United States Patent 9,976,180 (METHODS FOR DETECTING A GENETIC VARIATION IN SUBJECTS WITH PARKINSONISM) - sequence listing, part 17

SEQ ID NO: 217 - DNA, 493273 bp, Homo sapiens
aaaatttaattgactgtctttggcttgtaatgctctgaagtgtaaacaggtgaaactgggaaaagaaaatgaattatccaggatttctagacagtaggatcctgttgaaagtcagcatgaccaaatattttgcacatcccctgtgcaccacacaaaacaagcaataaagctgtgcttatagaaagtttttgaaaaaaattacatcaagtcttgtcttaaccagtcggaaggcaattgtgaatggtgagattcctctctttattaattacttaaacttccataatgaaattcaggtgtgatccctaaggctctgcagcccagaacagttaaatgaactgcagaatatggtatttgccaaaggggaattaattatgttaagagatgtatactatgaataccaacaagcctaaatatgtgctgaatagtagaaaagggataaactagaattttacattataaaattccaccaacctcacaatcatggcccatcatctggttgaacatttttggttttgtttcatttttacttttgccattttgatctatgcttgcaccaactgccacatccaacctggccatctgcagcacacggggaactttttcttataccctcccctccccagtaatccatgggacctattatttaatcaaagaatcaaatactagccctcaggtcaaacaatgagaacaaactcactccctgtattttgcgctgaacattcccagaaaagagtcattactaatatgcatattaaagtgtacttatgccaatatcaaccagttagtaatagacagtatttctttctttcttttttttttgagacggagtcttgttttgtcacccaggctggagtgcagaggcgtgatcgtggctcactgcaagctccacctcctgggttcatgccattcattcttctgcctcagcctccctagtaggtgggattacaggcacccgccaccacgcccggctaatttttttgtatttttagtaaagacggggtttcaccatgttagccaggatggtcttgatctcctgaacttgtgatccgcctgtctcggcctcccaaaatgctgggattacaggcatgagccactgcacccggtgacaatatttctgttttggggtagcaatgataacttatataaatgatgaatcattccaagttccataactgcaatcggtcaaaagattaaattattttcaatctgccccacagccatatgtgttataattttatagtcctttcttaatacaaagtcccataacaacctcagagcctcaaaagctctttcactaatttgagcaaattttctcttttcccattcaaaattcacctccttaattcaccatcaagggggtggaccaggttgaggggaatcttctttttagtaaattaaaaaaaaaaaaaaaccacaactgaatgcaataacattttctaagtttctagcaaagtgttagtttccttagatttttaccaatatgtcaaaagttgatatttaataatctgttctacccaacacttaattggcagtctatccattgaaggcaaagagcagaaatgaatgtctctctctgaatacactaagtgtagtcaatcagaattactaacaattggccaggcatggtggctcatgcctgtaatcccagcattttgggaggccaaagtgggaggatcatttaagaccaggagtttaagatcagcaccatcaacatagcacgaccccatctctacaaataataatactactactaaaaattaaccaggtatggtggtatgcgcctatagtcccagctacttgggaagctgagatgggaggatggccttagcctaggaagtcaaggcttaaggcggcagtgagctatgaggactacattgcacccaagcctgggcaacagagtaaacctctgtctaaaaaaaaaaaaaattacgaagaattcatggtgtaattgagaaggctgcaaatagttgttttagattgcaggttcttgagtcagactctctgggttcgaatctcagctctgtcttttacttgccctataaccttgggcaacttccttaaggaattttctcagatgtaaaatggggatgattacagtaactacttcctcaggttgtcaggagtacatgagataatgtttgttaaatgcctctcacaatgtctggaaaatagttaatttataaaaacagttaccaccaccaccaccaccaccaccactaccaccaccaccaccaccaccaccaccaccaccaccaccaccactacacctagagaagcatgctaaagagaagacacaatacagctctcaaagagtttacaatctcaatttgcaagtattaaaaacccccactctctaaaaatatggtagacatattaagcatatgtaacatatgcaataaatacacacatcatactttcagtaaaatataaagtattcatattcaaaaggcttctgaaagtaggccgggcatggtgactcttgcctgtaatcttagaagtttgggaggccaaggttgcaggatctcttgaggccagcagtttgagactagcttgtgtaacacagaaagaccctgtctctataaaaaataaaaagaatggctgggcgcggtggctcacgcctgtaatctcagcacttcgggaggctgaggcgggcagatcacgaggtcaggagatcgagaccatcctgactaacacggtgaaactccgcctctactaaaaatacaaaaacaaaattagccgggcatagtggcgggtgcctgtagtcccagctactcaggaggctgaggcaggagaattacgtgaacctgggaggtagagcttgcagtgagcagagatagcgccactgcactccagcctgggtgacagagccagactccatctcaaataaataaataaataaaataaaaagaattagccaggtatggtagtgtgtgtctgtagtctcagctacttgggaggttaaggtgggaggatcacttgaacccaggagcttgaggctgccatgagctatgatcgtgccactgtattccagtctgggcaacagagcaacaccctgtttcaaaaaaggacttctgaaagtgagtcaggatataagtggaaaagtacctgctatacgacaagcaaagccaaagcagcagttatgtataagacacataagggcttcaacacagagtttttggaggggggataatattttaaaaaataaataaaaggttgtggactgctccatagaaataacacattactacatattgtaactatcatttcttaagagaaaggacattaatggaaatgttggaaggacataagatcagaatttaaaagtcttttcaattttatgtctttggatttttacattttgaacactgaaacagagagatgtgatagggagtgactgaggagtgtgagaaagctacctgagctgagagttgaagccagacatacaaagatctgaagcaaggtaattctgggaagcatcaccagctaattcaaaggtcccgaggcagcagtgagtttggcttgtgccaagaacagagagagaaccagtgggataaaataaaggcaggcaaacaagcagatgcaagattacataaactcttgagttgggtttgatgggtttcagcagagatgtgccatgatatcaagatgagaattagaaggaatctcctacctgctaaagggcaaagagcactaaaatggaaggaaaatcagttctaatattagagccacattaacgttgaaagtgccattcaagctaatgaaaaaactagaaagtaatgatggttgaaaagattaggatgatttaggtcaacatgttaaatttaagaagagaatgtgacacaaacaaggagccacctggaaaccactgtaaatgcaagtagcacatacttagagtctgcttatttctatacacgtggaagctactatgtacagatggtacatgtgtacaggttgggacaagataaactcccccaaaccagggggagtctaagatcatggttagaagactaaaagatttaagctttattattgaggcactcaaaatgagaaaaaagtttgtgccgacatagcattttttaatactaagacagacatttaagactatctagacaaaaattaatacctgtaagccactcttgtgcatcactttgggaaagataacttgatgctcagaccattaaagtaatgccatctagttcctggaactaccagctcaaatgtcatcttggccactcagtcaaagtagatgaatagacgacattctatttcatgatgggaagattctggaagaggtcttaaaggaaacattcaagttttatcttgtgcagaagaagtgtagatagaatacatggcacttatgagaaaagaggattgtcctattctagataacatttgcccagctgtagaggcactaccctggaggcaacagaccatgcgacctgttgcttcagtgatataattcacttgagaaataaagctgtgttatggaaagtttattcagagctgcatcatataatggcccacctgaatgtgccccattctaccaaaaaacaaattccaaaatataccaccattcatggcgagagtacttgacatgctcttgtctttgttgtctaaaaaataattgtccttcacccgagacttcgcaaaatgcaagaactaaatgcagtttccccatgacacagatcatctacatccttccacaatccccaacacacacacactagatttgtgatatcaatgacaaagtttttcttgggctcgttatatagaaaggaaaaaggatgtttggaaattttgtgaaacacctaattcctaagaaaaacatttgtatcatcatcattccaatcactggtcaggtatgattaaataatatataattggcatgattaaggtagagcagcctttctacttactaacagaaaatacattttccacctcatactgactacaggcaatcaagctctagaaactcctactctatccctctcaaggctgagaatggagcatgtgaggactttatcctcaaaagagagaaaatttagaagactcttctggcttttaaatttttcttaggtctaaatgacacatttgtttattcatgggtttttttattcttcttcttattttttttttgagacagagtctcactctgtcgcccaggctggagtgcagtggcgtgatctaggctcattgcaacctccgcctcctgggttcaagcaattctcctaccttaacctcccgagtagctgggattacacgcatctgctatcatgcctggactaatttttgtatttttagcacagacagggtttcatcatgttggccaggctggtctcaaactcctgacctcaagtgatccacaggtcttggcctcccaaagtgctgggattacaggcgtgagccactgcacccggcttgtttattcatgactccttttggtacatctatgttgagaacatattacatgccaggtacaatgacaaaaaaaaaaatgtgacaggcaagagaagaaatttctcacaatgcaaataagactatagggtaagagaagagactacttaagcatgggaattactgttgcacaaaactaaaacttaaggatagggatgtttggtattattatttcaatcatgcataaagctactcaacctcttgactcttattgtaaattagaattaaacataaaaagttctggttcctgacattttctgatggcccaaattttctattcttcttttattttaattgtaatctatttcctggattaacaggccaccttgaactaaaaatgttggttaatgttttacttgatccccatatttggagtcaggtaggtatgtctgtatatatgtacatatataagtatttttcatgcctgtggaagttggaatctacagctatataaggttaaaaaaaaaaaaaagactggctgggcatggtggtgcacgactgtactcctagcactttgggaggctgaggcgggtggatcacctgaggtcagcctgactaacatggtgaaaccctgtctctactaaatacaaaaaattcgctgggcgtggtggcgcatgactgtaatcccagctactcgggaggctgaggcaggagaatggcttgaacctgggaggtggaagttgcagtgagctgagatcacaccactgcactccagctggggtgacagagcaagactccgtctcaaaaaaaagactgtacagactgtaccagatagtgcttagaaaatgtttgcttaatctatcaaaataaatcactttagttgggcacagtggcccacgcctgtgatcccagcactttgggaggccgaggcgggtggatcatgaggtcaagagttcgagaccagcctgaccaacatggtgaaaccccatctctactaaaaaaaaatacaaaagttaactgggtgtggtggcgcacacctataatcctagctactcaggaggctgaggcaggagaattgcttgaacctgggaggtggaggttgcagtgatccgagatcgagccactgtattctagcctgggcaacagagcgagaattccatctcaaaaaaaaaaaaaaagaaagaaatcactttaaaatcttttagagttgttgaatattttgttaagaaaataccacagaaataatagtttgaaatggcactttaaattagacatcattaaaattttactgacaaatatttacaaggactgtcttttttattgagacagagtctcgctttgtcgcccaggctggagtgcagtggcctgatcttggctcactgcatgctccgcctcccgggttcacaccattctcctgcctcagcctcctgagtagctgggactacaggtgcccgccaccatgcccggctaattttttatatttttagtaaagacggggtttcaccgtgttagccaggatggtctcgatctcctgacttcgtgatccgcttgccttggcctcccaaagtgctgggattacaggcatgagccaccacgcccggcacaaggtctgtcttaggttgtcttgtcattattcccccagaatattttgaaaaaggaagagaaggtataactagtgtttgcttaagcattaagacgttcccattgttttcactaaaattgaaaaattaatccattttgttgtggattgatttgattcccaggatgagtgtaaggcaggactcatagaaactgcctgtttggcccttgctgaaataaataaatgacttacaaaaataatacccatactatggaccctaacattcttatcctctaagcttcaaccacatgaatcttgaaattgacaatagagccagaaagaacaaacagtaaactatttacagtcactcccttctactactgtgaataaaatgcattcaaatgctatttgttaaagtaaaggtggtcaccctaccaaattgctatgtaactacttctggaaatatttctacactgtaggcaggcataacaaatttctgaagtaaaacataatttggtgggtatgaaaagatactttgtaaacatcaactaataaagaaatacacttaaaaacaaaaaaaaagacagagagacagggtctcactctgttgcccaggctggagtgcagtggcacaatcatagctcactataacctcaacctcctgggctcaagcaatcttcgcacctcagcctcctgagtagctcagactacaaaagcacatgccgccacactcagctaaataactttttttttttttagagacggggggcggtctctcattgtgttgacaggccggtcttgaactcctggcctcaagcaatctacctgcctcggactcccaaagtgctgggattacaggtgtgagccaccacacctggcctaagaaatatactttttgaatgacttaatctaaaatattaaaattctaacaagtcaaaacacatgcaccctttgaaaacgacttctggctgagaacataggcaagacaaatatagcaaatgaaataggttaattaaaaaaaaacctgtcagttatttaaatttttaaaatactttttaagttcagagacatactgaatcatattcctcagttatcagcaagtgcttttgatagctttatgaaatcagctcacaagtttgttaaactcacattaagaactcaatcccagatgtagttatgatatcaaataaaggaactgtctggaggaagaaatgtacagacatagtaatcaaattctcatacaggattaatgaatgacatgtaggccaaaagatgattcatcttattttaaaagtaactttaaaaaaaactttgattattttagaataaaacacatatccttataggtttccttaggcagtgtcaaaattaattaaatgtatttatgatatattaatacttggtcatcagaaatgtaacagaaagggaaaacataactcttttgaagagtatacctcatcttttccaaatcaagatgagtcaaatgaaatttgcacaaattttccaaacaaaggaatatccaggaactagacatcattactaaattagcaaatctttaagaaatatcttaagataatgtaatgataaagcccacttttaaatatgagagctatttccaatgcagtgtctatttccaatacagagtctatttccgatacattttttgttttaatagagtcatatttgaactatgtttctttcaatagaaattgactattttttaaaacccaagtccattaaacagtgagttaagaaaaattacttgaaaaaattagctaaagtctcccaactacttacttataaagtgagaaaaataaaattaatattaggctgaggtgagaggatcacttgaggctaggacattgatatcagcctaggcaacatagcaagatcccatttctaaaaaaagaaaaactcagcatggtggtgcatgcctacagagtcccagctactcaggaagctgatgtgggaggatcacttgagcccaggggttcaaagttgcagttagctaagatcacaccaatgcactccagtctgggcaacagagtgagaccccgcttcgtaaaaaagaaaaaaaaaaagggattttgatcagatataagaaacattctgggaatcaaagaaaaacatcaaattattcaaaatgaaatatccctcatgtaaattacatgtttaaaagtgactacacattatttgcaatgtttttaaaatttcaaataaaatttatccaataaattactttatagtctcatttctggcaccagtaataatatcaatatgttaaatagaaatgctttttatttaaaatcagatttaaaagatatagtccatccaatttctacttctacatttctacatattccaatactgactgaaggcaaacacctcatttccttcagtgtttactcccctctgataaaaacgctgagggtataccaagcgtaggactctgttttccttcaaatccatactttgttcctgtgaactcacttgggggaaaaaaaaaactatatttttgtataagctgaatgagaagcacttgtaaagattgtcagatacttaatgtggcagatggataaaagggatgggatgagctctattttcagactaataaaaacctaattatttcagaatcaattatatttatgactaattttttaaagtccaaaaatgtattttgtcatgagaaatttgagctccaaaattaaatagatttagtgttttgtttcctatactggattatatttcaaaaatggttttaggtggaattgtaaagataagcaattttagcacatcttaataaatccaaagacacaaaattcaaagggatgattttatttttaaatggtaatttacgtaaaagcgattcatcatatataaggaagaatatattttcttggtttatatcttttataattaaaactgagaaataaaactgtggggaatataaatgtcttatacaggtttttatttgtcagaaattagtctattattaggttacagaaaatcttagattttaaatgacattgaacctactaagccatacatttttttaaatccccacaatatctaaaacttttacccttgaaagaaaacacactactgtttcaactataagcaaagttgtctccaagtattaaatgtatatttcttaaagacttaaaaaattaataaacattttaaagaatatatttattaagtttccaggaaatattctgtccttaccctttatttttctatttggaatacattgaacttagaaatatgtccaagataaagaaaaagtttacatagttttctgtgaaaaatgatgaccaatacagaaaatgtagtaaatacatgaatgaaatgtaagaaagtaatcatttattttttatttgcacagattaagttaatccacactgaaaactagccactgaactaaaaaagcaatagctagaaaaagtttacgtgatgtctaatgcctccaccctaattatcattaggttttacctgccaagtaaaaatagacactctagaaaatatttcaaaggttttagtatgcttgacccaggactattggcaaccattgtgaacttcagggatgattacggtatttaataatgaaatgcttaagtacacctgaaaatggatgataggcacttttaaaacttcatttgtttttacctccatttcattagagtcgttatagtattaaaaatattatatttgcaactcaaggggacatcatagtatgctaacaagctaaaacaaacctatcatttatttccactgtttcttggcagcaatataatgattttaattcaaggctttccaaattctgcaaacattatggacctttcatcacagtattagattatctatccgaatctccaaactattacatatcttagaaataattttttatttagtaatcattttaattgtctaatcaacaccttgaattgaaaatcatactttaattgccaactgtatataacctatgtaattaatttaatgcccagtaatttatagctgattatagcaacatatattttaatgagagcatgtacaagtgaatgtaatgaaattgctaattcctaaaaagtttttgcttatttataccttgcttagagttaacaggaaaattatattttatccaaacattatgcactgcaataatggcataatgaagacataagactctcctggcctaatctgattctctgcagagcagatgtagttagtacttagcagtctagactaaatataaggagatttattttaaagtgcatctttaccaatactcttgtgatggtcccaagatgaacttaagtttacttaattataatgataaattgttaaaacatatataaaatcccaaacagaggcattccaaaaataacagagaactaagttccaccaagagcccatcaaaactcaagtgtaaacctcatgtaagtcattgaaaacaatgaaataccttaaaggtaattgaataattgaacagtgaaataaaccaaaattagagtgatataaataagacttccatttgtttccatctcactctgtgaatttacatgtaagattaagtgataaactaacacttataaatataatttttagcttaataaaacagactggtcttatttgtaaacatatatatatatatatgattcacagatataaaataagggacaatcaaatactaagacatttgctgtctttggagaaatcatcatcattgccatatattcataccccatttccaaattataaattcacttgggaaaatcaaagactttcattatattgacacaaaagttaacagagttgatctatgcctttacaattctttttaaggtgtcagacacgccaagctcttcctccatgctttgtaatttcaaaacatactccaagatgcaataaagttcttagtgatcaaaatgaagtgctgagattgccagagattacaggagaccaaccactaggtctctgcgattccagcaatcatggtgacagggaagagttgccacttgtccactcttctattcatatatctacctactcacctactcatccatgcatgtacgtaggcatccacctactcaactaaatacacccaatgtttgtcgtaccttgtatagtgaggctgtccaagtctttagaagttcacacttttaagaaagggaaaaggacctgaaaaattggcagatgaaaatgaagacagaaaagaggaaaagaaagaaaattaagactaaagtagagaaaaacaaaaagtgtagaataggttatatacatcttgtaaaacaagatattcatccttattatatttctatcactcacttatctcttagataatgaggtttctacagaacataatataaaatgacatattaaagaatatggtgacatcaggagaactgtaaagttctttgaaaggcaaatagtgccgggtgtggtggctcaggcctgtaatcccagcactttaggaggccgaggcaggtggttcacttgaggttaggagtttcgagaccagcctgaccaacatggtgaaaccccttctctactaaaaaactacaaaaattagatgggcttggtggcagatgctgtaatctcagctacttgggaggctgaagcaggagaatcgcttgaacccgggaggtggaggttgcagtgagccgagattgcaccactgctctccagcctgggcaacagagcaagactctgtctaaaaaaaaaaaaaaaaaaaaaaaaaacaaggcaaataaattaataaatgcagctagaaatggatagaaatttattttgaaaaacgtatttatttttgaacttttttctggtccactggagaagaagccacaaaagatcataaacaatgtgtacgtaaaattataaaattgtatggttgaaactgtaatgcatttattccaatttcaaacaagaaagggcagattagacatttgactcatttgacaagcatcagctttagtcctctttggatttattctcctgtaattcacagaagagctctgaccaaattctaattttttgttcttcaatatttcttatctttacatttcgtcatgcattaaaatcctatttggacttgtctggcaccaatggcacattcttcctggctaacagcattatgcagatattaataatgttttaaaagtggtcaagggcatatcagcaatgcactttgtccctcttttaatgaaagaaagctcatacttaaacaggtgaactatcacatacctaaagttccagtgggaagagagaatcaaatatcaagtctaacaagatatttgttaataagagcaacaacaggatcttgaaaatacaaccataattttcagaaagaatacctaaaatttttgcagaaagtcatatttctcttagtcttatcatgaaataacagcacctaaaagcttggattctatgttcattgttcccacaaagtatgaaaaaggcatgagaaacattattaaataagactgatcacagtagagctactaactgcattcattatgttttttaaatcctcaaagccaaatacagtttttaccaccatgtccaacagagtttcagtgttataatgaagtttagtaattcctttaactacctgtgaaggaagtaaagtatcttctaaaaacttctgggtgctattgacataataaaaaaagagggagggaaattgctctataacagattttataaattttttatggtgtagtttttatagtgcatctataaaatacactgaaatgtgattatcaaatattgttcagctcccataatgaagaaggctaacattaaggatctgtccttgtttttactttgtaactcctattgtctgagccagattctcctcaggaccttattttattgtgattactgcaacatccctgccagcaagtgtagagcagacttggtcactcctttgctgaagtcagccaagagaatattctattagacaaagtaacatacgcctcaaaggcttggaagccaggggaaaaagtgagacacatacaagacaataatacataaaccaattaacttagcctctcaggaaaaccatcctcagtctcatcaaattgtgtattatctggcaatataaattgaaaatctatttatagagtagtcaggctaaatctcttattgctaaaacagaagtagtgaaggtcaaagaatgcaaaatcctaggaaacacaatttttttccaaaggctgtttaatatgcctttgatatagattactttattgacaatggttcttttgtctttctgaaaactacatctgcacaacaactaggtcaccttgaatttcaagtacaacattgcctataaatttaatttaacatcatattatccataattaccatgaacaggaggcaggtgtgacccttatggttaagctagagggaccaaggacaggataggttaatagacttgctcaaggctccagggtctgagttaactacaggctctacatgagccacaagtatgacctggctattaaaatattattacaatcacatgcttctttaaagagtagtacttccaaatcaaaggaggtaccagttccattgctggatagtacactcttcactccaactctgaggaactttattttagcgttagatggcatctttcatttcatagttggaattgaaagcatccatagagggcaatgagaaaagcaagcaatctgaaattgacgccccaggaactctgaatcagggaactctgagttgcagagaaaaggcggagcaaggatttgagggctatgtagctatgtataaatatccaaaggattgtttggtaaaaaatcctccaatagatcatttattctagttgggaatgaaagagaagaggtttttttgttcgcttgttttcgtttttgttttttttttttttgagacggagtctcgctttgtcgcccaggctggagtgcagtggcacgatctcggctcaccgcaacctctgcctcctgggttcaagcgattcttctgtctcagcctcccaagtacctgggactacaggcaagcgccaccacgcctggctaatttttgtgtttttagcagagatggagtttcgccatgttggccaggctggtcttgaactcctaacctcatgatccgcccacctcagcctcccaaagtgctgggattacaggcgtgagccaccgcacccagctctttcattttgttgtttctaaatgtaattagggctaccataaaataaagggatttttcctaataagtagtatgcttcatatcatgaaaatgttctaggtaatgtgacagcctatcttgtcggtatcattatcagaggggtacctaaatttggaaggcagtgaaatgatacatggaagatctttaaatctaagcttctgtaattacaggtcgtggagtctggcagagaaggagccaaactcagaactcagatctatgcagattagctctctgcccttcctttaataactggactcttggagcatctgattgacaggtctctaccccaatctttctactctgactgaccttacataacacgtagggttctctaatacagctgatgctattaacttgattaaaaatatttgataacttttaagtcgtcataggacaaagcccaatctgtctaaagtgacatattctggtctacacacctgaatttacatggtctcctaccacacttctctaacttccctgagagtgcctcgggtgtcaccaagtgggggtggggtgtaacacggctagcagctgtgacaccaggccttctttcctgcttggagaaggcagctttgcttttatctctttttcatatatatagatcatgtatataggttcaaaaaaaaataaacctatatataggttcatgtttttaaaacggcttagctttagaaaaccactgcttcagatacacaaaggcatcatggcacctctaacagtacaattaagtactaactacatgccttcctgcctttagacactatcttcacctcctcatcccttcctggcaaatgcctgttcgtcttttggggctgtaaaacaagcacaaccttctctgtttcttcaattcccaaggctgaattatttgctctttctcttctcccattctacacatgcctctttttttttttagtactttatacattaaaaatagtattaaacaagcttatctttcccatatacaattaccttcccagagctaggggtatgccttatttatatttttatctccacactttgcacagtgttttggatgtagcaggctctcaataaggctctgagtgaatggtagtcactggttttcaacctgtaatctttgacattctaggattctgctcaagattgagataattatgtaataataaccatggtaatactgtccttatattttccagcaacatttttcacaacccttgaattggaaatatgggtttgtggtcaatgagatgggtaaaggctggaaatttcctttaggaagtgatctccagatacatgatgatagaagtcatggaaattagatttgcctctccaaatgtcaggctacatttccatcatagggaaagagaacatttaccaccacgggctgagcaccatcaggcatattgcatatatcatttcatttaatacaacaccgaaaacaaatttgctctattatttctactttataaacaatgaccatgaaacttggaaacattaaaataattcaggctcttaataagagaaaattctagcctcgggaacatggcaagaccccatctcttaaaaaaaaaaaaaaaaattagccaggtgtggtggtatgctgtggtccatggtcccagctactcaggaggctgaggtgggagtatcgcttgaacccagcagtctgaggctgcagtgagccatgttcgtcagggtgacagagacagagagcctatctcaaaacaaacaaaaaactcagaaaattctatctcgtcactcctattgcatcatgactactagttcactcgctcattaattcactcactccatttattgatgtttatgaaatttattaagcacattagatgtgcctttaacatacaaaagtttcttgtaagtacattacttggatagattccaaatatttaatttccaggtccaagctgctttgaaatctagaaacaggccattatttaatttttttttttttttttttttgagacagagtcttattctgtcgcccaggctggagtgcaatggtgcgatcttggctcactgcaacctctacctcctgagttcaagcaattctcctgccttagcctcccaagtagctaggattacaggctctcaccaccacgcctggctaactttttgtatttttagtacagatggtatttcgccacgttggccaagccggtctcaaactcctgacctcaggtgatccacccgccttggcctcccaaagcgctgggattacaggcgtgacccactgcacccggccaaaacaggcctttatttaaagacacattttgaatttaaaaaaaggtaaatatgcaacttttaggggaaaaaacattgtatctctcatacataatatttttaaattataatgtgcccaagataggaggttttatattcagatcattttcttgagctagtttaaataacagttttttgtgtgcctttaaatactggtctatatattgtttgcaaaattgtgaccattacattttaaaaatctctacaaacattagatgatatcacataacaaaactttgacaatttcacaattttattccttttgacaaaattttattttaaactagtttaacatgtgtaaggcaattttggatttaagatttccctattggttttgttttaaaatgcacctctctggccatgatttcagcaagccaaatttcacactacacattttagaagtttcttcaactcagaacaattgcagtaatcccagttataccactacttcttagctcaaggatttggctataccacaagttatataacgttcccagaaatgtaactgctgagaaacagtcgaaatgtggttcactataccttacctgtaccaaacgtggcactcctacccccaataccagtattataaagtagttccctggtcagaaaacacaaagcatacctttaataattgggacaaacacacacacacacacaattgggccaccatttgttctaagtatagttgcataacaaagctgactgctttaaaagctggactaaatcatgctgattgcttgaaagtccagactacaagaacattggggctaagaactgtattttcttcataacctttggctaaatttgtcaaactgaactccaaaattctcctaaagattctagttctgtctcctattcatttattgtagatgttaaagtgtgactagatgcacgtcatatcagatacagattgtttaaacaacatgtgacggcaattctattatgtgtcaaatagagatttttggtaagcaggcaatcatttaccttagagcaaacaagttagaaatcaagaaggaaaaaaaaaaagccaccttaacatggctatcatttcatttttggctgtctaatctttaggtcatagagagagtggggcagagcttgccaaggttgcaggttcagacatagagagagtggggcagagcttgccaaggttgtaggttcagaaatgacttagcatttaccccccagtcaacagaaggcaatgaattccagtcaccatttctctgtacaattcctcagtggactacaaagagccaactcacttgaaggaaatgctaaaaacagaataaaagagtagtcaccttcaattgctcttagttttctctttctgtcctacttgattggtatttcctgcattacctatgactgctttctttcctcatggaagggtacttattagaataagattatatctgtaataaaaagaatagttcaaaatatctaaatgttcagatagtccgtgtagactggttataaacagatctgtaaaaaatgactaaattatatattcttattgattgaactagtatgtattaagtcctagaaaggagaaaagaaataaaagtattcatagttcttgaccataaggaacatacaattggattaaaaatagaatgggctgggcgtggtggcttacacctgtaatcccagcactttgggaggccgaggtggatggatcacatgaggtcaggagtttgagaccagcctggccaacatggcaaaaccctgtctctactaaaaatacaaaaattagccaggcatggtggcatgtgcctgtaatcccagctacttgggaggctgaggtgggagaatcacttgaacccaggaggcagaggttgcagtgagccgagatcatgccactgcactccagcctgggcacgagagcgagactctgtctcaaaatacataagcagagagagagagagacagaaaataaaaatagaatgaaagtgtttgaaaaaattaaaaaatcatgcaaaatacaaaccagtttgaatgaaaaaaaggaaagaccaggacattctatgattagctgccagattaatgatagaggcaacagaatgtcctagggatttggagagggagatgatcatgttagaatcatgggtcaacaactgctgtagagcaatggaattgactttattgatttttaaagaaatggctaaattcaggtaagtagatgaagggcagaaggggagccacatggtgggaaaatgcagggcttactggggacagcaagtaagccagattggggcaacagagtttggtcaggaagggagtggatggttagcatggtacggcaggccagggccttatggggaatgcctggacagctgtgctcaggagtctcaacattcccactgaatgctcaacatgctcggtctttatcaagggctttccatttacactgtcatgcttcaatctctcagtaaccccgggaactgggactttggatcaggagggtcagtgagttgaagagacttgctcgttagtgaaagagccaaaattcaacctcagactctatggctcacaaagtcagtgctcttgctggtggggacatgggaatttcttgagtaagggagtgaaataaaaaatttagtattccaggaagtatactctagccagctggtactgagggactgcattaaacaaaacaagtcagaagtagttccactgaaagtttcaaaatgtaagggagattgacttgttcatgtaagacatcaacagagctagactgatactagcataccaaaaccaactaatcaatagcttggtcatgctactctctctgtgttggtctcattctctcctactgcatgtttcatgtctccccgcaacatggtggatgtggggctgggggtaggcagagaagaaagtaattatcttagccacagcagaaaaagagacaacccctattacaacatcttcatataaaacctcagtaaaggactctgctagggcatcgctgtggcccggaggtagagtactgacagtgacagcacaactgaattaaaaagttgtggagggagttgcagactaaaagaatatagaatgctcttctcaggagacattgaaagaacggatggaaagacaacagttattcactataaccagtatgcactgaagttacactgaattaccaaggtaggataaattcttccacggttgaagaccataaacatgacatggatcatgcatttaattatgttatcctgagttaattcgttatcacataacggagtttgcatttttattcacagacatgttaaagttatatgagcattgcgtgtcattctaatggtatgatgatttccaaatttaccctatatctttctctactggttcacatgtcttgtttttagaaattactttaggaaagatgatttcagttttgtctccctttgtttcatttctgtttttgttttgaaagggggtaaagttatgttgcccaggctagagtgcagtagctattcacaggagtaatccccctgctgttgagcacagaagttttaacttgctctatttccaacctgggccagttcccctctccttaggcaacctggtggtcgcccctcctaggaggttaccatactgatgccacttagtgtttgatgcaaacacccaatgtgcatgatgcactacagcccagaactcctgggctcaaggaatcctcctgcttcagcctccagagtagctggactattggtgcatgccacctcacttggcttatttgtttttaaaatatgctactttcatactcaattacctttcatcaaaattttgtatatttataaattatatatatataaattatatatatatatatttttttttttttgagatggggtctcactctgttgcctaggctagaatgcaatggcacgatctcagctcactgcaacctccgcctcctgggttcaagcgattctcctgcctaggcttcccaagtagttgggatttacaggcacctgccaccacacctggctaattttttacttttagtagagacgaggtttcaccatgttggccaggctggtctcgaactcctgacctcaagtgatctgcccacctcaacctcccaaaagtgctgggattacaggtgtgagccactgggcccagccaaaattctatatttcatgatactatatatttctttttctcagccttccccaaaggaaccatttgcctattaccaggttgactatgctataggaaaaaaaaaaaaaacaacagtccgacatttggggattactggccctgaactgacacattccaagagatccaaaacatcactgtggcccaccagtcagagcaggagttagtggaggtcaggtgatcaaggagttttacctcaggtcagtcccatagtgggtacagtgggtccctgaacccatcctgtggttatttcctcagttccaaaatgtataattggaaaaaaactactgagcaactggcagaatccctgcattggtggggaatatagaatctttcttactttagaatcttctctaccttccattctgggtagtaaaacaaatatctagtgtgctcagaattagtactttgatttcaaaagtaactgcctataatgtctacgtgtatacctaagatatggacatagagaagcaaatattataatgcctcttaaattacttattttttgttttaaagacaggatcttgctctgtcacccaggctggagtgcagtggcatgatcatagctcaacacagcttcaaaatctgtgactcaggcaatctttccaccctagcctcccagtaagtccctcagctgggactgcaggcatgagccaccatgcccagcactatacataggtatcttaaatccatattatctacatttatcttaaatatacatcttaaaggatatatcctatggtttggaggtatcaagaaagtaaatatccaatttttcctaaacttattttataagcaactggaagccaatccaattaaattaatcaatgataggcaaaccatttggtgacacagaggttttgttgttgttgttgttgtttgagatagggtctcaccctgtcacccaggctggagtgcagtgacacaatctcggctcactacaacctctgcctcccagactcaggcaatcctcctaccaccaccacgcctcactaattgttctgattttttttttgtagagatggggtttcgccatgttgcccaggctggtctcaagctcctgaactcaagtgatcttcccacctaagcctcccaaagtgctgggattacaggcatgagccacgactcccagcctgaaatatagattttaatcttcagcttgcattttgttctaaacaacttgttttcaataagaacgggcagacaagtttaagccaccatttgttggagcagatcatttattggtgtgttcagatggtactgtactagccttcctcttcccctccatcctcctagccatgtgcagggaattttctctttttgttggttaacactcttcctcatctggattgccttcaactatgtgacaacgaagaattcaagcaccaaaatagcagcagctacatatcctttgcatgacagtgtaatttcttctgccttaaggctgtgtctagcactgaaatcatagtctgtttacttcgatctggtgctacattacaatgggagggatttaactcttacttataaacacacaagggaattatttctcagctctgtttagattagaattagagatgaaattgtgcagttcttgttgctgctgagccaatcaccccattgagcaaaaacttaccttcctactttactagacaagcaagaatactgtgctgtcttttaaaatgttctgcaatataactattagaaccaatacagaaaatttttggtggctagtgagtataggcaattaatcttgaaagtttcccacttgacttgaatgtttgactttctcttcagatgctttctgctggggaaggagcacttctgaattaaagaattttgcaaaagaaaatgtggccagggatattatgtgcgtgtgtctaaaactggggattatcagtacatgctaagtgaatatgaggctttataaaccaatattttaaaatttcatgatcagaaaaagtaatctttaacaccattctcttacccgtgatcgcttagtaatcttcgtgtctatgaaattctacctctgaaatatctcttcagctgttcccttctctctattcccaattttatcttttagatcctattgtctcatctgaatttttagaagagcctactaatttaatcttctgcttctgatcctttccctatgttaactttctaaattatgaatataatgtcacaatttggctcaaatgtgattttaaactataaagtaatttaaactgtaagtcatataactagtttgatgataccgtaaaggtagatataagatattaatactactactcagagacccatgaatgtatctcagtgcctggcacagaataggcacttgataaatatttgcttaatgattagtaagctttccatcgttgggcttatgagaagccaacatttattgagcatctcctttgtggcacatgcgtcaagtctccagcacttgcttgatctttagctaacactgttgttttaatgattttctcacaaagaaacagatagggtaggtattagtctcattttaagtatgaagaaactgaggtcttaagagtatataactttctcaaagtcgcaagactaataagtaccaaggctggagtttgaagttaagtctgaattcttaatcgaccctcacacttacaacatgcagctgaaactttttcttcctgttcctttgctttaatagtttaacatactatttgatacatacaaaagaatacatgtaacaaatataaattgcagagcctaaaaataaatagtaagtatcttagtttttaaaagtgagcaaaagataaatgacaagtcaccaaacagacaagtaagcaagtaaatgatgctcaacgtcatctgacattagggaattacaaatttagacaaagaataccactacacgtttgctaaaatagctaaaattcaaaacagtaccaccaacaactgttgggtgcaaagcaaatggaattctcattcattgatggtgagaaaatggtacaaccacattggaagacagtttggcagtttcttacaaatacgacccaacaatcacgctactaggtatttactcaattgattttaaaacttacgttcacacaaagcctatatgcaaatgtttgtagcaaccttatgtatagctacaaaaaactagaagcaatcaagatgtcttccaatagaagaatcgactacacaaactgcagtatagctatacaatggaatattattcattgataaaaagaatgagctatcaaaccacaaaaaagatgaattttgaatgtatattgctaagtaaaagaagccagtctcaaaaagctatataaggtatgattccaattatatgacattctagaaaaagcaaaaatatagcagtcaaggtctgtggatgccatgggttcagagtgggagagacaaatatgtaaaacataggggattttttttatggaggtgaaactattatgtatggtactctaaaagtagatgtaagacattaagtatttgccaaaacccaaagaactttatagcacaacgaataaatctcaatgtatgcaaattaaaaaaaattaactagaaagtcggggaagcctagcatgaaatgcaatctaaatatattataaataatctaaacatattacattgcatacaacaacttcccagaaaagtattggggtataaagtgcagaactaagtaactcttgaagaaagggaagtctgtaagactaaaggtaaaggaaactgtacgtaagaattgtctcccacaggggtatggattaattttgaaaccattatatatgtatactaaaattaaacaattgagtaaatggatggtggatagcgtgagccagatttctcactgttttactgagagattacagataagcaagggtaaaaacgctagaatgatccttatgggaatgaattagagctgaagacctcagtatgaactcatatttagtttaatatacagaggattacatataaaaatgtttttatatgtatatacatgggccagcacacacacacacacatgcacacgtgcacacacagagttcgctctatcagctgaggtctagaagcaataataccccagtggcacacagggcacgcagatcttggtttctgattccattttccaatgaccagggcttcttcaacaaaaggctgatcctgtctgcggcaagaaatacccaagatgagtgtggagcctcttacagtgccagagttaggaagtgccaaaagaaaaaaaatcacctaaaaccccacaacgatgaggctatgtcaaagggacgtaggagctaattaaaagaacatcctatgccaaaaatggaacaatttaagcaacaaaataacagagtattgaattataatccaaagtatgaaccaggcttgatggcacacacctgtaatcctagctacttggtaggctgaggcagaaggatccctggggcccgggaggatccctggagactaggagcaatatggcaaaactgcatctccaaaaacaacaacaacaacaaacaacaacaaaacaaacaaaaaacaaagtataaaataaatatccatgagtctctactgacataagtaaataattgaataaatcaacaaataaatggggtagaagagataaacctactatgtagaaaaattccaaataattccaaataatttgtgtaggtattctatccaaaagaaagtaaagcataactactctctaagtatggctctctaagtatgacctgtttccaaacagtagagtatgaaaaaagaaaaaaaataaaaataaaaaagagtggctctagagtggaaaaagtggagaaacctgacaaacactacctcaagcaggtgataaaagtttatatcaacagtgataagtcacattgacagtgtttacccttgatatgatgtgatgtggcactgtacctctgggatcttccttctaagtgtaatcatgagaaaaacatcagacaaattcctattgagaggcgctctataaaatacctgaccagtacacctcaaaactgtcaaggtcgtcaaagacaaggaaagtctaagaagctgtcacagctaagtggggcctaaggagatgtgaaaactaagtgtaatgtggtgtcctgtatgggatcctggaacagagaaaagcatacataaaaactaaggaaatctgaataccatatcaactttagttataagcaatgtatcagtattggttcattaactgtaataaatgtccccctactcttaacagaggaaaatgggtatgggatacacaaaacactatgtactatctttgtaataattctgtatatctaaagtcattctaaaatagagtttatttaataataaataactagctatgaatgtaccacccaatcagaaactagaatattatctgtaacctacagccatcctctgtgctccatctctccccttacttccggtacctcgcccccacctaaataaatcactatcctgaatgttgtatttaatatctttcctcgttttagcacagtcttattacacatgtatgcatatatacctttaaagagtttgcttatttttgagctttataaaaatggcactgtactatcttctgagacttgcaccagtggattatgtataagaaaatttattgtggcactctttctgaaagaaaaatctggaaacaaagcaaatgtcccaaataaataaacagtggtatagcttgcacaatgaaatattacacaaaagtgaaaaatataaactacattcaacaatgtggatgagctttagagaaacaatactagagctgggcgctgtggctcatgcctgtaatcccagcactttgggaggccgaggcgggcggaccacaaggtcaggagatcaagaccatcctggctaacacggtgaaaccccgtctctactaaaaacacaaaaaattagccgggcgtggcagcgtgcgcctgtagtcccagctacttgggaagctgaggcaggaggatggcgtgaacccagaaggcggagcttgcagtgagccaagatcgcgccactgcactccagcctgggttacagagagagactccgtctcaaaaaaataaaagaatactagatgagaaaaggtaaaggtgttaatctgaagcagaaggccctttgtcaaatggccacaacctacctcatctatctcacttcaccgaatctatttccagtcacaccaaacttctccatgcgacctaaacattccacactcttggacacccacttagcttttatttttttaaaaaggcatgttgtgatacaattcacataccacacaatttatgcacttaaagaacacagttcagtggcttttagtacatacagagttttgcgaccatcaccgtaatcaattttagaatatttttatcacactacaaagaaacatcatactcattggcagtcaaatcccatttcttgccaatccctacactctccctggccctaggcaaccaccaatttactttttgtgtctatggattttccttttctgcacatttcatctacagtaaacggcatagtatgacatgtggccttttgtaaatgactttcttcacttagcataatgtttccaaggttcatccatgttgtaacatgtattagttgcatcatcattccttttttttttttttttttttttttttgagatagattcttgctctgtcgcccaggctggagtgctgtggcgtgatcttggctcactgcaacctccatctcccgggttcaagcgattctcctgcctcagcctcccaagtagctgggattacaggcatatgtcaacaagtccagctaatttttgtatttttagtagagacgaggtttcaccatgttggctaggctggtctcaaactcctgaactcaggtgatccacccgtctcggcctcccaaagtgctgggattataggcgtgagccactgcacctggcctatcattcctttctattgccaaataatatgccattgtatgattatactcacttgcctttgtacatccagtttcttctgtcattgctctctgcttgtcaagttcctatttacccttcaatgcccagatcagagattacttccctaactcccatggcattccactgaaatattattacacttgtcacattgtattataattatcatgtgtatttctcctcctccacccactagtgaactgtgggctccccagacgcggggacaaagctttgtgcatctttgggttcatggcagttaccagaatttgaccaactatatctactcaacaaatgtttattgaattattgaatgagtaagttttcccacatttgtcaattttacatttattatacaaaaggagtatgcatactgtagaaagtgtgtgcaacaatgcagggttactatggtctcaaatctgggttcacatacgagttctgcttttgataactcaatggtcttgggcaagttgcttaatcagtctaagttccatctgaaacatggggataatatcacactcatatggttactgaatttaataagttatgtttttaaagagtttaacccaatagtggtagccattattatgaccaataataaaagccactaacagaagggtcggggaaggggcggggacctttaagcagtctgattcaggccaggtgcagtggctcgcacctgtaatcccagcactttgggaggctgaggtgagcggatcacctgaggtcaggagttcgaaacagcctggccaacacggtgaaaccttgtctttactaaaaataaaaaatcagctgggcatgctggcgtgcccctgtagtcccagctactcgggaggctgaggcaggagaattgcttgaacccaagaggcagaggctgcagtgagccaacattgcgccactgcactccagcctgggtaacagagtaaaactgtctaaaaaaaaaaaaaaaaaagtctgattcaaattcttcattttacaaataaagaaactgacacctcgtggggttggggggatgccagaggccactaaaggagggagcatggtgtgatggaataatcacatactatgaggcacgacatagctgatttttgaatcctagctctgtcttttactaactgcttatctttgggcaaatcgttgttttccaaacatcaattccctcctgagtatacgggggagcacaaatacctagctcacagatcagctttgtgaattaaatgagaaactactcatgtagtaggtttgtgtcatgaacacaaacatatacacatgtgcacatacatgaacatacacatacgaacatagaataatgcaataacaaataaattggaagaaagaaaagttttagaaagaaaaatgtatagtctaataaaaaaaaaagaggatagaaatcaccttaaaaggaagattaaattttgggaaaagtgatttatagtcagcctgcaataggaacagcatcttataaatatcagtgggtacaataatgtaggatatttaggaataaaagatgtttataaaattaatcattgttcatcttgccctctctccaaactggcttattttaaactttctagtattttctgtctgatattcctggagcagagctgaagaaaataaatgttctttctgaagcctctaaaaatagtccatcaacatgattttcctccaaaaatgaaaaccataagactggtaacatatttaaaggtgatggggcaggttttaacacacaactgtgccactgtttaaaaagtaccatcatgttcttttccttaggaagtgtttgtccattcactaaacattataaatgaagtagtagcatactcaaattgcaataacccacagaaattgtatagcaccatttaaagcatactattgatggggcataagtggctcatgcctgtaatgtcagcagtttgggaaactgagatgggaggatcgtttgagcccaagagcagtctgggcaacatagtgagacctagtctctacaaaaaaatatttaaaaattagctaggcatggtggcatgcacctggagctacctccagctactctggaggctgagatgggaggatggcctgagtctgggaggttgaggctgcagggagccatggttgcacctctcgacttcactccagactgggcaacagagtgagactctgaccctgcctaatgaataaagtaaaacacagtatgagcccacaaataatcccaataatttgataatatatgaagatctcaagaaactgtgaagaatacacagtggtattttatctctgtctccactaatttactggtgcctttatttatttatttatttatttatttattttttttgacaaagtctcgctcttgttccccaggctggaatgcaacagcgcgatctcggctcactgcaacctccgcctccgaggttcaagtgattcccctgcctcagcctcccgagtagctgggattataggagcctgccaccatgctcagttaatttttgtatttttagtagagatggggtttcaccatgttgcccgggctggtctcgaattcctgacctcaggtgatctgcccgcctcggcctcccaaagtgctgggattacaggtgtgagccaccgtgccttgccaattctgattttttaaaagatccctcacacttcattttttcctacaactttgtagcttggctgttttacatgaattaagtattaaataaacaagtatttgttgaatcttactttatacccgccattgttctggcaactgggaccaaaataaatggagatcctcctctccaggagcttgggttctcatgcagtgtgataaacagcaacaaacaaatgaatatgtaatatgtgagaaggaaatacgtgctatgaagaaagtcttgaagacagcaagggagtgagctctggggaaatctgggcagagggaaaagcacaaaagctccaaggtaagattacccgtgtcaggttcaaggagcagaagcgggacagtgtggctggagctgagggagcaacagggagagagctgggagatgaagtccaggaagtggtggaatccagatcagatagagcttttgcttttccccatgggagccacaggagagtcttgaacagaggagtgatatcatctaactacagtttcaaggctccctcgggttaccatgagagaatagcacatagaggagcaaggcgggaggagggagaactttcgagaccattgctgttgcacatcaggagtgatgatggaagcactggggctggtgagacgtcattaggttctgaatatattttgaaaggataattttaattgcacaaccttgttccatttgtcacaacatgttccctttttaaactgcagtctaaaagccaccttctccaagaaaggctttaaataaccttatggtctccaagccacttatataaaccctcctatttttccttaatctgtacccgcaaattgctttttttcttctatagactaaaggtcattgctgtcttagcctaatagaaacacaggaattaagtcagccaagtgatataacatggctacttcctaagaaatgacagtggagcaggcttaaaaggctcatcagtctagaacactcttgtctgattagggcctccgttccgacagcatcttcactgtgaagtgagacgaccttgagaatacaaagtgatcaaccagaactcatcttgtgggtcctctggtgtttttccgatttttaattcaacatagtgcacggacttcgatgttcaagtgacagcttaaccagttgtatttaaataatggcatgagcctgttcatcacttggttagaagaccaggatgcactggtattatagcatttatgcaaaaaccacagagacagaaaacagtatttgagaaaatgtgagaaagaatacagaaaggtctggaaagatatacactaaagtttcaatggttacctctaccaagtgacagttggaaccaggatgagaaagcaggatgattaaaggacactttgcttgatagtaatgtacaacctacttttgagaataaattattcttattgtgtagttaactttttaaagggtccattttagttatttggctccttcagcactattgaggcagatggaattccataatgtgtataaaaaacagttttatggaacattaatgcttgtatttcatattctacttataaccaaatattagaaatagttgaaaagttcctttccaagctgatatttagattcatgaaaggaacactggacccttggtgataatgaatataaattttcttaataactgataccctctatcatgttctatactgatacggtttggctgtgtccccacccaaatctcatcctgaattccagtggaaggtgactgaattatggggactggtcttttctgtgctgttctcatgatagtgaatgagtctcatgagatctgatgactaaaaaaaaaaaaaaaaaaaaaaaccccgggtgcggtgtctcacacctgtaatcccagcactttgggaggctgaggtgggtggatcatgaggtcaggagttcaagaccagcctggccaacatggtgaaaccctgtgtctactatacaaaaattagatgggcatggtggtgcattcctgtaatccccgctactcaggaggctgaggcaggagaattgcttgaagcgggacccaggaggtggaggttgcagtgagcccagatcctgccactgcgcagcagcctgggctacagagcgagacactgtatcaaaacaaacaaacaaaaaacaaataaaaaaacatgggagtttcccaagggagtttccctggacaaactctttttgcctgctgccatccacgtaagatgtgacttgctcccccttgccttccaccatgattgtgaggcctccccagccatgtggaactgtaagtccaattaaacctctttttctacccagtctcaggtgtgtctttatcagcagagtgaaaatggactaataatacagtacattggtaccagtagagttgggcattgctgaaaagatacctgaaaatgtggaaggtgactcttgttatgttttagcaaagagactggcagcattttgcttctgccctagagatttgtggaactttgaacttgagagagatgatttagggtatttggcagaagaaatttctgagcagcaaagcattcaagaggagacttggatgctgttaaaagcattcagttttaaaagggaaacagcataaaagtttgaaaaatttgcagcctgacagtgcgatagaaaagaaaatcccattttctgaggagaaattcaagccagctgcagaaatttacataagtaatgaggagccaaatgttaatccccaagacaatgggaaaaatgtccccagggcatgtcagaggtcttcatgatagcccctcttatcacaggcccagaggtctaggaagaaaaagtggtttcgtgggccaggcccagggtcctccagctgtgtgcagcctagggacttggtgccctgtgtcccagccactccagctgttgcagaaaagggccaacatagatctcaggccgtggcttcagatggtgcaggccccaagccttcacagcttccatgtggtgttgagcttgaggctgcatagaagtcaagaattgaagtttggggctggacatggtggctcacacctgtaatcccagcactttgggaagctgaggtgggtggatcacctgaggtcaggagttcgagaccagcctgactaccatagtgaaaccccatcactactaaaaaatacaaaactacctgggcatggtggtgtatgcctgtaatcccagctacttgagaggctgaggcaggagaatcgcttgaacccgggaggtggaggttgcagtgaactccactgaactctagcctgggcaacaagagcgaaactccactcaaaaaaataaaaagtaaaataaaataaaagaattgacatttgggaacctccacctagatttgagaggatgtatggaaatgcctgaatgcccagatagaagtttgctacaggggcagggctctcatggagaacctctgctagggcagtgcagaagggaaatgtgggcttggagtccccacacagagtccctactagggcaccgcctagtggagctatgagaaaagggccaccatcctcctgaccctagaatggcagatcctctgacagctcacaccttgcacccggataagccacagacactcaatgccagcccacgaaagcagccaggagggaggctgtaccctgcaaagccacaggggcagagctgcccaagactatgggaacctacttgttgcatctgtgcgacctggatatgacacatggactcaaaggaaataattttggagctttaagatttgactgccccactggatttcggacttacaaggggcctgtagcccttttgttttggtcaatttctcccatttggaatggttgtatttacccaatgcctgtacccgcattgtacgtaggaagtaactaacttgcttttgattttacaggctcataggtggaaggggtttgccttgtctcaaatgaggctttggacagtggacttttgagttaatgctgaaatgagttaagactttggaggactgttgggaaggcatgacttgttttgaaatgtgaggacatgaaatttgggaggggccagcggcagaacgatatggtttggctgtgtccccacccaaatctcatgttgaattcccatgtgttgtgggagagacccggtgggaggcgattgaattatgaaggccagtctttcctgcgctgttcttgtgatagtgaatgagactcacgagatttggtggttaaggaaaaaaaaaaaaaaaacaacagaagcttccttgcacaaactctctttttgcctgctgccatccacataagatgtgatttactcctccttgccttctgccatgattgtaaggcctccccagccatgtggaactgtaagtctaattaatcttctttcttttataaattgcccagtctcagggatgtctttatcagcagtatgaaaatggactaatacatataccataagaaaatctggcaagaaagctaaaagttaacaggagaggttaacagaaaacatgagctgagcccaggaatgaaaaaatggggaatggcattcctcatcaggaagcccacaaaaagaaacagcaaggaaataaaatggctagtggaggatgtgaattttagcagatgctaaagatagagagatccaggacttgtagaatcatagtttcaagaagtagttcctctggagtttcttgttttcttcttttatatttaaattccccattgtgcaatctaatttccttagctctcacaataatgctttcacagtagaatcattctacataacttcaaaaagaaattcttcatacatgaggcataggatgtcaggaagagagaggggggaaaaacccctaaacaatgggtaacagttgataataaatcccatacaaggcaaggcatcacaaggatgcagcgtgtcttccgagtacaactggcttatgccttgacagactatgggctggtgacaagttgagggatctgtggcttgatagacgtttcctaggaaatgaggattctgcagttggttttcactgtgctgccaaactgttctgggaaaaacagatttagagaaaccaatgaacttctttatctccatgcttccctgtgtccaccagagccacactcattctgtaatccctgagtccagcttgtgggcagacacaaagcagcatgcttacctgatatagtaagatgagcagtaaacccaaagatttaaatgaggtacagctttctcacacagcacaatggtacactgatggcacagcacctgaatttaattgcttctactactttgactttggtgttgaggagcatggatatgtatgacaaactcctaattcaacactgtgaactcatttcttgttattatgtttcacttgaaactgtctaaatgagttagaataactcattatttttttcacccaaagggtttgcctgctacatcttgtttttatctcaattaattttgtgtctgctggactaacacaaattaccacttccatgtcttgcacttttgatgtaaaaataaagctaatttgggaggtgtttaaagctttattaatatgtatatggccattagcagcgcctatgatgttagcaagcttctttctaaaacttagaaattctccttctgattctgagctgcagcattcccactctgaccacatcatttttagcatttttcttagggcacaaagaggaatttcacacagggtcatagaaaagttggtttgagttttcctaccatttatcttacccattctgctcagtgagtcagacttacataatacatttctttctctgattttcttcagaaatccagaggcagcactttctcccacggaagtgcatggctgctgtgtaacaaccaagcactattccgcctctgtttccccttctccagcctgaacttagactgggcaagtaaaaaaagagtcacgagtattctaatgtgataccgaaatacagatgatgagattctctcttaaaaggaagaaaggatgcaaaggacaagatccatactaaataatgtggcctatgactccctctgcactccccctgtaagttcccccagccttaaacaaaaaagcccaccagtgctttcagcatagtagggcagctaaagaagaccaaagaggaaatgtgaccatcaattgggaataataggtcctgaggctaaccacatataacaatggaacaagtaaaagtaattgaattgtgcttagagaaatgaggattgagaaaaaggcagcattgcatcagtctttgagagtatgaagctatacagccagttttcctgaatacttctcccaagtcttccattttctggatgtgtgacctcaggcatgtgatttgaccactctgtgccttaatttcttcatttggaaggtagggataatatttgcactgttctccctgaggttttatgagcactaaaaatctagtgagtaaaaaaaaaaaaacatttacttagaatagtgcctggcacatattaagtatagtcgatcctcaggtaacaggggtttgaactgtctgagtcaacttatatgcagataaaaaaatacagtattagtgggttacaaaacccacatttatggatagccaactttttgtatacttgagttccacaggaataagcatgtgtagatttggaatggggtgggggtagtcccagaaccaatgctctgagtatacccagggtcaactctactccataaacatttgttgaatggaagggtttggacaaactaagtcaaacattaaactgaatagcaagtaagatataatgtacattaaaatgacaggatctgtaagctatttctagctacagccacagaattaaataaatttgagaagtaaaatgcaaaataaaagagttttaatagttttctgctattaaaaaagagaaggttaagattaattaaaactaatctttaaagtaggtattcccaccatgtttagtaataatttgtcattaatgcatatatattaatctggcatctttcacatattgcttagagctatgctagcaaatataatagccactagctacatcaggctattgacagcttaaaatgtggctggtccaaactgagatgtcctggctgggcgcagtggctaatgcctgtaatcccagcactttgggaggctgaggcgggcggatcacctcaggtcaggagttcgagaccaggctggccaacatagcgaaaccctgtctctactaaaaatacaaaaattagccaggtgtggtggcatgcacctgtagtcccagctactccggaggctgaggcaggagaatcacttgaacccaggaggtggggtggttgcagtgagccgagatcacgccactgcactgcaacctgggcaacagagagagactgtctcaaaaacaaacaagcaaacaaacaaacaaaacaaccaaaaaacaacaactacaaaaaacaaattgagatgtgctatatgcataaaatgtacattacatttcaaagacctagtatgagaaaaataatgtaaaacctctcattaataattttcagtactgattacatacaaatgttatgagttaaataaaatgcaatgttaatcataatttcacttattctatttattttaacacagctattagaaaatttagattacatacatggctcacatttgtggtctgcattacatttggatcaataaggaatataaaccgcactattattaccactacttcaaactaacagttattgagttcttactctgctagatgttttaaatacattatttctagcatcacaatacctctgtattttctctccttttataagataagatgttctcagagtatatattgccccaaatcacaaagctactagtgtcaggggaggaatgaatccacatctgtctgagtgcaaagcctggtgctttctcctatactagagaccacatggaactagaaaggcctaagcccccatttgccaacagaaaaggtaggaaaagaattcacgagcgacatagtgcatatatgaaaagcaaaaatgtaaactagaaaaagtatactcataaggaggccatttgccatgttttcataaaaaattcaatagagaattaatataaaagtgctaaatctgatacctagttaacagcagaaaatgcttagatgttatatagcatgaacaatcagaatacaacactatccatacacttactacagctctgtaaaaggatctatatatcatgaaagaagactgacagggacattcaaaattgataatatctttgaataaaggcaactcaaaaatgagcaggtggggtggggactttgatcctcaggggacatttggtaacattgggagatacttttgatggtcacaactcaggaggtactactggcatctagtggactgaggccagggatgcttctaaacatcctacaacgcataaaactacttcccaacctgctgagattaagaaatcttataatagggtaatggtgttacaaatttcctcctctactttccacattcgataatgttaaattgtcttactatacaagaaactaaattaaaaaatataaaaaaattattactaaaaaagtaacagaaactaaagcataatcgccaacatagaaggttattttatatatgggggtaggtgctgggtaatacaagagggtcccttaatatagtagcaaattccttctaagtacttcttagattcactaaaaacgacatctgaaaaggatatatgcaattatacatagattaaaatttggccgtgtttcctcaatcactacttgccattggaatgactgattcaacatctaacaggaaattggcactcctttcactgttgggatagcatttgctaaacatcaaaatattttttctcactcctttgagcaagtagtgcttcacacgggtgttattattactgagattgacaatatatgctgctatttacactgcatttaggaagagatgggaagagagatttttctgacaatttttttcagtatctgcatcattatgataaaaaacagaagcttaaaacttacacttgtataaattctgtgtaaaaactactcattttgtgagcttaactatttgtactaacagattacctgattaaagatttcacaagagtaagtatatatgccatgcttgcaggcatgaaagaaaggaaatctgaaagctgtgtatatactcatctttttcttcatttattcagttacatcaaaaaggggatttcagaataaaaatatgtacaggaagaacctatttaaataggtttattgatgctataaggaaggcctaatcacagtctatgaaatgcttgtgctacatcatttgaccagagaaaacgcaagtgctcttttactgaatatagccagagcaatgaacaatttagttttttcctctcagcatgaaccatcgtcttggtaatctccagtaaacagcacattgcctggcacgtagtgagcactcaataaatgttaggtgaatgaatgaacatttataaaatcataccatgtgctatccagagttgtgccaaatctcttgacaagaagtcatatttcagttccctttctcctaagtttcactcacacattcattcactcaccaaaaacttactactcacctgtaagtttttatagcatgtcacacacaccacctttatgatacttatcactgctgttttaattatttgtttgtaggtctatctctcccactaaagtgtcagcacttcaaagacagagaccatgtcttgacactttgttctctgatttaatcttcaataaagagctggaggataagaaaataatggttccaagaacttgcctacagtctcataatttaaaagtcgtagagccatgatttgaactgaggatggctcactccaaactatcttcttcccattttaacagactatagagaaaatgagagtgaaggcagagtgtggaatgagaagactgtgaattaagacaaaacaaagcagaacaaagaagttttagaagctaagtaagacccaatcagtgggttctattgcaccagcaccaaggaacagaaagcacaattcaagaaactgatatggacaactgcagagacctcagaaatagtctctagaaagtcaacgtatccaacatttatggaaaatcgaccacaaccatttggaccaatctaggtgaactttttgagggggaagaactgaatctcttttctgtttctttatctctaacttataatttgttggaagaatgaaagactgtatgacataaccctagtgaaagagatcccagtcctgtagagtgaccaacagataaaagaggtgagataaatcctattaataggcagcaaattgtcagactggagaattagccaaaacaaagcagacaagagattctgcagtaaatttatcctaattggaattttccaagtacaaaaaattgaaatgcttatcagggtcatgccatctcaatgtaatgataccctgaacaggctcttagtaagtacaatatgttaatattggttttatttgttgaagaccaaatggcagcgtaattaggaaaatgagttctggagctcacttcactgcttgacttcttagctcagctctgccatttcctagctacctgactttaggtaacttaataatgccagttgagagctatgcaaagcagaatagtacctaatacgatacacatgcttaacaaatgtttgctgttaattgtattgtcattttcaaaatgttatattaacatataaatttttaaagaatcatgggacttcttcaatgcgacattctaaaattactgaaagtgaaaatatatttttttaaatatttggataaatccagaaatctggaacattttcattaattcaaaattaatgaagtgaagccaaacaaatatggatgatgagggtaataatgatgataatagtaataattcttctaaaacataattgtatgtactatggtttgaatctttgtcccctccaaaactcatgttaaaacttaatcctggctgggctcagtggctcacgcctataatcctagcactttggcaggccaaggagggtggatcacctcaggtcaggagttggagaccagcctggccaacatggcgaaaccccgtctctactaaaaatacaaaaattagctgggagtgatggcgagtgtctgtagtcccagctactcgggaggcttaggcaggagaatcacttgaacctgggaggtggaggttgcagtgagtccagatcacgccagcctgggtgacaacagcaaaacgtctcaaaaaaaaaaaaaaaaaaaaaaaaaaccacgaaaaaaccaaaacttaatcccaaatataacagcattaaaagatagggaagacttttttttattttttattttttctgagacggagtttcactcagtcacccacgctggagtacagtggcgcaatctcggctcactgcaacctctgcctcctggattcaagcaattctcctgcctcctggattcaagcaattctcctgcctccgtctcccgagtagctgaaattacaggcattcaccaccacatctagctaattttttgtacttttagtggagacagggtttcaccaccttggccaggctgttctcgaaatcctgacctcaagagatccacccacctcggcctcccaaagtgctgggattacaggcgtgagccaccacacctggctggagggcttttaagaggtgtttggtcatgaagggttttgcccttatgaatggagtagcccattcatagattaatggattatcatgggagtggtttagttatcaagggaaggggtctgttataaaagttggtttgggccaggtgcggtggctcacgccagtaatcccagcactttgggaggccgaggcgggtggatcacctgaagtcaggagatcaagaccatcctggctaacacggtgaaaccccatctctactaaaaatacaaaaaattagccgggcgtggtgccgggcgcctgtagtcccagctacttgggaggctgaggcaggagaatggtgtgaacctggaaggtggagcttgcagtgagccgagatcgcgccactgcaccccagcctgggcgacagagcgagactccgtctcaaaaaaaaaaaagttggtttggctctcagttcagcccccttgccatgtgatgccctgggtcacctcgggactctgtaaagagtccccaccagcaaaaggccctcaccagatgtggctcctccaccttgggcttcccagcctccaggactataagaaatacatttcttggttgggtctggtgcctcatacctgtaattccagcactttgggaggctgaggtgggtagatcacctgaggtcaggagatcaacaccagcctggccaacatggtgaaaccctgtatatactaaaaatacaaaaaaatattggctgagtgtggtggcgagcacctgtagtcccagctacttgggaggctgaggtacgagaatcacatgaacccaggaggtggaggttgcagtgagcctagatcacagagccactgcaatctagcttgggtgacagattgagactttgtctcaaaggaaaaaaaaagaaaaagaaatacatttcttttcttggccaggtgcaatggctcatgtctgtaatcccagcgctttgggaggccaaagagggaggatctcctgagctcaggaattcgagaccagcctgggcaacatggtgaaattctgtctctatgaaaaaacacaaaaattagccaggggtggtggcacatgcctgcagtccctgctacttgggaggctgaggtgcaaggatctcttgaggcagggaggtcagggctgcagtgagccatgttcgtgccgctgcactctagcctagatgacaacgtgagaccctgtctcaaaaaaaaaaaaagaaatacatttcttttgtttataaattacccagtctcaggtattcaattatagcaacagcaagtggactaagtatgattatgtgtgcatgtctgcttaaaatggtatctttagatataccaataaataaatgtttttaattagaaaaaatgatgagaagcctgaaaatatacacattgaacatctcaaatttcaaaggagaagagcaaatcactcccataagatttcaaagtgacaggtaatcacaggcaagataaataacagttacagttcagtctaaatcagatttttttttcaagtatagatgctctctctcttccaccgcctttcccccccccccccccgcaaagccagacccaacctctgcattcaagtaggaaacctggaagtctcaaaggaatttttggtacactattgttcagaagcactttttggtacattaatgttcagaacctcctactgaactgtgtcagggaaagtggaagctgattagaaaataagagctaccggccaggcgcggtggctcacgcctgtaatcccagcactttgggaggctgaggtgggcagattacgaggtcaggagatcgagaccatcctggctaacacggtgaaaccccgtctctactaaaagatacaaaaaaattagccaggcatggtgctgggcgcctgtagtcccagctactcggaaggctgaggcagaagaattgcttgaacctgggaggtggaggttgcagtgagccaagattgcaccactgcacgccagcctggtgacagagcgagactccgtctcaaaaaaagaaaaaaaaaaaaaaaagaaaaaaaaagaaaataagagctacacattgactataataataataatgaaatagacatcccacacccacaaacctgccactgtatcactcttattgttttcaggacatttgcactgacactgggccaatttttgttttactataagaggttttaggatatgtctttaaaaatcatactgtgtacaagacaggttggttactatcagccacgatcactaacaaaacagttccccatcatcagtcctaccatctgtactcccagttctctccacacacgggcttggttgaacagattttgaactggccaaggtcactgcacagctagcctccacagatggggacagtgtgaaaaacctaattgcagctgtggataaacacaaacaaggacacacatggttggcaatacccctgtctagacttgatggtggctcagtgtcactaagcacaaaaaacaaggacatagtttcaaggtaactatctctcagcgctggtacaaatgctatcatcatgtggtctaaatgtctccgagatatttaagtatcaatttaagaaatggtaatagacaagcaatatttcctatcatacatacattctctcaaattctctagggaaaaaaatgcctttcttaaacaaaaagataaagcttgggaatcagcacagtgccataccccatgtgaatgtcacaagcattgcctgcacacaacacagaagatactgcattagggaaaaaatgaaatatcctctttccacatatttatttcatatgtatcaaaatttccttttcccactccctttccaaaacaaattacttggttagagactttactttgtttttgtttcaacaaaatttaattgggtacaccttctattctatacccctaagacactcatcaaaatagaatcacgctgaagatggtatcctagattttcccccttgaaatacatatggccctcagggaatgtggattgtcaatgtcttttctagacactcaacatgtctggtcactcaggtttaaagccaaattggttatgcattactttttgagaagttgttaaaacttaaaataagttatcaagtcagtgatatttcaaaagattgttgataaaaaagaacatataactgtaaccatactgaacagttgattatagaacgacatgtcagtgcacatatggcagtcggataaattatgcacatctggattacttttggcaagaaacatagctaagtgtctaaagccaagtttagcaatctgtcactaacaatatgtacatttattttaaaatgtcaagggctcaaagtcatattttctatttcttcataaactttccagctcttcgtaagacagcaaacaggtgacaaaacacattgcccaaactgccaaaggctgtataaataaggggtaattttgaacttctcaccacatatataagaggactcaaagtctgaaacaaactcatgtgttgtgggatgtactgacatataggtttcaagtgagattgttaccatttcacttcagaagttggttagaaaatgctttcatttaaagatatggctggcttacatggagtagtaaacaatataacactctggggaaagcaaatggaaatagtctagtggtgtctccttataaaaggaaaagaccagtgtctctgtgatcagctcagattaagtttccttttttccattgccaattactgacatcatttaagccccaaagaaatgttttcctacttctagtccccttgattaaaagaaaagccaagagacacgaaggtggctctcaaactagcagtaacaagaaactttacaatgggatgtatgggcagcagccaggtgggaatgtagcagtacctgtaagcacaaaactcctcttgactattatgctgcttcctagtttttctagcattccaagcttcttaacagcttcagtgggaatgccaagatatgtcatggagactgggtggggtcccgtcattccaggtgttgccttccagtctcatttgtgctggcagcagagaaaaaccagagtggaactattttatttacagagtgatagctgaatattcactctgtgtcagtctttcttctagctcacccatttggtaattttactgttgactagcatctttactatataccagatctggattataacatgttcaaatggtgtgggtggtgggaaatcctgtgtctctaaatcatacagattggtattcaaacaccaggtccactgcttacaaactgagcctcatctaaagaaggaggatgattatgaagcacctacttcacagtgtggctgtgagaactaaatgcctaaaacctacaatacatccaaaaatagtggctataatcatttctgttccttttctccttcttaaagtgacagactgggactaataaagtccacaaaccacagattgtcaataaaatgttgtaaatccaagagtaagctaataaacaactgagaagaaggaagaagaataaagaagataagatcctaagaggaaaagatatttaacttttaatttttatctgcttttctgcttttgtaaagtttgatgcataaagctattgaaatctatgtgagcttaagtgtctttccctgatgaaataaataaaagacaattgcctgtgttattaagaaaaggcacatgttttcagaactgtcagtttctattattcaagtcagagagattttactttaatagtattagaggcagagtgaaaaatacatctatttccttcttaattttgatattttctatttgactctgaagcttaatttttaagttatatcacattaaaaatgctcaaataaaagacacatataagaaggtaaaagagtaaaaagaattttaaattaaatgagtccatttgcccatatttcacttccccaggtctcagtggtagcaatcttcacacactattaatgttctttagtcttttactccttacactcctgaggaattttatatccccacaagacacaaaaactctagaaatataaattaagagaaacactcacagaaaaacccaaagcagatctgacagaatgattcttagtacagaatacaggaaaaaaaaaaaaaaaaaaagtcctggcctatcattatactgtattactttaaataagttaaagtctcctggcccaaagaagctattataagataatttataatttagatggttaaatgaatgttcatgatctttgccaagttcaggacaataaatatagggggttcttccaaccctaggaatctgttattgtcactagacaaacaaggtaggcttgagaaaactgatatactttccccaggtagacgtgaagcttcttcatattgaattacagaagtaaagttttagtgaatactactttacataatttttctatcacggtcatttaagattttattcacaaggcagccaaaggcgaaaagcaaaaacagaagctagaacaaaacagtctttgggttaataatatatattcctttttttttttgagataaggtctcactttgttccccaggctggagtcagtgccacgatcttggctcactgcaacctccacctcctccgcctcctgggttcaagtgattctcatgcctcagccttctgagtagctgggaccacaggtgtgcaccaccacacctggctaatttttgtatttttagtagagatggggttttggcatgttggccaggctggtctcgaactcctggcctcaggtaatctgcccaccttggcttcccaaagtgctgggattacaggtgtgggccactgcacccagtcatatagttcatgtggagttttaaaattgtagtaatttaatcttgtatttaagttatacccttaataagtaccatattaaatgtggtaaaatgaagagtacggactaggtaagaggataagatctagaattagaaagacctggatttatacactgactctgcagtttgtcttttaacccattatactaccttatatctattcataataaattatgtatctgaataagtgtgtgtgcatgtgtaaataatacatacacacgcaccacagagttggtacaacgattaaatgagtacccagcacaatgcttggcagacactcaatagcaaactaagaaatcaggataatataggccaggcgcggtggctcacggctgtaatcccagcgctttgggaggccaaggcgggtggatcacgaggtcaggagatcgagaccatcctggctaatacagtgaaaccccatctctactaaaaacatgaaaaaaaaaattagctgtgcatggtggcaggcgcctgtagttccaggtattcgggaggctgaggcaggagaatggcgtgaacccaggaggcggagcttgcagtgagctgagatcgcgccactgcactccagcctgggcgacagagcgagactccgtctcaagaaaaaaaaaaagaaaaagaaaaaaaaagagaaatcaggatagtatagcagtaatttgatgaaaaattatggattcatatcataatatacgtcaatattaaatcctttctgataaactatttgaaatagtgacaaagaacatatacaaactctttgagaaagtattcttcactgcagaattaaatcacaagtaagaatcctgtaaaaaaatcaccttctcaaggccaaaacttacatttttagctgacatctcgttacaatggtactacgttctaatagattgtggaggtatataattacaacacttaaaagatgaaactaaatgaaaaataaaattcatagtgttaatagagtccaatgtaggagtgcttttttttttaatcccccaaactatgtagaaaacatccatggaggaagacatcagcgttaattcctaaaaaggctcctgtgctcatcaagaggcctccaaccactggaccactgcagttgccacataatctgtctgaagcaaattcttcctcttagcagttgctgaaggagtggtgacttcttattagcttcccttatgagaacatcttctatgctacgcaggatgtttcaagtaaccccaaagatgtttagttgtgcttcatcatcataaatgaagacttaacagggagaaattaagagtaccgttaaatttttcttatgcctgttaacatattgtcattcatttactcaagttcttcaaactctgacctccttttggctggaatgcaacaggatgaaggatgatatcttctcaaactgtgatgtttatttaaggatatctactactcaaagaaagaaaatgaatgtggtaggaatatcatgaaaataacacggaaaacatggctccagagaagcaacgtaaaaagtgtcttaccaggcccaagtagaaaatcaccctctttagacagttcattaaacttttcagagattaatcactagagagattatagcagtggctatgaaatttatggaagcattcccccagaaaaatgaacgcagacactgagccataaatgtaaagaactcaaaaggaagcaatctaccttccaaacaagtgttgaaaaggtctgaaggaatttggttgtctatgtcagccattatacggggaaacatgatgctcactgttctaaggggaaaaatgttcaaacatgtatactaaatgttgccctggggttctcattacttaattaacatgcacacataaaatctggagtgtgtacaacaacagctagccttaataataggtaagtcgcgtcagtctctttttctaatattctattttaagttgtgaaccttaatccaggtaagctgtctgtcatttggcaaagatgtgaggttttctcaggaaagggtaggtatgtaaggcagctctaacatgacctgatttttaactacctttcaagggatattttacaatgtttttgtgaacactctggtggattctgggaccttaagacgccattcctttggaaatatgtaattaataaagcgttatgggaaagatgtgtgatgacaatgtctttcttgagttatgctaatttgattacaataaatttaagtaaattctaaagtaattatttctttcaaataacagcatttccagtatttaaaggaactgtccccacaagagtcttctgaattgaatttaatttgtctattacttataatatgctcttaagtttaacaaaaagcaagcacaatgagttattcctaacacccaaattgatggggttttctcattactgaatctcatctgctcctaagtatgcttacattgtaatcaactgaaaaccctcagaatagcttttgcttaggatatacgttgtgcttactccacaggctggtctgaataaaagcaaagtgtagaacccaggacaagtcagacagtagcagtaccacactctctgtatataattcattgtccaacaccatatgagtgaagaaacaacacgaacgaccacacacaaaaccttcaagtcactaaatgatacacacaggaagctcagtaactccttcggggtaaattttattttaaatttctatttagacacatatgagaaggcatactagtactccacacattagttttaaaagcattggcccatggcaaatattcaaccctgactctatccttacttcatgggatggcataagacaggagtatcctccaaaatttctgacctccctaacattaatagctaaaatgactattctcgctaaagtaacattgactgaacatttcctaaacaaaacaattatgagcatcattctcaactaccaaaaacatcttaatagatgcaaaatattaaatcataaataaaaataatcacatataagctaactcactatcctactaaaccttgatagcataaaaatcagcttaaaataatcattaaattttattacaattaagtgctattataaataacatgcttgttttagtagtaaagtatcgcttaactaaagtgataaaagggggaaataattatttaaatgaattactatcaataccttatttaattcaaaagaattcagtggtttgtgcatttcactaaaacatcagatttaatttactgttatttttaaaaagtaaacgatatttacagattaatagcaagtatttaaaattttacaattttaaattacaatttatataaaaataaatgatcagaataaagtcagatgctggaatagtcatacatgtattaattcctatattataccattatttttagttcctgaaaataagttggctttttgtcatctcatccctttgctatgatttcgctggataattatgcactgaagttcattactcaaagcatccagttgttgaacagaatcaaaatcacccaacccaataaccacagagtaaagaattgaaagaaaattggatataaccatggatcttaacagaaacaagtaacaagcaaatagggcccaatattaagtgctaatgcaaaattccattgccttcttttcacttgcaaacctacacaatgtcaacattttctgaaactgattttgaataatccctcttattttcaagtataggaaaattaagatatattgatgagaaaaaaaattctatcatttccctttctaaatgctattttcaaatgaacaagatagatagatacctgtagaaaattgggcagtgagtacaggcagtgatgtaaactgtattagaacaccaaaaattcaaaataaaaacaaatttaaagatgcatattaaggccaggcatggtggctcacgcctgtaatcccagcactttgggaagctgaggtgtgcaaatcaccagcggtcaggagttccagaccagcctggccaacatggtgaaaccccatctctactaaaaatacaaaaaatagccaggcctggtggcacatgcctgtaataccagccactcaggaggctggggccagagaatcacttgaacccgggaggcggaggttgcagtgagctgagatcatgccattgcactccagcctcggtgacaagagtgagactccgtcacacacacacacacacacacacacacacacacacacacacacacacacagacacagatgtatattaatttaatcatttagtcctttaggaaatgaccttctatgaatgctatgagcactttctatgaacaaggccctatattaggtatatgtgaatcaccatgtacttccaaggaagtgtaatcactttcaataaaacacaggacataggaattctaaagttgaaacagctttgggtattctgttagataggaatacttttgaagactaacaatttttaaatattgcactagagagaggtgaagagttgaaaggattagagacagaaacaaaagacatcgctgctacgcacataattcattcagtgctgctggttacaaatgatatggtattcaagttactttttcaagcttttcatttttatgcataatttcttcaaagatgcctttggggatggacaatttcagccagtaaattattttttacataagcatttaggtatggctataaaatcatttttgcttgtatcatgttctcatcatccccaagaaaaaccccatcgtccccaagaagaaaaaggcctaacgttttgtgtttttagattttaacttcatctgaaataataatagaaacatgttaaaaccaactatttgagcgttaataaatttctaataatattcatattcaaagtagttcaaaattcataaaatataaatatcaaacagggagtacaaaaaaaccctgagatgtctattcatcacagcaaattcagctgagtgctctgaaactccccctgtcctttaaatgtcacaacagaggagtgaggacaattctcttcattcatcagaagaagatggggacctgaacgttttctaaatttcaagtctataagcatcttagttttccaggaagtccacgatcaagacgccaaatggtcagtttctggtgagacctctcctggcatgcagatggccacttcctagctgtgtcttcacgtagggaaaaagagagctctttcactccttcttcctcttaaggccatcaaccctatcaaatgaggatcttacccttatgacctcatttagccttaatttacttcctaaaaaccctatctccaaatatagtcatgttgggtgttaggacttcaacatatgaactgggggaagggcacaagttggtccataacttaaatcaaaaattatgtcctatgtcattcatgaaagtatgcgttatataaaggatttttgtgtcaagttattggttattgtgtgatgcccatttagccttagtttgaaaacttttaacaaagcagttaaaagtattcaatctatttgtttgaaataactccttccatgggtactctactaatgatggaattgtatcataagcatattaaacttgagaaagaaagaactgaaacagtcccttaccaccgctccatctgaatttatgttctgaagatggaagacatgaatcctggtatgtttaggctttgtgtccccacccaagtcttatcttgaattgtaatccccataatccccacatgtcaagggagagaccaggtgcagttaactagatcatgaaggtggtttcccccatgctcttctggtaatagtgagttcccatgagatctgatggtattataaattgcttttccccctttgttcagcacttccccttcctgctgccttgtgaagaaggtgccttgcttcctcttcgccttctgccataaatgtaagtttcctgaggcctccccaactatgctgcactgtgagtcaattaaacctctttcctttataaattacccagtcttaggcagttctttatagcagtatgaaaacaggctaggtatggtggctcatgcctgtaatcccagcactttggtaggtcaaggtgggcagaccacttgaaatcaggagtttgagaccagtctggccaacatagcgaaaccccgtctctactaaaaatacaaaattagccgggagtgatggcgggcacctgtaatcccagctactcgggaggctaaggcacgagaactgcttgaacccaggaggcggaggttgtagtgagccaagactgagccactgcattccagcctgggtaacaaaaaaaaaagaaaggaaggaaggaaagaaggaaaggagggagggagacaaatacaaatccccctaatgggtctcagttctctggggcttctcatgatgagaacacttccactacagtgtgtgattctagtatttaaaaacgagtattctttttcatcctgacccttgaatgcaaatcaaatactacatcttgtgcataacaggagaaataggagaatgctccactgttggaaagaaaactacagcatgaaagttctaaaatattttcaaagggaattttaactttttatgatttttctccttataggttgacttttttttaaccaccataatattcgctgtggttttagaagttttaccctttcaaaaactacatatacatacgtgtgtgtatagacagatactcacatttggaaggaaaaaatcctggtaacattttaaattatcatcatgaaaaagtatctcttgtgactgcaagttgaatatgttctatcttccagagatacactaaagacacataatctaatcaactcctaccaagataaaataggaagaagccctcacaccagccccttggctctcctttttttctgtgtttttctcctctttgtttctgagtgtatattgctcttgcacctttaatgctcagaaggaagatgaagcttcagctaaggccttactttttccttctcaagcctcatatttagaggggggaaaattagatgcaaaatcaccttttgattatatgcaaatttgtcaaatttttccattaaatggtatattaaggaaatagaggctgctgaagaattgggcatagtaaaagacctagatttgaactaattttatcattttatttctgactctggaggagtggctacctttgttgaaaatatgggaaaaatgaaaagacagatgaggcctacgaatcttcatattttagagtaaaaataagggaaacagaaagaaaaatatgtaagcaaatgtggtatgtttaaaggttaggatttcacacaatgcatttatttttctcactagttatgtttgacaatggggcttaatttaccaaggaagaaataaccatgacgtctttctactgtctagagaacaaatcaaagaattgtatttcatgagcagtgccttccaattaaaaaagaagaataaaggaaagagaaaagctcatatattctgttgagtgtgtagcaaatacatagtaccactgtggctatttaaacaattgaggctaatggaactaaggagaacttctaatgcaactgaaattgatgcaatggtacactttaatttttaagtgtttctcttaaatattctatgcaatagggattgagtgctcatttgattaacttattgcagggatggttgcgcaagaattaaatgtgctttggctggacattgacaatgaaatgaatctgaatatacttaaatgtgatatatactgttgctttgggtcaaaagttttttcatgagaaaatatcaccaattaactaaaatcaaagagaaaatgtcattttctcctcatttaggttcttttaggaatacattaactatattatcagtgcagcacctgtctttattaataatagatgtaaatgttggttctctgagctgtcaaacttacaactcaaacttcctaaagtaaatcgataactataatacatgactataataatgtagaactgtgagttctgcaaaatatctaataagttttgagtaccatttaatctgggagtttttgtttcaaaggacaacaatacctcagaaaaggtttatcactgatgagttgttcattattcaatgaagatttatcatacatatgctaaaattaaatggagtagggagggggctggagaattaatcatacagaaaagaagatgactgaatgatctatatgggggtagtaatccccacactgccagcgtttattccatagccagggtgccatgggaaccaaggggctgagtcgcccagtctttgggaggagtctcatctcagaggaaaccaggaagtcttccaggaggaccactggacattagccaggctaggggtgaagggcaggggcactgcaggccgttggagtgctcttgtacaattagccttagccagtgggcttggcactctcagcctgtgtaaccaaacccagaaggggtctagaaggcctttcaggacaccgtatgcttcagaataggagcggattctcagtccacagatggttcctgatagagtggctgggtggggtaagactattcttgggctcatctagtcttagagatctggagactcccagaggggtggaggagtaggatacttttggggccactacagtggtactgactcttcaaaaaaaaaaaaaagagagactgtaacttaaagtgatctaaatttattcatttttaagggaaaaagcacaacagaaagaacaatcactctgtctaccctttctcctcaacgctgcccctcgacatctccctgggagaagctgtaagactgccattgtttttgtacgacccccagatgcacaaagttgtggggagccttcacattgccatctcccctccagagccagatttgtctgtggcattagtgcactgaaagctgaggggtagggttgggtattctctggaggacaaagtgctaatgttcagtaattctgcaaacatatgaagacaacattgcctacctgccaagggtgtggcaccatgttctggcgaaaaaaactgcaactgatttcactcatccaagcaaattcttagggtgtaatgggagttgaaaaacatcatcttggaacctactaaagggacaaacatgatatgaaaatgattgggcgggagaggccatatttatgaatccttagtgaggctgttttatggttcagatattatggctttggctaatgtctgagtatatgtatacacagattttaataaaaacaaccgtgaaatttgagaatccacttcactgaaattatagaacaaatatatcttggatactacattttgcgtaaggctgcagtcattccctttaggtgaactgaaatgacactgctaccatgtcttttctgtacagaacagggaaacaatgacaataagaataaatgaattgtttaaccctgtgagcttcagaatgcttagcaaactactgtgaatcaaaagatactacagaacaatctttggctttacttgacagtatttaacaggtcttataagtctatttattttatttattagtcctttattttactcccaatgacctcatttccttctcctttgctatagtttacagcaaagcaatttgaaatagcaaatcaaaatattatccgaggacaaaatgtaataaatgcagaaattgagaataagtttttttagaaatttttgttgcagtgtgacatagctgtgactcccaaatatataatcagtggcttcatgtcactgaacgtacagactaaaattgccagttggtgatgaattagggaggaaacatgggtatttccccacaaatatttttattagtattggtttaaaacatctggcaattgtacataaaatatttttaaattcccttcagctatcaatatataaattattgcaaaatttattaggctaacactttctaacttgtactcttagatacagaataaagatattcttggtatctggaacactgtagttgcttccattgtctttggcaggttttcactaggagaatggtcagcgccataggtggtaaccacggcttagaagaaaagagaagaggtggatgggtcccaggagaggcagactgaaatacctatattctctcctaagcgtcccatggctccaggcaccacacatgagcttttttttttttttagatggcgtttcactctttttgcccaggctggagtgcaatggtgctatctaggctcaccgcaacctccctctcctgggttcaagcaattctcctgcctcagcctcctgagtagctgagattacaggcatgcgccaccacgcctggctaattttgtatttttagtagagacggggtttctccatgttggtcagagtggtctcgacctcccgacctcaggtgatccgcccgcctcggccttccaaagtgctgggattacagccatgagccaccgtacttggcctctacacataagctttagcatctggatacttcagctaatctgggacaggtccaatgaatatttccacagtttatcactttggaagttataggcttttttcaaaatcccctttaattgcttattagttctatagctctataaaggcaaatagcctcatcctgctcataggaactttagggaagtgctttacaatctccagccttcaagacattgagacaatgaaaaggcctttttttttttttaagtatatgtgtttcgcagtagcttaaatagacatttaccagatgtaaattttatcaggctttgtgttgaagagatttcttcaagtggtgattgttgactctaactgtaatgtattttatgatctctccagatagaataggagggaaaaatgagaatattaacccttcctctacctgctattagttaatcctaacaaatactctatgaaacatacatgctatagccaaaaaatacacactggtccgctatactagaagcaaaagaaatcagaatgggttaaaaaaaacaaggcaactagcctaatgatacgtacaatgaatttggccttcatttttctaggctctgggtttgcttttcacaaaaactggaatcaagttcctctaggcggttgacttaatgatttgaaaacagtagtataaacaaaacatgaagccacatgggagagacgaggaatttatatatgcaaagtcaacacatactttatggctaaataattttcatggttttaataatttaaaaaatgttcaaagctgaattaatagatgattttcatgttaaacctgggtaagcagaagtaaggtgtttaagaactcagagtcactgggcgtggtggctcacgcctgtaatcgcagcactttgagaggtcaaggtgggcggatcacgaggtcaggggatcaagaccatcctggctaacacagtgaaaccccgtcgctactaaaaaattagccaggcgtggtggcaggtgcctgtagtcccagctactcgggaggctcaggcatgagaatggtgtgaatccgggaggcggagcttgcagtgaactgagatcaagccactgcactccagcctgggcgacagagcgaggctccatctcaaaaaaaaaagagagaactcagagtcatataacctatacatggtactgccgagatcttgggctgcagctcctggtttctatactaagccatgttattatgctactttagcaatttctagccctagatctccttaataacaaaaatcaaaagcatgtcatggttagattctttgaattctgccactttcaggaagtagcacctctggtttggatagctaaaaggaatagcagaggtattaagccacaactgcacttaccacaaatattccactcttttaaaatataaacatgtgactgttaaaatataaacatgtgactcgtttccattggcattcaccgctttcacaaagacaatggaagaagccagtaacactgctacatctacaggaaacaaaaatgaaactaaatggctccaaatatatatatatatttgagtctcttaagttcaagtgattctcctgcctcaacctcctgagtagctaggattacagtcacatgacaccatgcccgactaatttttgtatttttagtagagatgaggcttcaccatgttggccagactggtcttgaactcctgacctcaagtgatctgcctgccttggcctcgcaaagtgctgggattataggcgtgagccactgtgcccagtcggctccaaatattaataagcataaccagggtactgtattttggatattagctgattgattgtacagttacaaaaatatgatgcatcctaggaactatccattgaaattttcctgttaagatagcaagatatactgccaactagcatgactgtttccagaaagcatatgggaaggtgataaagaaggggcaaataatagagcaaaacacaaaaagaccaagagaaaaaaacaattaattctacaattggggaattgtcaggacaaagatatgtataaattaagataaaggaatgtgaagtatgcagtgctgactgaagaggtcatatggggttgtcaaaactgggctatacgtatgtgactgaaatggcagaaaatgtgaagtaaacgagtaaaagaaaacctgcaagactaaattaaacagaacaaagacacatagtatgtacacatagtactttaaaacaaaactgtaaaaaaaaatcatctatttggccattgaaaacaagcattttcccatccttgcccactgttagcatgaaaatgatttactcagcttggtcagaggtagattaacctgatgaaacaaccaaggcaaaacccattctcaatgtgaaaagtaatgaggattttcctcagtttgtgtccaaggacaacactaggcagcacagccctagtgaagcataaactcctagcagacagaaagcttcctgagggcagctataatttgttgtttacatggaggcctagcagagtccttttcatactgtaagtgttctatgaatgtttattaaattaaattctacttaagtagctctcttttctaattagccttggcaatcaagtagtttattaaaataaaaaagtccaagtattttggaagtgaattttgtagcagcaaattcaggatgggaccaatgacctacaaattgagctgcagcaaaatattggctgggaacaaagtagatcctaaaggtggttttgtcagacaaagtgcaacaaatctcactgaagaacaacagtcatatggagtgttgtcgcatatgaatgattacttgaaatcagtgttagaatctcaaaaagaagtaacttggtaatgcaaagtaatgctattcaaagtgctgtaaaaagataaacaggtattctagtctcagctccagcaccccccgcctcaggaagctggctcagcccactgcagtccataacggtttttgccaactgaactcaaagccccattaatgcagaaaataattacaatctacccttgtggcatctattaacttttctttaatcatgttttgtctctccaattagactgtacgttaattaagggtaaagagtttcagacatttcttctgtagccatcacatctaatactatacaagggtgatttaatattagataataaatttaggtaatttacaacattaatagttactattaataggaaaaaaatcacataatcctccccataattatggaaaagcatttgataaacttcctcatccattcataataaaattcacttcacaatagaaaaggatatcttttataaaaaagttttttacctactacgagattaaaggcatttatctatttaaataagtaaatatcccacagaaaacatcacacttaaaggaaaaatgttgaaagcactccttttgtaagccagaggaagtcaggaacactttctgtcaccaatcctattcaaaattgtccaggagataccagtcaatgtaggtagacaagaaaaagtaatcaaaataagacatgaaaaggatgaaagaaattttcatctgctaatgaatttaatatgtgcaggcatgtattaatattatattcaaatgaatcaaaaggattaaaagtctaggttttctggctacaaaaaccaacatacgaatgtatatttcttgtattttatagcaacaattagaaaatgtcactttatgcacaaagatttgcaaaattttaaaacccagataataccatatactgataaggatataaacaaatggaaattcttatctactctgggaaacttcttggtagtacctaataaggttggatatgcatataccctataactctttctattcttaggtacataccattgagaaatggttgtacatatacaaatgttacattcattaacattcacagcatcagtgtttgtaatgtccaaataatgaaaccaacccaaatgtccatcaacagtagaatgaataaatcaattgtgatacactcaatatgatggaatattacacagcaataaagacgaataaaccatagcctcagagatgagtatggatgaatctcaaaataataatgaacaaaaatagaagaccacagaagaatgcatttagcatgattcccaatttatataaagttaaaaatataagatggctattacatatattatttggagatgtatatatgggtggcagaagtattgaaaagcaaaaaaaaagaaacaggcaacacaaaattcaaggcagtggttacttctaggtgggaggtagaggatgcatgaaaatgaggggctcagagaataatacagcacagggagttttctatttctatttcttaatgtgggtagtggagacattgccatttgctctaatactactctttaaactacatacacatgttccatacattatacattttttatatatcacagaaaaggaagaaggaagaaaggaaagaaagggaaagaaggaaaggaggagggagagaggaggataggaaaaggaaagataaaaaaggataattataaaatccttggaatgctaaggaaaagaagcttgccatgggactctcttttaaatgaaagtacacatacttctacaaacactacttagcaagaaatatgcacaacacaaccacaaggggctataacaagacatcacgcttagggctgagattagactcctttcactaaaattgatgagtcatttgtcacaatacagatgttttatggctgaaaggaatgactgaaaacactggtattttcttatgtaaaaaacaagagtttctccagattaaatttcctctaaaatttttaagtactaggttgaaaaccagaggaatctactttcacttttcttcaattatttgcaataaaacaagaatatatatcagaccatggggaaaatctttttcttccacactttggaaatctaaaaggtactacttttatgtactaccatctaccataattagatttaatctaaattgtgctattgagaggcgagaaacgcaattaaagtgtcaacactcccaagaccagccaaacaaccttttggcaaatgctaatataaatgttttcataacctatgttttttaaggtcactattcaaattccatagttatacatatctctgttttcagagactttatttctcaggttttgaagggctggagaatgttactcaaacataaggtcggtaaagaaattttagcttagaagtctcctataatgctacagagctgtagtctgtagcagtcctacagggcactgctcatatgcagtaagcaaaggtggggcatggggaggaggaagaaaacagatccagagactgtctgcagagcatctgttccagcaacccagttgtgggccttctcctggaccagtaaaactccatctggtatgggaagctaactgttccccaggtggtgtgcccacctgtcaactgacagtcgggcttgtgccactaagaacaagggcagacacattttggcacagacctttggagcatttctttaacttaatggctgagcaagacttgagatgaagagatgaggaaacacagaaaaaaaaaaaatgcaatgggccctgctggtcccaggcatcagctagggaatctaggtcacgcctacaacaggcgtctgatggggtataccatagagggcggagagtggcagggaatggtgccagcctctgcctttctgggcttgccagcccttggcagggattctggaaaatgagacatcccaagtcaaatgcatttccgcacattcctctccctctcctgcctctagctacttacatgtggttaatagactgctcaaattgaaaacacacacacacacacacacacacaccaccaccaccaccaccatcaccaggatatggaatctatacacgttcgttccggaatgtttaggttgaaaatacacgtacaaatatagtctcctggtgaagctctgtgctatgtatttattccaagtgatgtccacaatctttttggaattcttctggcatctggctttagaatccttggcatattcttgtcaataccctcaggtgatgaaagatgttttattctaaagagtacattttatttaccaggcttatggaattagatgctccatcaatccatattgaatataagaataaatggatgggtgaaacaagcacatacctatagttcttagacaaattcctaatgaaatgaatgaccaagcatggaatgtacaattttttaattttaaaaaagcaaacaaaaaataaaaaatagagattttcttgtatggctcatatggtagaacccagaagaccatttcagtggaacaaaggagaccactgaaataaccagagaaccactcaaggtgatcctggatataggggctattaaccttttaatctttgcattattccttaaagcgtttagatccatttgctccttgtcttctcctatcctctagtcctgaaatcaccagggcaccaagcctcgagaggctgctctctcccttactgggctgggtttctaagatatctctgaccagatctcagagataactccaatccagaggatctttaggcggatctttattctgccaaatcctacactgatactaattttcaaacttagatgtattttaaataggaaaagaagacccaaattatatcattttaacttaccttattttttcctgtaaaacaatatatcataaattttaaaagtctctgtgcttagaagaaggtggcattcatacatttctggggtgtcttttaaagagccttattggtccatagttacatcccatacacatatatattataggcacatttacatgcagacatataaaggaagtattcataaaggatgagtgatgaacaaacacaaagccatgctttgatgttaaagatgcagtgcttcactgttgagaaggatgtgtaattgaattcttggtaatcactgagaatggtgtctattgttgaatgtagagtgctcacagaagtcttgcctagggagtttgctctgttctaaggtgaattctccatagctcaactcaaacatgaaaggtgtcctggcattgagccaaatgcctaggccagggtgttctctggatcctgctggggtcactgaaagaccaaagaaagcaccccaaacctggcctgacatgaaccgagaaaacttgggcagcatttggccccagggtaaggatgtgacagagcctgctcattctccctgcactcactttggcacacattcagcaatgctctatttgattgctacctttccctaataaagagctaggcttttagtggatgttctgattctcataatgcaaagacagaaggtatgtgtgaaagtctccagtaacactatgcttcctgcacatagtctacccattaaatgactgacttggatttcttgcaaagattgaatgctggaggtaatttaataatttaagtataatataaacatttaaagttaaaaaaaaaaaaaagaaaaaagactgatctgggttattaaactttttaaatatgaaagtgatttctgaaaaatgtgcaaaaatgacttttactcttttcttacttaaataccattatcatacaatattcaagtgattttgctattggtgggaagtttagaatgcatcctgatgaatatcaaggatctgctataaaaacagattctcttaaatataatttatgtgcatgcaacacacacagtgtttaaaatccacattcttaagtgcagatgtgttttcagtgtggtctcagagtgaaggtttctatacagggtttagtctgagaaacaactcgggaaacagatgaaaggcatttcagatgattaccctagagacacagtggttctcaagacttgaggcatataggccatcctgggctagtagacaaatttttgacatttaccacctgcttagcaaatgtcataccagttcattttgatactcaccaaatttgtgacttcctagaccagaccacgtagagtctcatatggcttttatttggattgccttaaaaattgccatattttcccaatacctaatagtacttcaatttcttaaaatacagaggaaaaaaagaataattttgctaattaaatcctgtcagaagtacatgaattctgttttaaaacaacaatattaaagatttttgattaggaataaaacatggaaattcccaactaagatataacatagcacaaaaaaaaaaaaccagtaatgatatagagactacacaaaggtaaaataacagcaacaaaaaaggcactggggtatataattcatatatgtattttaagtaactattaccattttctcttaaatgccctaataaaataaagcattttaagatatgctataataccttaataataattcattaccattatctacatgattcattttacctacctctaaaagagaattactatcactttgctataaagcaaacagttctgaaaactacccacttggaatgctgtacagtgaccaggcctgggtctgtattgctcactactctacatccaggacacaatgcactgtttgtcccatcataagcactgaataaatttgttcatctgacaagtatttatgagcatctactatgtttaaggagctgttctaggcacctatatatacatcaataatcaaaacaaagatacctgcccaatggatattgccgacttgctaaaagttagatcagcagccttctttgaatatcaactacttctgacatagagatgtggcacaactatatgaatgaaagaagaaaacagtgtgaaatcaagactcgaaattcttttgagaactaagatatattttctaatgcctctgtccttcagtgggcctgcagtgggcttgcataggacagggaaaaggatttaggaattcactgccactttgaggtcatatgagttgatctaaaatctcagttcatctttcctccatcatatgttacctgggtcacagagggcatgaatttaataagaggtattaaaaaaaggaactactatctaatgacaaggccgccttttaaactctgtaatagttgtttcctgtttatgcataggaagatgtatatttagaaaatttatagttctttttagaatggctaacaattaccagaatatgacacgttttatagccccgtgccttttcttaaactcttccctttgtccccaaagacccttttctactgtccttttcccttctcatctcttgtttgttaaactgatgaatgaaaaaacacgtgaatgaatggaggttgagagctgctaaaggctggttacaaccaggaaagcttagggaggaagctggatgtttacagaaatggctttaggtgtcattagttctgtaatgtagtcctgtgttgtttctgaaaacaaagatagacaggacagtaagttaagcccaaatcagcaggctttctccccccaagtactagaatacaatagccactctgtctcacaaatatataaaaacacacttggcttagtttcttcaatatattactctcatttcaattgagctcatttgtaaaaagggcccatctgcaaaatggcaactggggcctgtccaagtagcaaaaaacataaaaaaaacatccaaagagaaaaaaacttgaatcaagacttcaaagttaaaaaaaaaaaattagattacattttaaaaatcaaataataaaatgtttttgttatttttaaaaaaatttaatgacaggagattgttgtggtagaatgaaagagcatatcacacaaagtccaaagagtcaggtttaggtcagtattagaagttggatcttgcataatttattacttcatttttgtggaccttaagtctttcatttataaaatggataaggagataataccacatttcccagaacaatcaggagaagtgcctgatacaatgtatgtgaaacatacttaccactgttcatgttagttcatattaatttcagttcctcctctgcactccttagtactctttacatatttccagtggcttttaccataatatattgtgattatctgttatatgtaggttattaatctttgtacctgtcattctgttattcatttttgtacctccttacacaatggtggcacacaataagtgtgcaaaaaatattgtttgaagagaatgaacacaagttgttttgttaaatgagcaatgacatttcatttcatttcattttttattttttagaaaccaagtcttgtcccgtcacccaggctggagtgcagtggtgccatcttggctcactgcaaccaactcctgggttcaagtgattttcctgcctcagcctcctgagtagctggaattacaggcacccgccaccacacccagctaatttttgtatttttagtagagatggggtttcaccatgttggccaggttggtctcaaactcctgacctcaagtgattcatccaccttggcctcccatgtgctgggattacaggtgtgagccaccgtgcccggcctaataatgacattttaaaaacacagaagtatgcttaaaattctaaaccaaggtatttctcatctttgaaaaagttgcttttgccaatttgtagataggcaggcctatctacaaacaggacagttttctacagctaagtcttcacatactggttactatgtaaggcttaaatttggtctatttaatgttgaacaaaattctttatcctgttgaacaaaattattcttaacacagccagagtacctgaatcaagactatgggagtagccagtccatctcctgggcacccttactgcacaaagaaaacaagttacatatattttatagctctaaggcaacaactacccatggagtaacttatgtctaacacaggccgggcacagtggctcatgaggtcaagagatcaagaccatcctggccaacatggtgaaacctcgtctgtactaaaaatagaaaacaattaactgggtttgatggcacacacctgtagtcccagctactcgggaggctgaggcaggagaatcgcttgaagctgggaggcggaggctgcagtgagctgagatcacatcactgcactacagcctggtgacagagtgagactccatctcaaaaaacaaacaaacaaacaaaaaacttatgtctgccacaaccagccaataacactgccatttgtttaggcttccatttttacttcaaacacaaagttttagattctctctctatcttaactaaaatcaagaagctggcactaccaaatgttatttaattctatagtgagatggcttttaattggctagtcttacaaaaatggtagtcaaatacaagcataattgtgatcaataactgtaaaatagtttgtagtatataaattccaaaattcttttgaatatgaagaaaattttacattcaagtagatcacttttaggttcctataataacatttaagcttggtaacatgctaccagaacttggttattttttggtaagccatctttttcatctaaaaggagtaaaagaagaataagatgtaaaatatactcatttaagcttaaggtggaggaaggaagaactttaaaacctaatttggtttgaccaattaacgttctgattgtactctacagggagagcacacaaagtgtatacatgcacacacagacatcagtgctgatgtgcagggacaaatttaagagctacctcccattatgaggacataaattcacaaacacactcctacagcatttccaaatggaaagcatgggcatctcattaggggtcgaacatagggcataaaaaagtacaacgaccttgctgggtttggcttctctttcacatctaagttccttgtaaaacaggccaaccatgagaggatgtttaaaacctgtagcattaaaaaagaatctagggtcatataattatttcataaatatctgtaagactgaggaaagttggatgctcctctgtttcctgcaattcaaaggtaagtgaaaaccaactttggaattaatagctttcagagatctgaaagcgttctaataccaggattttcaatgctgcaatttaacgacaaccctgctgttggccttttctgacctgttgtgaagtaaatcaggcaaactaatgtgggctaacaagtctttttcacaccgttcgatccccctgcttctcttttctccgcagacatcgcctttctcccactttctgtctagccatcctccgtcaaagcacacaaaatggccactgtaaccctgcatcactgctcattagatcacaggttagtcaagtggaactgcccggggttcccaaaggagagctatacttcaaaaatctgtccatgtcaaatgaagaaaaaaaccctgagcgtggggtcacccagatcaatgatcaaaagaaactgagaatgaagggggaaaaaagcacaccctcgtttttgttaaaaacacacaggtctgatttattataaggaatacagagatacgatggggtttcctcctcttctgccctgttttcattttttaactaagtaatttgttttaatcaggtcctgttggttgttaaacttcagactttggaaagtctacaactaatccttaaaatttcccccaaagaaaacccattctaggaaatccagttttaaggaggactcctaaatgtttccaaaaacacttgaaaagcaataaaagtaatacaaagtaatccatctttaatgcttgagaagattctatttaaatctgagagtaagagttggtgcgacatacactttaatatgctttaaaataatccgagtaacctcttgagccttcaaagaggggaaacaacaatctgtcaatcacgttaggagcacacacaagtgacatactataaaaaggcagatttctggattttggtgaggctgcaaagatatgcaggtaggcctataccttgtttaatcatctccctcatttcttctatgctattcaaagtacaacattctatatttgcatttgtactttttgaaaaaataacactactaatataacagtaccgcaaacttgacatattaaaaatgagggcagaatgatatatctggaacatcttaaagaacaagacttggtatcaaatttcacaagtgaaaatcaccaaaagatttggttttcctggtttcctcataactagagagaaaagtacattttatcggctaatgattaaaaaaaaatttctgcccgcaataccacatatatgaatgaaagtaaaataagttaactgcttataatttaacctagcaaaagttgtaagggttgtgtaagggctttatagctttgcagtattttcttttttacatttggaatttattctttaagtaccctcaaaggaatataaatatattcctttgtgactaaattaaatattttttgtttgacttttgtgtatttaaaaagcactcccatgacacttactctataccagacactgatataattgccttatggaacattaactcattcaaccctcaaaacaaccctgtcaggaggagggggaagaaagcagggagcaactgttaataatgagtaagactctctatgtgctatgccctcctttaatcctcaccattcactacaaggtaggttctagaattagccccattttacagatgagaaaacagacttttaagtttttgcccaatataatttagatggtcaacagtgagaaggatttaaatccaaaagttctgacttcccagtcttactgtttgtcatctccaaaccaaagtgccaagttaaatattcatcaagttaaacctgggtatatcctgtgacccccccgtaactgcaattttacatgtattcacttgagaaatgcttgcatatacaaggagacatgtacaaagatatttatcaacagctctgtttataatcacaaaaaatctagaaagaacttaaatataaagaaaacaccagaacattttttaaaaagctgtaaggcatcacatataaatttttatcacacaaaccattatcatatattatttagagacacatgtatatgtagtcaaagcatagaaatgtacactgggaaagatacacaccaactttaagatatttcttgcttctgaaggagaaaggatgggaaaatgatgaggaagggaaaggaaggggctttaaatgcagctttcatgatttgtttcattaaagaaaagatctgaaacaaacatgataaaatgttaacattttatcacgggtaatgggttggatgggtttgtctgatattttctatacttacctatatgtttgaaatttttcataataaacacggtatgactgcttagatgtttacctcatgcaatcacaaataaattgtgaaattactgcacatggttcctctaagtcctctccctcatttgactcagtaaactgctaaaaattcataccttggtaacaagttagagattaaactattaaaattaattttcttaaaagtgttttagaagtaccatctttaagaaaatcactaaatttgaaggaatttaatgaattcaaatacggactatattaatatatagtctatgtttcattttgttgctaaagaaaattcattaagttggcatttctaaccttttgacattcaaagtttagtaataaagcagcctggtttcagactgagaattgtaaattagagctgaacagggcacttgactagaaaagtgaactacttttcactgtatacctttttgtaaaattgtaccacatggctttattaatcattcaggctgattattaaaataagattgaagatttaaaaattatgtaatatcacatggggatccaaatgaaaatgatagaaatacattttctatagaaccttagttagtcatacaatcttaattgacagaggatggatcaagcaatctcaactacaattctttacaaatgtatgcatatttgtaaacaaaatgagtgagagaagagttgttattctaaaaataattgtggtgaaagtaaacccacaaattacagccacaactcttcctttaacatcttaaaaatatgatacaactttaaataacatatatttttcagttcggctttaccaggctaaagaaacatatgacaaaattttgactaactagagtataaataaaaacaaataatgaaagaattataatttttgtattccatttttaacagatgaaattacaaaattacagattcatattgagtgttttataaaaaagcaatgtctaggacctaaaagtcagtcattgcttcaacaaaattattttctgcatctacactgctagaactaatgttctaaataattgaagggctactacaacattcagaataattaaagaagcctgtatttccctagagcagaaaactgtgctgtattagcttaaaactgtattagtttaaaagatttaacaatatgaaaagaaaacaaggagcttctctggtaaagaaaaaaagatagctatagtgctcaaaaacatttccattaacagtaacaggccattcattactcaagtacctgatgacctcatgctttgccttaaaatctattctcattttttcacttaaaaaatggacttaatttgcttattaacataagtcattaaaaagccagtgttaagaaaacagaaaaatgtcccaacttatacttaaagaaaaacatcaaagttaatatgcaaaattggtatccaaaatatgcagaaacatgtatttccatattcatggctgtctatttaaataatttacatattaaacatttaaataattcaaatatttacacttaactctccaataaatttgaccaatactattttattttttgttttgtttttttttttgagacagagtctcactctgtcacttagactggagtgcagtgatgagatcttggctcactgcaacctctgcctcctgggttcaagtaattctcatgcctcagccttccaagtagctggaattacaggcgtgcaccaccacgcccggctaatttttgtattttagtagagaatgggtttcaccatgtcggccaggcttgtctcaaactcctggcttcatgtgatccacccgccttggcctcctaaactgctggcattacaggtgtgagtcaccatgtctggcctaataaataccactttaaatgaaactatatgaaaactgagtaaaatgtaaatctttatgtataacaagaaagaaagtgttctttctaaacaatttgtgccatgttttggaaaatcgggacatttatctggacacagtgatttgctttcccataataataataataacagtagtaacaatagtgttttgtgcatatacattgtacctccatctcaagatcttttttggcctatttttcaggatccctctaatgattattcagtcttctcttcaatgaaatatgctaacgcctgatgagagagcatctttctttcatagcacagttaacaactgtaattcttcaaccagctgttctctaaggattcccctgacaagctcttattttcattgcattatttctttgttctccttgtctaaactgtacacaagttacccagattttccactctggcccctttcaataaagaactgctttggcttgacaaataattagtcataaccagtattaaaaaataaatattacaaattctacatgctaaaattatattgttctatgtgacttctaaattacttaacagttcatatgtagaaccttcttcccataaggctccattggtttaacttctcatttatgaaaacaatcccagttattttatggagctagttaccatgtaaacattatagcccataatcttatgtcaggtgtagcatgaactaaaactcaatctatgtatactgtgtttagggcaactgaatccagatacttgaacatattaagatataagcctaaataaaacaaaattaaaccctacttgactcttctcctttgtaacctagtaaaaaacttgtaaattttttttttgttgtcaaatatttatatgtgtaccaatttagatcttggaatttctactaaagaaagtaattaccacttcactattagatactgtgataacaaacacagcaaagaccataacaggcccagtcagttgaaagctatgtgctaccttcaaaatgagatatttttcttcattagacctttgtagtataccttcttattggtattgaaggtgtgcctcatatcttcactcaaaactactagataaccttttttcatggtatcaatcctcgaagtggtaatgtgactattgaaataatagagtcatggctgaatataaaattctatataaagagatattattaaagaaaaagaatgagagactgtagataccaataaacaaaagtgaaaggaggtactataaacaaattactcaggtttggattagttcatttccaagcctatgtacactggaagagtggccacttctaagttgcattcagtctattacatgtaccgttgtacatgtccagttcattgttttcatcaaaggcacatgcaattcataggtaaggaaaaaataaagtggcaaggagaaaaagcctgtttctaagtaggagagtattctattcattgcaaaagatgaaagcaggtatctcttattacatgtttttgttctcagaggaacaaggccaaaaatatgtgattttcgtatttgtgctaacgcagcagaacttttcaaagtcactgccagaaatggaccagctttcttacctgttttttccatgctttaagttaaggatgtctgcctcattatgaacattgctggttcccccagacttctgtagtctggctttgctgtgattactggtcaaaacctttaattacagtatatagtttgtgcagctgcctggaaattggtctcagggtcagtggctcttcccgttcccctctttccattcttttgaagcaatattgctgaactgaaggcattgttccagctttctggtgtgctctgtctgctgcacattatgaatagctttgcaatcactctagcaattggttcttcaactgcctttaggttgtcaattgtaattcattggcttcaggcaccttttctcttttcattctcttgaggtcttttattacttaatttgcaataatattagggaatgtcttcttcagacatgtcactaatgccttactgattatgaggctgggggtacatttgactttcatacatgcgcctgttaaaatgtttcaatatttccttcatctctgtgacttgtgatgccaatatttgcagtaccttgcaaagaagtttgcttaatgctgaagtcttctctctaaagaataatctaaagactcctccttaagatattcttattggggttaatttatataattagttatagttatttttataacttcccaaagatatgatttctcatttttataataggaactaagatttcatattttcttcccatattatgccctattcttttttaacatataaaaattataatttcaagctccacacaactcagagatactgaagtagaaatcaatggctatgttttcagaaccttttaagaagacctgtatttgctcctcagacatatttgtagagattatataagaaaatattaagactattcaaaatgagtgacaatgcttctgcattacagaatcaagaggaagttttgtttctgttttttcaggggaaggaataaacaaatatatctcttgctccattaagaaaaaaagtaaaccatttgtgcattatgtctcaaatccttagttctggataaaatccaacagattaacccttctcattagtctcagccatctcagagcaaccaagggtattttaaagcagacactatgtaataataataatgataataattatcataattataataactaacgcttattgtgctttttatcttcaaagtaccttactgacattaactatgtctctattttcaaattaatttacctcgacaaatgttttattaactttgtaagctatggaatgtgtagtgactgagttctcttttgcaaataaaaaaataaatgaaaggaactaagggacaaggaaagggtaccttaaacttttgcctcaaatcagccattgcctttgttgaatgaggattaatgaaatgctaatttttataaaatataatattaacatacagatctaaagtgtgaagatcaccactacaacaacacaaatacatactacctcaaaaagattagaaagtagccaaataatattgtttggataaaatcagtctctaactttactagttatgattcattataaaatatttaaatatgcatacaaagtattaaatataagaattttttaaaatccttctaagtttcacttacgtaataaatgattttattaattaaaaggctacatttttttatttgtttgttttttgagacagagccgcactctgtcacccaggctacaatgcagttgtgtgatcttggctcactgcagtctccacctcccgagttcaagcaattctcctgcctcagcctcccaagtagctgggactacaggggcgcgccaccatgcccagctaatttttctgcttttagtagagacggagtttcactatgttggtcacgctggtctcgaactcctgacctcaagtgatttgcctgcctcggcctcatttgtttttaataaattgaattcatcactttaaaaccatgtcattatgttcccttagagcttcattatgtaccagtctctatgtgataaatctaaacaggaaaaaaatagattttgatgctagcaaacaacataagttctataagataaatataagcaattattttaaaatgtattaaaagaatatcatttggccaagatgtccagccaatttctatgagggattttggaaagagaatagtaccctgatatggtgttaaaaaaagtccacaaatagacaaacacaaatgtagaaacataaaatcaaacatttgtaaatacgataattaacaagttgaatctttttaaaactatgtattaacatggttagagtggtgaggattcgaggaagatgtggtttgtaagcaatattaacaggtcaggtttggtgtttcaggaaaataaaaatttttatattcaaggataaaaatagatgcattggcttgagtaaagagagagtaaggaaatctggataaagttgatggtatgaaggcagtaagaaaggatgtatggtaagattcggaggtagtcactctttcaaacaaaatacagttatcccttggtatcttttgaggatgggttccagaatctcccatggataccaaaatctgagacgcataaatccctgatatcaaatggaggagtattatcatataacctatgcacatcctcccatatactttaaatcatctctagattacttataatacctaataatgtaaatgctacgtatatagttgttatactgtattatttagggaatattgacaaatagactatacgtgttgaattcagagaatggtgtttttccctgaatattttcaattggttgttggttgaatacatgaatgcagaactcacagatatggagggttgactgtttattgaccacagagacataaacaagccgtaattcctgtccttcaacaaacttacaaccttaaggagtagacagagaagttataggcgaaattctaatattatgatttggataagcgcaggttgccaagggaaatcagatgagagagcccaactttggcatgggcattcaagactacttcctgatgtaatacatcatcttgagggggttgtattagtccatttttacactgatgataaagacatactcaagactgggaagaaagagaggtttaactgaacttacagttccacatggctggggaggcctcagaatcacggtgggaggtgaaaggtacttcttccatggtggtggcaagagaaaaatgaagaaggggctaaagcggaaccccgtgataaatccatcagatcttgtgagacttactaccacgagaatagcacaggaaagactggcccccacgattcaattgcctcctcctggctccctcccacaacacgtgagaattctgggagatacaattcaagttgagatttaggtaggggcacagccaaactacatcaggggttttcctagtgaattaggaatagtgagtggtacataagcataagtgagtgaagaaaaaggaatccgatgcacattaacatagaagatctgtggaattacattcgattccagaagggattaaaagattattaatattagaaggttttaaaatatgggtatcatgaaacttcgataggaagtttgcttgttctgctctgtgttgaaaaatagtgagaaaagaggagatctaggggtgtaaactattaggaaactctgagaagcacttcagaggcagaagtgggagaatgagactgtgaaaagtctagatgtggagaataaaaaagagtacgaattgaaaaaggcttcaaaatgttcactttacataaaatgaagatatgtatgtgactgaaggaagatagtggaaaggaatgggggttttaaaagagaacataataaattactttttgtatatacattgacatatattgagatgtataactttattaccctcacctaaataatttgcttgataaaatggacatttcttatataacgtatttgctcatggaaattttgcttttggtggacaaggcacactttaatcatattgcttggtagatgcaagaaacacaggtatacagaggaaaaaacagtgagatcaaggtggatagacatagaatcaagaaaatcaggtatacaaaattaattttatcaaagaatgcatatagaaataaatgaattaatgtataataaataaaatattctggctgttttagtacttacagcttaaaagttgctcttcaaaatacacttaaaataatgacattcttatacctaatgaaatgattgctaattcagaaatatttatttctcttgataaatattttcaagagatagctgagtcattcagtggaaaattgacttccaaaccctctcattgtttcctcaatatttaattgtaacagcgtgcagtgcatctgtaaggaatgaacgaaaaacagtttgtatctctcataccattttagaataagtatacgtcccataggggaattttcaagctgctcacaccataggtatgtacactgctccatgtgaaatcaaatcagtattctaaaatgctgccaagaggcaggtcaagatacttggaaaactcttaagatttagagtatatgacactttccaatgattattttacaaacacatttctctacacatacagaaagcagtattaaattaagctaagcattttacacgatttaaacactgctttgcattttttaataaaagatttgtcacatgaagtcagagaagatactcagtacttcataaagctaccaaaaaagaaatgatctgttatcaagcaatataaatataaaataatttaaactatagtttattatctagagacacagattgcccaagaatttcagtctttcaaaactctgtctgatcctttgtagaaaggaaaaaaagtacacaaggtagaaataatcacctataaataagtagttataattaaatgtgatagttaaataccatagaaacacactagcaccctcttccagaagatgtctaatactaaaaagcgaaaattaaataaactcttcatgcacagagtaatgaatgcattgttcaaaaaaatctgaatatttataaccaaaataaaacatggtctaaaaaaccagtaatgtttatatcattacaaaaatacttgcaaatacttttctcgcatttatatcttgtttttcaaacataacacaaagttctatgcatgtcataataacaaactgaattaaaattgcataaaaattgagaaatggcctgatcacaaattttaactttaatgttgacaccctaatttagaagctgtattttcctgtgttaatgagccgtggaacaaatagagccattcaaccttataattctgcctcaaaactctgtttcacagtcttcatatttctcaattagtatttgctttaatagaaaatattcaacaaatacttaacactgtacttttgatatactatttctgaaaaagttaaatacttttggattaaggatatagacaaacatcaaatcagatgacattgctagaaaatatagactgtttcatgttaacaaaacgtgttcttttataagacacaatgtccagtaaaatgaaaataagattttaaaaaccaggaggtaaaagaatcacaatcagcaactgtgtagaaggaaaataggattacatttattggctactatatcaacttaacttctcataaaaccctcctgatctattaaataacttcagaactgaagtatgctctcctatgggagttgtaaaacaaattagttacaattacaattcaatacaaatgagaaaccaacctatttacccttaagatttctctcattttatagctttatcatttaaattagatcagaattttccctaatgtaccaagtgggccacttgacataataataaatttttctcgaatgctttctatagagaaaaatagttgatatgagtaaattctggaattcacctccccaaagtgaatacaacaaacatctgttgcaagaattgcttggctttcagacagtatgtaaagggtgttctttttcctagagttttgctgttgttgttgtttttttaagcttgtttaaaaatacatgttttcactatcagctctcaagacataaaatcttaaaattctggtaagttaaacccaggtcattaccaggtatattacagaaagaaaaaatatgtaatgtacaagactacacttgcttttgaaagggcaagaaaataattgggcatgttgccctctctctgtgggttacatagtaattttaaccattgtcttcatttcttaattcagtgctccacacaaacatagcaacactcatagtaggggaggggactacatatacaacttccttatgatttttattctctttggagtcccactgataatttgactttctcttttgaatttcactggcttctccccacttctaaagtcaacagtatccagacacactcatcaaccaatagtgtgtttgtacagtttcactccagtgacaggataaattattgcacattttctgcattaaacataaaatgtaataatttcaatggagtgagaagaagaatcaatagcctttatgactgattatcttttctaactgaatcaaagtttagtgctttttggtaagttgaatgcaccttccttgattctgacagatcagaattttgcctaaaattcacaagtattttgcagattaaaataccatctttttagcattggtaaattccataaaacatacacaaattagcaggtgcaaatgagtaagaatgcttatcagcaatagggcacaggatgtgcaacacctttaggaaagagagaataaaaagacgaccgttatctaaatacatttctagtaacacatgactttgctcacttttcaatcttctactgcctcttctataataccaatgcctgctcccaacgattttaaagttattgtttacaaaatgtttaagattcaattccacaactccatttttatgccaacaataaggtactgatttaattcttaaaacattcctgagagcatttcaacaaggcattttaatacagtacacagagaaacttctctgtcatcaagaaatgggaaaaatctaggatatatccttttctttttaggccagacccaaagtaagtataaccatgtcactgtgcttccataaacttcaagacttataatggaattagcccatgtatcccattaaagcagtctaaagtgtagacatgcacctgtatggtatatgtttatttaattatggggaaaaatgctttacttaaagcagtccccatattggtattatgcaaattccattacaagcaaaagttttgagaaaagtaaatttaaaatggatacaaataaaaaggaaactcaaagccacatatgctccagtatacacaagtttagaatcattttcagaccatatctatgacaacgctacatttataactatcagtcttactgaaagatgaatcacaaaaagaaggaaaaagatatttgctctttacctaggaaagacagccagtcaacacacacaaggaatactcagaagcaattaattgctaaaagcttcctttattcaatgtgatcatctttcattcctatggagggtaaccataagtcatatgttaggtttaaagatacattactttcaattatatgatgtctaaggaaaacagatacacaggttcataactttaaaagcagaaagaaaaaatcttttttcagatattgcaaataacttgaataaagttatctgaagttaaaatggcacttatatctatgttttatcaatgtgtatatgtattatgtatatattacatacacacattatactgtctacatgtagtagtgtacacatacatattacaagattttttagaatgaatagctgaataacaatgcattctcagcaaacgaccttataatcataaactacccttcattacatactattatatctactctataggcagaaaaactgatgctgagaagttaaaagatttacaaactaaggtcttaaaagcacattaggagacaccatcattataatgctgaagatcttcacattaatgactttctgaatagatttttattgctgttttttacttaattacttaatattatctataaggtatttttcaaactctattctttaaaaggtgctacgtacttaatgctgaatgaggcaactaaagtgagacatgagctctgtctgttgaataatgggtccttgcctttcttttttttaaactgtgtttctaaaatttgaataaaaactctatttatatggttcttctacttaggtgtttaaacttcaaagtaaattatccaaattaatcctattaacttatcataataaattggattattctcattttagaggtgagaagccaggcacaagaataggctatctgccgtgggtcacacactaagtgtgagggaggtctggagttagaacatgttatgtccttggctcctcatttatttttcaggctgaaaggcaagattgttcatattaatcatctcattccaaaatcacttgaggaagcatgcaattttctgaaggagaggggaaatcatatcctgaaagttacaagtataaaggaatacatcaggagttttgatttcactgtacttacgttataattcactataatttaagttttaaaaactattcacatatctcattactgcagtaccatgaatcacaagctctattggctgagactctatttgcctagaattagtctcatgcttttataggagagatacaagctaagaaataaaattaaatgaggaagataaacattggttccatgttaaaatgtatttgatggcatggaatttgcaagacatcaattttcagcctagcagattacagaataggatccattaatcctagtcaacattgaacacttcagaggaacaagaacatgacacctgaaggcgagtaatgcatggaaatactcacgatatgttcctagaaaagctgaagaagagaatgaactaagtccacaggttaaaacaacattaaataaccaggcctttagcccctcaaaatagatgaaaaatataaccagaaacatcttttaaccattgctaaatagctagaaaactctgtgctctccaagtagggttaggtatgtaaacaagtgctaacagattgatataggctttctgcttcctatgaaaactaaggtttcatgttgaaagcagcataaccagcacattcctaattacatgcatttttccaggttccaacgtggcagcaaaagtacaagcaaggaagacaaagagttgtcatgctaatgagacatacctcttgtactgagcgagctgctggcttgtcttgatgattggccaatattaaaaagggtaaagtgcataactgtggatgctgaagagctgagtgcagctcatttctagcagcttctaaatcatcctctgaagaggcactgtctaatacaaatattaccccttgagatccttggtagtagcggctccagtatttccggatgttatcagcccctgtcaaaaacaaaacaaattttcgttttaaaaagagctttcagcaactgaaaaatgttcccaacagtaattcctactggaaaccaatgtaccttttaaaaattaagtgctaaactctgtggtatggattaaaacaggaatttagaaaaggcagaaatcacagtggatgggaacaaagaaggcagtagagccaataggtagatttggccttgaaggaagacacaaaatccaagccattcttaatgacttttatataaaaatgtgtgtgagagaaccaggataaatacttcctagacttaaactcaaaaggatattttcagactttaatcatctcaaatgaactacacactctctaaaaattgagactgaacctgcctcagagagctgcatggcctagacatccaccaacgcttctttccaaaccattaacattagcttggtgatacttttttaacagaactgcttgctgatcaggacagccttgtttaatttcacctagggagttattagcacaatagctttatgtgtcaaagtgctaaagtttgtgaaaaactaaaatcatggcctttgatacaattacatgattctgtttggcttcataacccatgaggaaaaataacagacaacaggtgtacacttatgatctcaatgagataagatgtttattaaaacaaacaaataaacaaacaaacaaacatatggagaggctgggcgcggtggttcacacctgtaatctcagtacttttggaggccaaggcaggtgaatcacctgaggtcaggagttcaagaccagcctggccaacatggtgaaaccccatctctactaaaaatacaaaaattagccgggcgtggcggcgggtgcctgtaatcccagctacttgggaagctaaggctgaggcaggaggatcgcttgaacccgggaggtggaggttgcagtgagccaagatcgcgccactgcactccagcctgggcaacacagcaaggctccatctcaagaaaaaaaaaaaaaaaagcaacaccacatggagagtctcatcagccaaggcatgtcatgtagtattcctctttgtatttccattatatagcacaacatctaactcaaagttcagtactggaataatgaaaattgagggaatgagggagtaaaattatatactaattaagctttacaaatttgagactagaacaaactctagagatgatttagtccaactctctgaggaaactgaggcagacagaggtaaagtaagtgatcccttgtcatgtatctaataaatcacaaaattgggatttgcatgagttagcagacaacctgcccagggaaggcataggcacttcccattacatcatggtgactgttttcatcactttcattcaagaataggaggggcaatatgtgtgcatgtgtaggaaaggggtgctactggttatataacgacaattagatttcaaggaatttcaccaatttattgcatatgatcaagtcctaaccagttaataactgtatttcagtcatccactgaacatctagctcctatgtttgacatattgttatgtgttagggaaacagtggggactgcagttggtgtgccctggctggcaagggtcacctgtttgcttctcttcccaactctgtgctcagtgacatcctgttggtagcttgaaatcaatcagggtgaaagcactgtcactatggaaatcagcaaatcctacatatcgagtcctttcatctcccagagagccaacacaccactgatgacactgagcagcttatattttctgggagaaatagaaaagaaaactcaaagattataatagagtacaagaaagtgctgtcatagagatactcattaggtcctctgggatcaagagataggcatttcatccaaagtggggcaattcttttttaatttcattttttaaatttgagatgggttctcgctatgttgcctaggctggactcaagactcaagtgattctcctgcatcagcctcttgggtagctgggactaaaggcacataccatggtgcttggggcggtgggggtaaatttcttgaaagaataatatcagtagccaaacagctcccatttattaaacacttcctatcctccaggtactaagtgttttaaaaagaaaagctcatacaattcttacaacaatctaaggagggaagtataattgactaagcctttgaaactaattttcaggtcctaaaatctgtgatttcaccattatactatacaaaaataactaggtatatatttaataagaggatcaaggacatttgatgttgagtaatgttaagtatgtgaagacatgggatatgagcagggttgatgcatatcaagcagggtccaactaagaaaacaaaacaaaaataaagaggaaatttaagccagagattatttaatatagggaattcattacttaggtggtggtggaactaaggaaacagcaggggtactgagataagcaacatcttaggtccggttccctagacacagagcctgagacatcatttcttgtacacccgatttagagggagtgctgtcaggagaaactagaagtgaaagaagtaagctagaatgggggaagaagctaggcaaagatattgtttcagaaatctagcctcagcttgatgcgataaggaactctaaagcatggattgaaccacagaagttgtctagtccaaaggcaagggagctgagctattacacccttgtatagtcattagccatccctggggagcaggagggggttggggcatgatctcataatctcccaaacatatttggttggggcaattactgtcagccaagggcaggcctctggagaagagtacaggtgtgagtcattagcagccaatacccacagcagctgggagatggatgcactggcccaggaaaggagatctgggtaggataccaacagcatctgctacaggctacatccagacactatccatatgcttgagaaccatccataagctggagggacaaaactggaggcagtgttactcggtggtaagtgtttaaaacaacaaaaatagtgtgcatgtgtatctgtacactagcttgttataaatttcactaacatgaaggatgtgcagtgcacagttttcattgtaagactcaatgcagcatgctttattgtaaattccacatagccaactaatgcccacagaatgctttcattgagtttctatccacagccaactaatggctgcaattgacaaactagtgtagttctgacatgaatggtggctgctcaaagtgttttacgtatattaaatcacttacccatgacagtctaatgactatcatgaggtaaatactgttatcaatctcattttatcaacaaggaaaccaaaacacaaaacgattatgtaacttgcccaaggttacacacctaataaatatatttaggtctaatgtgattgaaatagagatcatggactaaaaaggcaatgaggctaaataaagaactatattaccacataagctaggagaaaagaaatggaaccctattggaacaaaaggtaagttaatgcccacatacattaatggaaatatgtccaaaaacatttcccaactggttaattcaatggatagttattaagtacctattccatccatacaagtctctgagctaggacctaaagagatatttagaaagccattattcctcttaactgaaaccatcaaatcctgtaaagtaatacaaattacaatgaggcctgcaaatatagcaggcagagcaaatacatccacacattagatggtgtccagtgagtcaggtataaagagaatttggttgcatgttttactagagcttgtcccttggaaacacacaggacacctggaaattcaacttgtgcagtcaactctttcaatgagaaactatgttttcattggccacatttaggagtacatatggtacctgcaaatagtgagacacatacacacacacacacacacacacacacacacacacacaaacccaaagagaaataccataactttaaaaaatgtcccttatatgacataatgtatgaataatatattaatagtgaaaagatccttttctttaatctcctgctacagtttcacccaagaattcccttaatacggcagtaaaagttattattttattaacttagctcttaaacacacttttaaaatattctatgtgactaaatgggaagtaagcaaaatacatttttgctacataccaaagtagacagttgatttgacaataagcacttgtacaactgtttgagttgtaagctacttcacacaactccatttttacttgaaatttcaactgacaaactatgattattcagatttgactgtttgatagacattttctcaaaaatagatgtgcaagcttgtcatttcaaggaaaacaaatgatagtatttgttgtcaatggtaaaatttgttttcaagcaaaagctagaattttagaaaacttatttctgctaagttttaagtgagcctgacagcttttcagtgatgagattggtggtgatattaatagacagatattcataaagtaatctgtaaacatttggaagctctacactactcagtgaaccaatattttccaaatgacgaatgcatgatgttacaaaaccatgcatagataaaaaaatacattcaaagtacaagaaagaccaatgcaagttaattaactgagtacaaaaagttccctgataagttttccagattccacactacaactgattaagaaacaaccacctgttgaagaatttcagtatagtatcaaagaagacaatcaacagttacttaaaaaggttattaaatcatgcctccctttttgagttatctatgtgagactagactttcttcatatacttcaacccaaacaacatattaacaacagattaactgtagaagcagatatgagcatccggccctcttctattaaaccagattaaaaagatttgccaattttctcactatttttttgttttcaaaattgttgattttcattaaaaatgttatttatattaacatgttatgagcttattattcttttataaaaatttttaacatggctttaatttctgacatggcacatatggatactcattgtctttaatgtgagaaaaagacatttaagatctactgaaatttaggcataaatttagagctagtttctagcgggaataaaagtcttactttaaactatctttattctaaccttggctgactcaagtcccaagatagaagagctggagttgggagggcaatctcaaaactaagaggtctacccaggaagcatcctaatctccttggtaccattatatcggaattctaacccagtgatcagatacttgaaggcctagaaagattactgaattgtgtgttgcccaggaactttaaatggcatgcctcccaggagattccaaggtaggtggtcctcagcctacattttataaaacaaagttctacgtaccatacaaactgatatgccagttgccctctcctcaccttatcctccctcaacacttattctggatgtctatgtgactccaaacacaattttacatcattatcttagatgtcaattcctaacaattgcattgaggaccatgtctgcattctgacattggcccctcctttatgttctcactatggttcatgccttcatcaccttccagctggatcagtaggatgaccttccaacggctctttgcacagctccagttaaattactcatacttgtcactatgggttcaatgccccttcaaaaattaagaggtagaacctttaagaggtgattaagtcacaaggacttcactttcaaaaatggattaatgctgttcttttggaaatgggttcatttgaggagttttctccattttctcctctctcttgcatgttctctcaccatgtgataccttctgcacgttttgatgcagcaagaagacccttgccagatgagaccccttgaacttggatttcctagccgtaccgagccaaaaaaaactcctattgcttataaattacccagtctcaaatgaaccaagatacttacctagaaaactagcacaaactatcacaaatatactaatacttgtccagaaaactagctcaaattatatcactactctgctcaaaaacattaagtgcctataacttgaagttctcaaatgacttgatttagcatttatagttctccataatctggctccactttgccattcctaccatgttcctctgttgatctccttagatactccacaaatgagcaaaacgttttgctctcctggaccagacctaaggtttccacccttatgcatttggttttgttatctcctttgcctggagttactaccgtgtgagttgtccccttagttcttgtaaattcaaaccactacatgcgcttcaggggccagatcaaatgttgcctactccaccaagctttacctgatcttgcagctgggaataatttctaaaaatcttctggtctgtttctcttggttctccatgtaacactttctaccctgtagcatagtaatctaaatgcatagttcatcttcctgattacactggaagaaccatatgggagttttgtgcattttcgtgtctgattcatcaccatactctgaccacatctaacccataatggaaactcaatagtttttaaagaattaatcttttatagaatacttattctgatttctcaaaagtagaatgtagaatttaccaagcaaatcattctttgctatacaaataatctatctttttggttgatggtggtggcttgagtaaagttattagcaactaatttttatgtttctggtacatacccagttctgcaaggaatctctcattcagcatctgatattaagaattccttaaacatatttacaatgaaacttcactctactcataggcctttctcagagtcctgtcgtagtatttgaaaacatgcagccataatacagcacgtgctaagcactgtactaaaaccacaaagtacattaacctatgttccttgggatactttttgattctatcctatttatgaacctttatactgttctgatgtccaacagaatcagtacccaagagaaactgaaagcatagaaagaaaaagctgtgggaacagttctggagaaatgttcccttccgtactcctgcaaaagccaacagctgactccttagaagaaccacagatgccaaggggatcacaacttgcatagttccaaatgttttttaagcagctaattcttgagccattggcatgacacaaaaaacaaaacacttttgtggtattctagaaaatctggtggcaagactagaaaagctagtgggaacagctttgctgcaattgacgttgaccaaagcaataaattgggaagagccaaaatggagacttcctggctgacagaaagatatttgttgcatacccaggatgaaataagatcttttaataatgcggaaatgctactgctttctagcacaacttgccaatttccccaaccagtattttttcttttttatcagaaactttaacgtaccaatcctgtgacaaaactgataaagatgcaagaggttctagattaagacaaactcacggaaaaagttaaaaaccatctaatgtctcatcctatatagcataaagtataattagagtcacatactataagccttgatgttcaaaagtggaatagtaaatttgtccctcactttgagtgttttttcgtctgtgactaatcagacctcaaaacaagttattaccatatttactcacataacaaaattgtaagagaattatgcttgctctgcaatatatgactgcactcacatttgctctttcatcttttaactgtctctatgacattctttttggaaatgcttatcagagctcttaaaatgagagttccatttctccacctggcccattccctttgatctagttgttgtccccctattgatgacagaaggccacccagcatcatgttcaggctcaagcataaaatagtgaatggcaaagaaaaagtctagatttcagggaggtgacatcaatgtttaattttataatgtgcatatcgaattatgtaattagataagtcaatgcactttataactcataaataaatttgggcagctctaagtttagggatcaagtatgttctaaaactttccaaagcttctaatttttttgagaattcagtacacaattttccttgaaaacaaagcagtgaatctcaggagtgagattcagccctgaaggacagaatgatggtagagtgatgaacagcatggactcttactgagttcaaagcctggctctgccacatatcatctaagtaacatgaaaactccgcttaattgttccaagcctcagtttccctctcaataaaagagaggaaaataataatacttaattacctcataggattgtgaggattaaataacttttttcacacagtacgtagaatatgctaactgttcacaagtgttaactgtcattttgttgtggatgttactattatcatttgtccaccatttaagcctataactcacagaactactgaacgaagaactaactcaagttagctcagtacctggaagtaaaaggctaccagatgctgaacaaaagaggcaaagaatagattttctgtaattcctgagaaaaccaatgttataaaaaaataaaccaaagtttttacttgggacagaccctttctttttctgttcaactaactttctcctatgtcctgtatcaccttcagactcagtattttataatctccagtttcttcctccctcattgctgtctagatttcttcccttgactaacaccaaataagaaatttctccccttcagacaaaaacgcatgttctttcagtacaggtgtcttcaactagacatgaacacaaacagcatgattagtcgtgttaacattcaggtgacacccttatgaaaaccaaaactgatcactaatacaaactggttttgtccacatgtgcacgtgcatgcgtgcgcaatgtgcgtgtatacgcatacctttgagagatgatgttacctacaaggctgacatacagtatacatacacatacatataaagctattattacactttatgacatttctctttcttttgttataaagcatagataaccaaaaattggtactatttttttcagcggcttgcatggttgcacaaataagagctcaggcagcatgggttaaggcagggggtgccatttgtaggcaagtactcttctttttttctgtcaagtagatttttaaataaaatataattgaattgtgaatacaagaaaagcaaacacaaatctaagcacaaaatgggctttttcttaataattcttgtaactgtttataacccactttttcagccttttcacagcttttgcttaagcattctaatttcactggttacctgtctccatagctctactaaataatttttataaaataccccaagattctcatttgtgctgttcatcactgtgtctccagtatctatacagaatctggcacagagcaggccattgatatttattgattaagttaattaatgagtgaatggggagtgattatgtaaactatttacccatcgattcgaggacaagaagtctcatttttatatagtctaaaagaactcttactcacaccctctcttctttttatattccttttttttttttttgagacggagtttcgctctttttgcgcaggctggagtgcaatggtgccatctcggctcactgcaacctctgcctcccgggttcaagtgattctcctgcctcagcctcccaactagctgggattacaggcacctgccaccacactcagctaattttttgtatttttagtagagacagggtttcaccatgttggccaggatggtttcgatctcctgacctcgtgatctgcctgcctcggcctcccaaagtgctgggattacaggcgtgagccaacgcacccggctccttttatatttcttatctgaaatactgtttcttctctctgagcttctttctaaagcggtacagtccctttttttctattctcagaagcaagcttcccctttgtgttttgaaattgccatttttaaagaggatgctagtaacatgatcatcctatttcagacaattcgaaatgaatagtttctatgagtgaaggtggatgaatgaaccattaaaatcatgtcttaaagtgatcagacttccctctttacacaattactatatattaaaacaagactagcccactccatcacatataccatcaagcaggtttcttcatacttaatcatatcactaaatcagtcattgccaaccttctatcttatgctctggaatgcatcttactgtctcaagaggcaagtggaactctcaaaatgaaattaattttaattaactttaaaatataagtgttaatgtgtcatacagcacttggaaagagaaggttatacaaaagagagtgacacagcattaaaggagtagggatcaatgcactagccaaaaagaagacaaatgactttgaaacattgcctgaggttaagcacttcacttccaaatacagtttcccacgaagaacacactcaggagaaaagggagagagacagtgtaatttgaatgatgttacacctactgtctaaattttatttagattaggatagttaaagactatatttgcctgaggacagagaataggctacatgagaagagacatttattgggtatccagtaaggttccacagtgctgaattttcttacaattctgatattagattaggacttattttcatagttgactgataagaagatatcactcctttcatgctcttcttattctagacaggtcgaaacagttatagggcagcacatataaaagtatgttaatctgcttaagcttgtaattctgacataggatcaacgtccattttttaaaaatttgttttaaacacatttatcataggcttgctgctgttctgaatattttttcttatatacaaatgactgaccacagaaaaaaatagcaaagaaaaaaacacattatctaccacacctccactctttggtttgtattcttcaagattttgtctctttcttaattagaaaaatgaggattttactacaaacctcaaaaatcagatcattctattcaacaaatacacaaacacagtcttagcaaaaatcaatctaaggtcatgcaccattgttaataatagatatataaaaaactttagaatgacccatattttgtattttcataaagccagaaaccacatattttctttctttatacttgccataatggcatcataggtgctcaatgattttggatttaaagaaggttaggaagagcatagtcattccaagctaattactaaaaccccacagaaatgttacatggtgaaggctaccccttcatgtttgtggtaggtagactctaagatgacctccaatgatccccacttcttgatattgacccctggtgtaatctccccttgagtgtgagctggcctagtgccttgcttctagccaagagaatgtggcaaggtgatgggatgtcacttccttgaataggtatcttctgtcttgctatcagattctctctattgcctttctggtaagcaagttttttgttttgttttgttttgttttttttttttttgagacacagtctcactctgttgccaaggccggagtgcaattctcctgcctcagcctcctgagtagctgggattacaggtgtgcaccaccacacccagctaatttttgtatttttagtagagacggggtttcgccatgttggtcaggctggtctcgaactcctgacctcaggtgatctgcctgccttggcctcccaaagtgttgggattacaggcgtgagccaccgcgcccagccccagtacgcaagtttttatgaagcaaactgccacactagagagtcacacatggcaaggaattgagtgtattctctcacctaggaatggaggctgctaggaaccgagaccctcagtctaacgctgcccccacaaggaaatgaaatctgccaacaaaaacaggaattagaaagagatccttttatggatgaataatattccattgcatggatataccacactgtttatctgttcacctgctgatcagcatgtgcgttgcttccatcttttggttattgcgaatagagtggccatgaatattggtgcacaagtttttgtttgaacatctgttttcaattattttgtatgtattatctacaagtggaactgctgggtcaaatgttaattctatgtttaacttactgataaaacgtgtgctgtttaagtccccaaatttgtagtgaattgttacacagcaatagataattaatgcaaagtttaaaataaatttgcagctaggtagaaattcccaaatgtggattaatgaactacagggagaaaaaaataataatttaccattggtctgactggcgactcatgattcccccagtcaatagtatttactgcattctcaaaatacttcttaaaaagcaacattaaaaaaattgctatgagggtttgccgggtgccatgtgttgcgctgtgctgtactgcagagattttttttaaaaaagaaaaaggcacagtttccaccctcagagtgcacagatctccaattaagaattacctctgctgatattctccaaaattctgttcatcagcttatttcttctcttgttgtacatcctctttgggaaagtctttactcacattgtttcatctacctctaatatcacgaaaacactcagttcaaatgctctcatctaattttctcctgagcaccaatactcttacttcttctatcatatgttcccttctagatgttccccaggaattttaaactcaatttgtccccaaataaactaattcttgctatgcactcttttccagcccaacctcttgaattccctgtcagacttagcagccaagattgaaactatgaatcttaagtcattctttaccccttatcctttattcctaattctcaatcaactgcccaacttacctctcctctataacccagtgtaattgccaagctctttgaaacttttaaaacttctctgctatgatttgaatgtgtcccccaaaaagcatgtattgggaacttggtcctcaatccaacagtgttggggggtagggcctaatagaagttgcttaggtcatgagggattcaccagcacaaatggattaatgctgattataaaaaggcttcaggctgtcagttcaatctcttactcttctgccttctgccacaggataacacggcaagaaggcctttgccaagtgccaatgccatgccttcgaacttcccagcctccagatcttgagctaataaacttctttttttaaatttttgtatttttttaatttatttttattttattttattattattatactttaagttttagggtacatgtgcacaatgtgcaggttagttacatatgtatacatgtgccatgctggtgtgctacacccattaactcatcatttagcattaggtatatctcctaaagctatccctccccacttcccccaccccacaacagtccccagagtgtgatgttccccttcctgtgtccatgtgttctcattgttcaattcccacctatgagtgagaatatgcgggtttttgttcttgcgatagtttactgagaatgatgatttccaatttcatctatgtccctacaaaggacatgaactcatcattttttatggctgcatagtataccatggtgtatatgtgccacattttcttaatccagtctatcattgttggatatttggtttggttccaagtctttgctattcccaaaatctccttaagctgataagcaacttcagcaaagtctcaggatacaaaaccaatacgcaaaaatcacaagcattcttatacaccaataacagacaaacagagagccaaatcatcagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagagttggaaaaaactactttaaagttcatatggaaccaaaaaagagcccgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagcaagctgaaactggatcccttccttacaccttatacaaaaattaattcaagatggagctaataaacttctgttcgttataaattattcagtctcaggtattttgttacaacagcacaaatggactaagatgttcctctggctgtttttcctctgctacacttatggcttacctagaaaattcttatgcagatttcaagcctgaacccaaacattatgaccttgtgaagccttccttaattttattttttataagactactttctctatccattgtgatcctgcagcaaactgattatctcttcaatttcaaaagctagacacacaacaaagcatcagtttttacatgcctagttctttatgactgttgtgggctgacagatttctgcacttatgttctgagaccaatttttctggatattttaggtagctaatataggaatcaacatataatcttcactcaattcatgtgtgctgaatttaaaatagccatctgatttatattatgattcacttaatcaactaacaagtatgtattgagtagcttctatgtatcagacgtaacactaggcataaggaatatggtggcaaaccaaatagacatgacccctgcctgactcatgagctcacagtctcacaggtcactgagttgataatacatttatgacactatgtcatttaggcttcaacctatctctgagcaacacaagtatttcctatatttattattttgattctttttttttttttttttgagatggagtctcgctctgtcgcccagactgtagtgcaatggcgcaatctcagcgcactacaacctccacctcccaggttcaagtgattctcctgcctcagcctcccgagtagctgggactacagatgagtgccaccacgcccggctaattttttgtatttttagtagagatggggttttaccatgttagccaggacggtctcgatttcccaacctcatgatccgcccacctcagcctctcaaagtgctggattacaggcatgggccacggcgcctggccttactattttgattcttaaataaaaactggaaaattaaatttcttttcagtgagttataagtaaattttattaccatcattagcactgcattaaaaacaacaaaaaaaccaatcccttcctgatacctttcaacatatatgactgtttgtatactatctaaatcgaaacatctaatatctaaatctgaacattgataggatgcctcaactatccagaagacagctaaaaattaagaaccatgggacagccaacagaaatgtctccaaattaataacctaaagctcccatgcttaacattctaaaaagtccctcaggtccacacagaaacctggcatagaaaaaaaagtgatcacaatttcttggctccctattcagagcatattagaagtagtaaatcattatgtgggtgatggaagagagagagaatctgccagaaacaggcacagagacagtagcaagaagagatagctacaacagagactaaatcaagaaattaaaaaattaaacgagaagagataataactatgaaagaaaataaggcacagaacagaaattaaaagcgtagcagttcagatttaatgtagcatgcaatagccacccactttcccaatagtactgtagggtttctgatgtccatcaaataaatgatgaattatattcctggcattttcatttattatcatttgaacatataaatgtaacaaggaaagtctgatgaacgccattaccaacaatcctgtctaatccagcctcacctcacttcctcctttctattattttaaagcaaaccgttaatattacatactttcatctgtaaatattttggtatatatctaaaagatgagaattctttttaaaacatagccaaagtaccatcaatatatgtaaaagaaattaaaatcaattgtaaagtttatagcccattttcagcattaaaatgtcttaaaatattggctggatgtggtggctcatgcctataatcccagcacttggggaggccaaggtgggaagattgcttgagcccaggagtccaagaccagcctgggcaacagagggagacctcgtctctacaaaaagtaaaaaatcagccagatatggtggcacatgcctgtagtcccagataattgggaggctgaagcaaaagaattgcttgagcctgggagatggaggatgcagcgagccatgactgcaccactgtactctagcctgtctcaaaacaaaacaaacaaacaaacaagcaaaaccataaaatgtttaaaaatattaaatcaaaatatatttttacattcttaattttattggttaactgtcaagagagatttaaaaaaagtgttctgggaagcactctctttcctaatgcaacacccagtgacgatgtggcatcattaaattatgatattttgctattgaaacttaattctttaatcaaggaaaatccttttacagaaaatcattaattttgtttagtctacaatagctctttcagatttaaaagttaacaatgtaatttattattatttgagggccacagactaattccctgaaagtgttatcagaaatgatatattattaacttattaggagatcataggctatcgtgagaaaacttcatgtcaaaattagttgtattagtactgagatgtaattattcttcaaaagtatcataaaatcaaaaacaagtagggaaaaacaaatacaatgatacatacctgggaaatatagaattgatttttggtagccaaaacttaggtagaaaattaaagaaccagggacacaggtacataatcatctcttctttcaattaaaagccatggtttgaaggaaacttaaatgaatggcactctaggtagttgatttggaaactaggaacctatttggcacatctaaggaaggatgcgtatgtatgtgtggaggggagaaaatgggcagaacacaaaacagctttaaattgaatttgagagaaatgtctagatgaaatctgaaactacaaatcttatcttcttcctaacttagatgtgccttggaaggattacagaagtgctgagatccctgtagcccttggggtgtccagtgggacctggggcatgctctccccatctcttgtcatcacctctagcagtaagcagtttctgtttatcctaatataccattaaaatattatcattttcaatgtttgataatgtgaaaaaccttgcaaagcattagtccaaagagcttattagcctgtcattcaaggctcttgatgatttgacccaaatgacctttctaaccttgaatcttttcacaccatttatgaaacgtttacactggtcaaaatgaactgctcgtgttttccccttacacccttcatgcttctcaactgctgttgcctctggtttgaatttctcctcctcctggggatctactttttccctatctttatattttcaagtataatcgattcctaagcctgcattaaatgccatctgtaccacaaaacccttccttttactgtatttgtatataatcttttttcccccactaaggagccagagtagtcagttatctacagtttttaatgtcatgcgtaactttctattttgtaccattgttacttatgtaaaatgtttttagtttaccaactagagtcaaagttctttgattgcttaattcaagtaaatttactccagcactttctgagaaacttttatgtgccaagtactatactaggtgcagaggataccacattagtgtggctacactatcaccagaattactgagtattgtttttaaaattctagcccagctactcgggaggctgaggcaggagaatggcgtgaacccaggaggcggagcttgcagtgagccgagatcgcgccactgcactccagcctgggccacagagcaagactccgtctcaaaaaaaaaaaaaaattctagccaatatgataaggcagaaattagtaagaggtactgcaactggcagggggaaaaagtatgattatttatagatacaaacccaaaataattaatgagaaaacttagaactaataataacatggttccataaggtgataagaaacaaaatttaaatgttttcaaatactttgataatacattaaaaaacatttaaaaatccagcaattttaacaaatattttaatatgccaatatgtacatggaaaaatatcccaatatgtatatggatgaacacacaaacacatacgcatgcaggcacagaaacaaaatatgtcttatactaccatatagtataagaaatattttaattctctccaaatttaatgaatatgtttattaaatatatttatgcatttaatataataaacattttaatctttccaaatttactattgagtttaagacactaccagtcaaaatctcaaggaaatctttaacccaaaatttcacctggaaatcattaacccaaaatctttcatgcaaaatttcactaaaaacagtcatatttttaagagcaaaataatcaatagacacaaattacaaaggagatacaaacataaagaattttaatttgttatttaaaaaatataaactaaaattatatggtacttttttttcttaagtgaaagtaagtttattaagaaagtagagggataaaagaatggctactccatagataggggctgctggttgccatttttatggttatttcttaatgatatgctaaacaaggggtggattattcatgcctcccctttttagaccatatagggtaacttcctgatgttgccatggcatttgtaaactgtcatggtgctggtgggagtgtagcagtgagaacgaccagaggtcactctcattgccatctttgttttgctgggttttagccggcttctttactgcaacctgttttattaccaaggtctttatgacctgtatcttgtggtatggtaccatttttcacttatccaactgcctaaaaaaatctaaacgataatctgcaacaatatgaaagatccaataacaaagacaatagaatgtatttctaataggaatgtaaatctatgtaaattttctaataagcggttttgtattatgtatcaagagccttacgatgttttaatcctgaattttctgtttttaatatctaatctaaggaaatatttagaaactcaattcaaacataaacttttaaaagaaaatcagataaatactaagtgccagatctataccaaattacacaggacaacacaggcatatagaagatctgggaagtgcctaccaaggacatagatactgaaggttaaattattttatcattaatcatcagaaattgtctaaaccatattaaagagtcgaagttccacacaagtcggattcagttaggaatactgacagaggtactgataaaaatgagttgataaggaggagggtagatcagcaatcaaaccccgaggagagagaaagtggcaagtgctggcagtaccccacacaagtattatccatggccaaatacgtgatttgtccagtcttggtagcaggcatatcgctattaacagacacactatcagagccagatgccattagacatgtggccgctataaggtcctcagttctgacaaatgtatacctgattcagctgacagtttcatagcaaagaaggataagaaaacaatgacaaatctaagtctccaaacttaattgtgaccatcaaagaagaaatggttactatgttattctagagactacactaccaaaaatgatcatttaccctagactgtagaaaggatttcaacctaacaattggaagaagatgagaaggcggagaccatgaatggtcatccaaaacaggaagacagttaaaggaggataaagctatcagaaagggaaagattagaggctaaaatgaagttatactcgcaaaaatgttaagatcagataagaaaaaaaactagagagggcataaaaagagtaactttgaaaacagttaagaggaaagtaaatttgcagataggagagagtatatcaaacttctttaagttaactcaagtctccagatccagacagattacatacaagatagcagaaaaactcagatgtaactgcaaaactgctctgagcaatgttatgtaaccctggagaatgggaaggttaccagatgattggtgataggcaaatattgccccagatttaaaaactgggatcattgtgaaccaccatgggttcactaagaataaatgtttctaaataattctcagctccttttggactgacttgctaggttggtacatttggggaataccatagtatgggatcatttcaggaaagtatttgacaagtctcttacagtatccttgggaaagaaagaaagaaatcagacggcagtagttcggtagctttgtagctgatttaactgacttacccccaaattcgtggatttgtgccaacatgaaaggggctaggtcttctatgatttgcaaccaatcttggttttcacagcacttcacacgtaactctactatagcaattatcacactccattacagttttataattacatgtctattattccctatagcctgtgagctccctgaaggaatgattagctttttttttttttttttttttttttttttttttctgagacagagtcttgctctctcgccaggctggagtgcagtggcacaatctcggctcactgcaacctctgcctcccgggttcaagcgattctcctgcctcagcctccagagtagctgggactacaggcacgcaccaccacacccagctaatttttgtgtttttagtagagatgaggtttcaccatgttggacaggatggtctcaatctcttgacatggtgatctgcccacctcggcctcccaaagtgctgggattacaggcgtgagccactgcgcccagctggaatgattacattttatccatcttgttatttctagcagggagcctgagattagcacagagtagacagtctgatacatgtttacatattttaattgaattaaaaagttgaagaaattattttaatatttacagatgtctcaaagctgaaaggaattgctaatatgttggatgataaaagaaaaaaagccaaaaagttcttgacaagctggaacaatgagccagcacttacacaatgaaatttaatagagatataagtaatgtctggtacttggaataaaaaaaaaatcagctgaagaacacaatgggaaagacatgactaaaaacagctggatgttttgacagcttatccaacatgggccagtagggtgctatgattcgtgttgttggcatgaaaagaaaaagcaaacctaaaaagagatgaatatcactggtcagaccacatctatagcatcatgcttctaggcacatattttacaagggaccccacaatttaatacttctccaggagacaaggaggatcgtgatagacctggagaccacatcataggaaaaatagttgaagaaatggaagataattagattgaaaagtgatccttcagaatacatgacacctaaattcatgtttcccaattactatctaggggagctgtactatttgttagtgtggctccacaaggcagagctaagattattttaacaaagaaacagagagttgcattttagtaaattataatgaatgataataatgaaaactcttcaaacatggcatatatacatactttctgagactgacttcctcaccatgcaagtactcagtttgggactgttcagttcagtcacatgccagagatttgaaaacagcaaattcctatttggtgtaacaggtttgagcaagaaatgtctgatttaacaaatatggtttcatattcttttatgagataaaaactgctggaaggtagaatgctattataagactcatttctgaaggagactgcatacccaactttcctgacactgcttctgagaaggacaggttagaccactgcccactgcagcaaatgcacccatagcccactctgagttccagagtgatggtagaaaatctggaaaacactgccttgtctcatgtggggcagagtttcaagacagcagaaggcaagggagatcagaaacatcaccttgttattcaggtaaactgtaaaagtatataaaaatatataagccatcaagaacaatgaatttataagctttattcccactctctttgtatactgactcccagattcattgactcatttagtacaattttatcagcaaaaaaaattttaaaaatgactacttaactaatggataatgtatatttaatatgcgattttctaatcatccttcaaataccttcaatagccagctacatcatgagagatatatctgcatgtttaagattaattcaaattataaggagaattcaaaagtgaattaaaatgtgacttacagccagtaaaatacaagcaagtcaatttttcaatgcatcttgactaaatgtaaaatatcatctgtttttgtgacaaacaagtctgtatcattaatcatatgcttccagctgcaacagctcgcattcaaattaaaaccatgaaatagcatcacagtgtcaagattcacgcaaactgatcttttaacagattgtgagggaaaaaaaaacatacattaaaagaagaatctggagaaaatgttacacaataaaaacatctgaaagagcttaagcacacaagatagaattctggtttttgaactgtattggaattaaatgttaaacaaaactcacagcctgctcttaaacaacgaacacatcataaaaaataattctttttatagccacagggctgagagttttgctgtttatatctatcccagcatacaaatccatagtactgccaggactgtcccctctgactttactgggaagctagacaggacagtctgcctgggttttttttttttttttagtttagttcagtttgtgtccaaaactggcccaagaatcatctcttcttcagtcactacactcttgcctgccagttgcacagctccaaacattctccttccagctacagatattaaaatgttttgttgttttaaaatttgatttagaactgcagtagataaccttttttttttttttgcttcaggctcccctaggtcagcaaggcatagtaatgttcaaacagtgcaacagcagccactcattgcacattaaaaacaaggatggtgccaggaaccagcaaagtgatatattctaggttagccatgtcaggcattttccagtcccaaagcaggtttcatatggtcagcacatgggccaaatgatgcacatggccgtcctgcacttgccccttgtgtcctcctctggtgacctgccccattgaactccctggacgagattcccagcgatgctatgcaaagaggacatgttcctctgagagtattttctgcattagggctcacattgtattgccatgggactttacacttttagggtataacctgacatgccacaaccttttcttccactcctcagttgacacctctttaaactggtggcccagccctagcctagtacacataaaaacgataatagccactctgccaatcaaggttaatatttcagcttctctaataaacctggggtagacaccatgatacaatatataaaaacaagaaaagtaaaaattcagaactttatctcaaaattgtgcaggctcttacctactagatttccttatcttgtaaccatcatttctttgttcttttgttccttgttcacagagatattgttccagatgataaatggaggagtatgtaagattttaatttcatcacagcctataaagaatattcccaatgaaatttaatgtgaattttaaattgtatattatagttgggcatggtggatttcagaagctttgaatcccgtaacatggattttaagagagaaagctttttttttttttaaaggaaagtaggatgaggaaataatatgaggagaacatgcagtgactaatcacttacaaaagagaattttagagtcaaagtatgccttagaaatggtctggaaaatacgcagccaaatcaaataacttaatatgtattgagacttcaatgtttacagaaaatttgaaaccttttataaaaccactaattcttttgtaatgctacaaattacttaataagagttactaatgtataaatctctattattatatttaggattttcttccagaagagtaccaccacacatcttaaaataggaggatctcgatccaggtacagtggctcatgcctgtcccaacatttcgggaggccaaggtgggagaatcacttgaggccaggagttcgaggccagcctaggcaacatagtgagaccccatctctaaaaaaataaaaataaaaattaccaatggaacaggatagagaatgcagaaataaagctaaacgcaaccaactgacctttggcaaagcacacaaaaatataaattgagaaaaggacatcttatttaataaacggtgctggaaaacaagatgaccagatgtagaagaacaaaactggatccctacctctccacttacacaaaaatcaacccaagatggatccagacataaatctaagaccagaatctgtaagaattctagaagaaaacctaggaaaaacacttctggacattggtctaggcaaaggatttatgactaagaccccaaaagcaaatgcaacaaaaacaaaaataaataaataaatgggacctaattaaactaaaaagcttctgcacagccgaagaaataatcatcagagtaaacagcccacagaatgggagaaaaaatctgcaaactatgcatccaacaaaggactaatatccagaatctacaaggaactcaaacaaatcagcaagaaaaaaacaatcctatcaaaaaataggcaaatgacatgaatagatattcctcaaaagaagatatacaaatggtcaacaaacatgtgaaaaaatgcccaatatcagtaatcatcagggaaatgcaaattaaactcataagatatcaccttaccccagcaagaatggccattattaaaaagtcaagaaaaatagatgttggtgtagatatggtgaaaaaggaatgcttatacaccgctggtgggaatgtaaattagtacaacctctatggaaaacagtatggtgatttctcaaagaactaaaggtatatctaccattcgatccagcagtcccactactaggtatctacctaaaagaaaagaagtcattgtatcaggaagacacctgtacacacatgtttatcacagcacaatccacaactgcaaagatatggaaccaacataagtgcccatcaatcaatgagtagataaagaaaatgtggtacatacatacatggaataccactcagccattaaaaaagaacagaataatgacttttgcagcaacttgcgtgaagctagaggtcattattctaagtgaagtaactcagaaaagacaaaccaaatactatatgttcttagttataagtgggaactaagctatgggtacgcaaaggcatacagagtggtacaatgaactttggagacttagaagtgggagcctgggaggtgggtaagggataaaaaacaacatattggttacaatgtacactacttgggtaatgggtgtactaaaatctcagacttcactagtaaacaattcatccatgtaaccaaaaaccacttgtacctcaaaagctactgaaataataaaaattaaaaattagctgagcatggtgatatccacttgtagtgtcagctacttggaaggctgaggtgggaggatcacttgagcccaggaggtggaggctgcagtgagctgagatcgtcccactgcactccagcctgggcaacagaatgagaccctgtctcaaaaaaaaggaataaaaaatgacttttaaaagtattttaagtatgttcagagatacacctaaagactttaagcatcttttctacatttctaaattgaaagcatactcattttggatcttaaccaatcaccatttaaacaagttttcatctgctccagtagagataatttcgccctacaacttgataaatgtttgcaaaatagacaactatatatgagtaacagcaaagaaagcccaaatttaaaatctatcaatgtatctatctgactactatccatcttaaagtccacagtagtctgacaactaagcgtccaagaagtctcctctgtgtttttaacttcctggattatagtaggtctctcttaacttactggaacaaaaagggtgattaattgatatctaaatacatttagaagattttgaaagaaaaaaaaaaaaaaacaaggcagcatgtgctctgtccctagttcctgaagtatgaattgtttattataatatggtaatcccactaccagctctggttgtaccaccaactatgattttgaaataaagggtttaaatatatatatatgcgtgtgtggatagacagatagatagatagatagatagatagatagatagatagatagatagatagagatagagatagagatatgcttacacagcccacatttaaaatctaccattatcttaaagaaaaagaacatgatagtggtggctcccactccatggagatcactgatggcaaagtacagagtgggaaaacatatttatgttttacccgcttggcatattataaatagaacaatctcaaccaggcattttgccaagatgtggaaaaatgaaatgaggcaaaatgcaaatggaaaataaaattactttttatgccaaaataaggtctggatggaaaactttaaccaaagatatggtctggatatggtaagacttatagaagatcagctgaagatgatttgaaactgcaaagattcttgaacaacaaaaaatggtatttcattacccatacacaaaacacaaactgtctagataggaattatgctaatatattttggaagcagatgctttctaatatattttttcaccttaatgtcattaccgttttttccccaacctgctcctttctataagatctgcactttgccaaatgcagaatcaccaacacgaataattattataaatataaccaaaatggttgggaagaaaatgttatatcactatggttttgagtatcactacggcatgaaccacaactgggttatactgagaaatctctcactctttatataatgaatctgtcatttttttttattaactgagtgctgctgtacacagacagatcaatctgtcttctcttattagcactgagattttaaaagtctacacattaagttaattgatttgataatttctttatcttagagtttgaagtgcttacacatttaatcttaacaattcagctatatacgattacctagaaactgacggttttctttccgagtcctttcccagtcactttcatcttttttcaagctttttttaccttaatctgtctagaataaattttcattggaaagcaatccaagaaaagggccaaagtctccacaaaacacaatttcaacgatttttaactggagataattaagagtatcttttaattttgcaagttatagaaatatttttaatagttttagtgtggtataactgacacacaataaactgcatatatttaacatgtacaatttgacaagttttgacatgtatacatggtgaaaccatcaccacaatcaagataataagtatatccagcacctcaaaagttttctcatgacccttttaatctctctctttcacttattgccatattttccttctcccactcccaggcaatcactggtctttctgtcactaaatatgagtttgcattttctaaaattttatataaatagaatacaaatttatctcagtaggagaacactattttattttgcttggcttctttcactcagcataattattttgagattcatccatgttgttgcatgtatcaatagttcattcactttgattactaaatagtattctattatacagatgtactacagtttgtttatccattcaccaattgatgacatttgagttgtttccagtattgtgttattacaaataaactgtgtacaagattttgcatcgatgtaagttttcacttctcctaagagtggaatggctggattatcaaattggtgtacatttacctttttcagagactgttaatctgttttcaaaagcagttgtgccattttacactttcaccagctctatagctacagtaagtggaggagttaaggtcttcaaaccctaactgattccagatcctatcttctgtaggctccatttttttctaaattagacatcagctttggccagaatttggatgacaggagatggaaatttaaagagtggcatgggggaatttggattataggagataggaatttagggagcaacatgggggagtttgtctaatgacaaaaataaaggatgctcacagcctggggaactaagtaattcctatctcattggtaccaggagctaacctagacgacagagacaaagtaaagatcagtcagaaagaacaactcagaacagaggaccaaactgagccacgagggttgatcagtgacagcccatgctctcctggactcaccttgctggcccattcatgcctgtggcctccctctccaatgacctcccatcacccctcataaggacaagatgctgtttactttccatccgaaatgactgtggttccgggagttgttaggaggccaacgtgttccatgctcttatgttaatagtgtggggataaaaactaaacaaaggaagcaagcatctgacaataaatgagtctactggaagtgaaaaaaaaatccaatttaccaattttccttttatggatcatgctttggtgtctaagaaatctttgcctaacccaaagtcacaaagattgtcttatatgttttctactagaagttttattgttttaggttttaaatttagaccttggatccattttgattcatgacacaagactggagtacttttaaattttgttggctgtgccattatttttgtctatttgctattaatttctaattttactggatattaaccagaaaacacataaaatatggtcacatgtgtaaacattatatggataattcaaagaacatatattttctatttgattataaaaatatacaattatcaattagatcaagtctgttaattggctatttaaatcctttatatatttttatttatttgatctgttatctgctcaaataaggagagctaaatttccctactaattgtggatcgatctgttgactttacatttctcttagttttagctttatatagttcaggattatgtagttaaatatttaaaggttcatgattacttagttatcttagtatatcaatatgaaatctttttctttagtctatttaatgatctttgcttgaattctatttcatctcatattactttaagtactttcttttttatggccttttttaagggtatcatttcctatatatatttttaccttaacctatctttttttgtagaagtgtcttttgtcaccatatatagctgaatatgtaatatttttatgctatccgtattagaaaagggaatttaatctacttacatttattgtggttattgatacagatatacgtgttttctatttatcacaacttttttgattgttttatttctttctttcttgaactttgctaaatgtatcaaatattctttgctttttgtccttacagtacatttcctttcttaaaaaatctttatgctttaaaaaaaaagttatggaaaaaaattcatgcactacagataaagcaaaatttgtatttgatcccggtgaactcttactccgttccctaagataatttattatatgagctgaataggtaaactttcaaaactttcttaaaaattcatttatgaatatatcatcctatttttattatcatgtttattcttaattgcctttaagacacataaacttcaatttttttcttctttaaatcataatctataccctaaataaaaaaagaacataatatacttttatgcttgtttctctttacctgaccctgccatcttccatgttaaaatcagaaataaagctattttatgtgtgcatgcatgtgtgtgtgtatgtgtgaaagagagagaaatcgtaattaatagtttatttttgtttataatatttctaagtatggttattttcttattaattatatttggaattgagagggctcattacatctaaatatttttttttcatattttatgctttttctcctactatttctttgataattttgtcctttccagtttctcttttctctaagagaattacagggatgctagaacttctgtaactattctctatgtctctcaaatttttccccacatttctgaagtattctttttgtatgtcattctgaaaaagattccctagttcaatctttcatttccctaatttatatgtgagttgtattaatgaccattttcattttaaattttaaagtcaaactttaaattcttaatttctgtgcttgagtctttttcatgaatacatctctctgaatgtcttcttctgatcactctattacctctaggtccttgaatattttttcttctcatttttcatttggcatctttctttcatggtactgatttacttcatattgcggtgtgtcataattatatgctcatcttttgtttgagaatctctgtgtgccagctcttttgtttaccattgtctgtttccagtgattaatagggacagacaagtggcttgtctcctgtgtgggtgggctttctaacccacctggcagtcagcacattactgaggcactgccctacctctctgggtctagcacccacactcaaggatttagtttgtgggtaaacacagctgctatccactacttaacacaaggagaaaagaaaaataaaggcacagctccaaatgtggagctccaattaataactctgatgagccctttgattaataatcctgacgaattcctcttttatttcgtgtttccattgtctgtacctttagctttgtcttgctttcttttctttgttgaggatttaaatctatttttgttatagatttaatttattgtttcttttcttaccatttttttcataaaatagaattttggctatggaagaaaaatataaagacatatataacaaaagacatttaaaaaaacaacttccaattttcaatcatgtacgttgcttaaatttaagggcttcacacacttgtaccaacagtgataattaactttacataaattcttcgcattattgctgctcacaatgatgccataaataccagggaatttcaagattaaaataatcaagcatcttcagtagaatctttcaacaatactttggaccgcaagaaattaaatgcaacaaatttttgattcctcaaaagaacactactcagatctattttaatcagctttgaacgtgtcagagaatcaatctagtctgttaagtgataaatagctataagcatattacctcttcaacagttgtcgagttgccattccatttatgggaatctagttttatgtttttctgagaacttccataatcattatggccaacatcactctcccaccgaagtatacaaagaaacagtctcagaggatggtgtgtgtgtgtgtgtgcgtgcgtgtgtgtgtgtgttcacccacacctgggcatggcagggattgcatcctcagggcctggcatggagttggtattcattaaatattcactgaagtgaattaaataacaataacaaaacaaccttttgcttgtgaagtgtctagcattactcttgcatcttgggtcataatttggcaaatttccctccagcttgaaactgctgagatattttatactatagtacagtgaacccttaagattatggtttgtttttcaatgattcataaatctccaatcttgtttcatctgtaaactaaacttagtgtatctccatgacttttgtctcatctgtcccttttcgtagactcttttcctctgtgaagtctcctttctccttcctatatgatcctaactgcatcttatactcagtcttgttacaggacttaccacaccagactgtaatgcttctcaaggaaaacatcagagtgataggaactttgtcaagttagtattagttattttttattttatgtatataccctgcctcacaccatacacacaaagagctttgagacttatccaaatgtttactgtacaaaaaaaaaacaaaaaacaataattgaagaacccaggatgaaagaaaaatagagtgaacaatgctacataatcctgtacagaggttagaggtaggatctacgatttgtaggggccaaagcaagatagatactatgactttcaagataaaaataaactagttacgttatacttaaacaagagaattgttatcagcatcttcgactgctggaaaaaaaaataagtagccttggaaaagttaagtgcgccctgcccaatatcccatggcttgttttgttagaggaaaatactggtctcttgacttccagtgctgttgctgcactaccacactgaaactaaatacacagtgaaaattagttgctattatggcaatccctgggagaaacaaatacttattcccttgtgagggataggaagttaaactaagaacccaacacaaatgttctgtgaggcagtttagtagagctggaagatacgaaatgacctgatggcccctgaagaggaaacagtggtgcagcagcaaccttcagaggcacatgagatcctcattgccaggggggtcaaaaggccagaaaaatcatttctagaacattctacatgtatatacagtcttagaaaaagtggacccttaagtgctatactagactatgactgggaagataaattttttaaaatttcctaaggcacttctccagaagaaaacaaaaattaaggtcaggtctacctcagccagtaacagacttctgggcccctagattcatttatttggctctgctgactgtttggctcagttttcccttagcaagtgtaaaaaacacttaaacaccaccaccctgggatcctattcaaccaattcagatagctgtggccttttaactcacatccaagtgacttggctttataccaatatcatttcccctagtataggctaagcctaagtgagaaagtacacagctcagggagccaggagttaactggctgttctcattccaaaaaggcctggttcttttccttgataaggaaacaatattatatcaagaagttgcggtcattcagtattacatatcacactagatccatgactataaaaagagaattagtggaaataccaccatctattcttaaagcatctctccaaggagctttagataattgaaaatgttctcttccagcccaatcccttgggaaataaatagaggtgatttattaaaacttacattttacgtataagaaaataacaacaagaaaatcaattgcagagagtggcagaggatcttgagggtatcctctacttgctgaaccacacttcttccttagaattatataataaatacagaatatgtacatttacttgtgtatagctgcctgtgatttacctatagtaaggtcaaaagcattctatggacatggtcttccttgagcccttcttctgtgctgtcattttcctttgccagggaaatggtttctcaccatccctcccatggacacctatgtctggaaatgtctaaaacacttttcgaatagcaagttgctttctcctataccagcaagaaatttttgcaactccacctgtccctcaaagcaatgtggccacaataacctctgcaagtctgtctgcctatgctgtttctttttctaatacccaactaatttattgatttatattgtctttacgtctcctctggctttgcagtgtggcatgagtctcagagccagtgattacattacattcataagtatttggctggagttttaaaaaatgagagatggtagtggggatctggagggggatgatgcataatatacatggaactgtgaaaatgcgtaagataaaaattaaagaagtcttctttcctctaaagtaagatttaataaaatgagactctgacgaaagaaagctttattttggtgaaagacatcaaatggcatgtgtacaaaagacagaaactaaaagaaataggcagcagtgccccctgggttgcctgtcaagaagtgtgtcctgtacagtttctggagaaattaagaaatgcaaataacctgggcagattaacagcacccgaagataactagcaggatacaaacaaacagcacctttcactatgaggaggcgtattcctccaggcaaacaaagaaacaggacagagtcaacatctgtttcatataacagcttggctgctgacagaagaaaccttaaaaaaatggcttagctgacaatccacaaaaatcattcaatcactattgcatgggccgaagcaaacgagtaaatgaacacaacctgcactttctatattaccctaaaaaagttgtcttttctttataggaagaaaaaaattaaaatgaaaatgcaaacaaaaatcttcatgaactttccccttttgattgacaacaggcagcaatgaatactgaatcataaaagacagccagctgcttttcagctggtctttgcctttctcaatgtcaattgcgaagacaccactttcaaagagaacattgggtaaggatggtggctgggatggggcatggggagacaattcagatgtaacacattagaatattaagaggaagaaaacaagtcatttgacacacccagtcctggttacagaattcagttagggagtattatgatgtctgggtccttatcaataaataataacacaccaaacatgttaagaactaaaaatttccatctctggattctatcaattcacacatacaatttcaaaatcaagaggaaaacattcatgactgcatagaaacctgtttgtaaatttaagtactggacatttctaaaatgcaacattatcagagctgtgacatcactgcagtgtggacaactgctttcaactcagctaaatgccgtgacatcactgcagtgtggacaactgctttcaactcagctaaatgccagatgcttcacttactttcataatgcggttaaagtacataaggcaaatgcaaaatgaaagcaattaagaggcaatgatagaagagatttttcaggtgaaatgtgaaaacagaaggaaaggtgatgaggtggagcaggacaagatcatttgatattaacgcacgcacagtgccaaaactatgctaggtagctaaacagagactccagtgagggccttttcgagttgcttctcagtttaaacaggtgtaatatcttgtttaagtggaagagaggtatgaccacaaagagaaaaaaaaaatcaatacatgatttgcattatttctgaccttggaaaaaaggctttattgaaaggtgtcctttattgcacagaattgagaggcggcaaagtgagagtatgatcattataaaagcaaatcttccataatgtgagctataggccaagcaaattctcagtggttgacctgcatttactaatttagccctcacaaggattatatgacataggaactattattatctcactttacagataagggaacagagatacaagaaggtggtagacttgcctagaatcatacagaatttctgagctttgaaacaagtcactagaaggaaggaaaattctttaaagagtaatccatcagtccattcagcatccttgttaggtatcttgtacaatatccagaaaaataaaataatctagagcaagacaagcacagtaactaattaaaactaaaagagaaggaattgagattagcttcaccaaaaacctcctggataaaagactatataggaaaacaaaaagttcacgaagtaatactataaaatgtcctgcgtaggaatcaggactaatatccaggcttgctaataccttggatggtattagaaaaccccttcaggtgtgaaagggcctaaatggatatctgttctaggcctataagaagtaatagttgactttaagaagtcaagtatggaagagtttcctctggcacctcttacttggtttatgcaggaacagtgcttgttttgacactataaccaccacaactttctagaactgagcctggcatgtaatacatgctcagtaaatatttgctgaatgaatgaattacaaagaataaacgaataaaacagtgaaatgtttgtggaaagttttagatagtttggaaagtagaagtaagactttgattcagaaggtagtcttgaagaaatcaaaggagggaagcaggattacagaaccagaagtcagaaccataactgagcaagagtttgacttgaaagatctctaaataagagagtgtgagagagaaaatgaatgataaaagcaacagaaataattagagattaagtcctataaatgtctttgagcagagagcaaggtattcatgttttgtcaatatggtattttagggatgggcgcagtggcttatgtctgtaatctcagcactttgggaggctgagggcagatcatttgaggtcaggagttcgagaccagcctggccaacatggcgaaaccttgtctctactaaacatacaaaaattagcgacgtgcggtggctcatgcctgtaaacccagctactcgggaggctgaggcaggagaattacttgaacccatgaggcagaggttgcagtgagccgagattgcaccactgcattccatcctgggcaacggagcaagactctgtctcaaaaataaataaataaaaaataaaaaatggtgttttaccaacacactgttaaccaaaaaaaaaaaaaaaccaaaccaacatgtgaagacttcaaatcatgcaaataataatgatacaaacagcagcaaataacaggtgggagcacttctcttgtgccaggccctgggtaaagtgctgtaggtgtagagtgcactggttaggcacaagagctcagactgataccaacctccggctccaaatgaccacagtcaaatcatcatgtctggtgttatcttatctgtgagataataatagcatctactctctaggcatgaagttgcaaagactgagactgtgtaggggagagaaaagggaataagggcaaaacagaagaagaaaatttagagctccaatttcacaaaaagataggcataatcactgcagcctggagggtgtgacaggtagttgagaacaaggcattcttaaaatagcaaaatagaaatggcccaccaaaccactgggctagactatcactgtgtcataatttaccttgtacttctgcacttaatttttttccctttcatttcattattttcaaaattttcactaatttcctatttctcttttcatgaatgtctccatcactgaatgaggagttccctgaagatgagggctgtgcttagatctttcattctctgcccataggaccatgctagacccataattaattgtggtaaaatgatcaagtgaacagtaagaaaacaccacatgaaaagaaattgatgtgaatgagaattttaagaatttttcaggaaaaagatataaaaacactttcacaaaacagaaaattggtaagaggaaataataatttttataagtaatatatattcaacacatatatattcacacacaaacatatgtttgtgtgtgcaaacatatagtttgtcattaagatccccaaaagtgactttcactgagtgtaactccattattcattgtttcctcaccccatatcatttcttctaaatagataatgagcacaggtttatgcgcttccctattttgaagaagtgagaattttaacttaagactgggaaagagtgaagaagagccttggaactatctgaaatgggtagaggaaggacattagcagggagaacaggggccatgctgttctcctgaattaaccccaggataaggagaactacctgggcattcctcactaagaattcatcactgtcctggctcttaatctctatatttaccacctattttcttgaggtcctcccctgaattcagaatttttctctgattgacaatgtgattgaactctgattaacctgtcttctgagcaaccctccactggtgaataaaagcttcatatcttcacacattgatcataaaacatataactctctcctcccagaaattctcagtcaagcaactccctctcagacaacttgatttcagccagtcataattccccctaagtgcacatacaccttattttgggatgatccccttcatatctagcatacacgttaactcctaggaaagctacactttatacaggttagcctagcttttcatgtgttcctggttgagacataacctagtacctagcctcaaaaaatatttgaggaaatgacttagtgaatgagctgtcaagaagtcaactcccttaagtgcttgcccccgagcatgtgacacaggatacacaattggattctactcagaaagtcccctcttccttcagacactgtgtcaactggaaacagagctattaaagttgagaaagtaaaagaatctatgcataggctagaaatttgctcttcaatactaacacatgccaaaaacttatgtatcactagcctggaacgaatgtatctgctctgatccctgaggctctgccttttacctgcatctcttaacctcattacgaaataggtaccaactaaaacataaccaccaaatcctatggtatcctctccattgtaatttccatttcagcaactgtcagggaacagctctttcggcaaaattaaaccgtgcttgagaacagacctattcccaccttatgtacctctagtcccctaacttgatctttcattgtactgaattttgatggcacagagccaaccttacgaattccttggtgttcactttttttaaaactgtccacatacagttactgtttgtttcatccaagtaaacatcatatgtaataaatgtcttattaaccaaccaatagtttcttatacctggaaggtgttcaataaaagctttgtgtccaacctaaaaataaaatacttagtaacagccatatttaaaacccatataactctcaaaccatgcatttacaatgtgttctttgatttttaaatatccataagtaatattattgtcaccaaggaataatcagcagaagccacaaagcaaaaaagcatttttttataaaccatgcatctggaaattttaaataggagaaagattattttgtttcatttgaatgttctgccagctgcttgtatttcttttttgaattaaattaaattaaactaatttctagacgttaatttatcaatagtttctgagcaaccattgtatttaaggttttaagcatatggcatggttaatatgccatacatttatttttcttaaaagtacaattataatttaaaataccctaatagaacacagtcttttaaaaactttgcatagaaaaattattataagaacattcatgttttataatttttggagtcaaaatgacaaaaccaaatgtcttaaagaaaaatcggaatttattgatcatggttgttttatatattaatgctataaagctaaaagtgaatatgaaattgactggcagaagcgaacctgtcctacacatagcgaactgaaaacagacacctgaaaagatcagccagttttttattagataaaaataagaaggtaccaaacgctattaaaatggcgtaaagttggtgttacaatctcatcgagctaaaaataggtcacagttagaatgaccttaagggaaaataaacaaaacaaaacaaaacaaggtaaggccaatatcacaaagtgattaaagagatggaagataactctctcctaagtcattaaactcaccgatatcatactgaactccagagcacttagtattttcatgcgccattagagaatttagtgggttcactgaattgactgatttctttgttaatctatttacatgggttaagaccctgactaacataaaacacaaccaaaaaatgccagacagagagtgtaatgaaagactgagtgatgtatggtttggggtacagcctatccgataaatgtgcttggccagcaaagaacccattggcaaagatttattatcggaacaaatacattctaaaaagatctaatacaataaaacctgcagtataaacacaaactactctaaaatacaaatcttttccccgaatagttgatctttcaatgatattaaaattctcttcatatgttttattcaagaattttttgaacaagtaaaaccaatgagctgtataaattgccaataatagtgtaattctttgattcattcaaaaaacccccaaagtttatgttacttagaactcttcaacaatttttaaaacatacgaagagaaggaaatatttctaggaaatatattatcaagataaaaatgaaccacctactaaaataagttatcattatgtttgaattacatataatacattattaccaaattcataaaagttaagggcagacatagaaatgatttgaaatgttatacctccaagttcttttacattcaagatggcattctggaatggcactgctttaatactaaaacctaaaattagaaaacaaaaacataaaaaaagaattagcaacttttaaattaaaacacttaggatgctcaaattgtctctttttaggctggttaagatttatttactttttgtagctgatatttatactagaaacacataatttccaaggtaaactgataactgaatattatcttctgccattatcaaaacatagttgttgtggctgggcacagtggctcacacctgtaatcccaacactttgggaagccaaggcgggcagatcacgaggtcaagagatcaagaccatcctgggcaacatggtgaaaccccgtttctactaaaaatacaaaaattagctgggtgtggtggcacacgcctgtaatcccagctactcgggaggctgaggcaggagaatcacttgaacctgggaggcagaggttgcagtaagctgagatcgggccactgcactccagcctggtgacacgccgagactccatttcaaaaacaaacaaacaaacaagcaaaaaacatagttgtgtattacggcaatatataacactatcccctttacttcaaaatattgccttattctttaatttaatatgtaatgtcactctgcaacttttatcagatataagaaagacatttgaaagtatagagaaatttcaaagaaaatattaaatctatgaggacctctgcatctaactttaattcttaaagttaatgtcttataattctttctcacatataactcagcaaccctagaaattaaggtacttaaattataaccatttcatattagaattacatagtatttatgttagtgtcttctttaaaggacatggttaatatgtcatgtatctatttttcttaaaagtacaatcataattatccacttatgcataggcaatcattttataatacatgtaatacaagttttatattataagaaaatattcagagtatacagttctatgattaactatatatttatgacttaactattaccattcaagacaataaattcaactgtgacatatgcaagtgtgtatatacccattcacacacacacacacacacacacgcacacacacacatgcaaatatacacacagattctttctgaaaggatccacaagaaaccagagctaatgactctcaggaaaactgggaatctggaaattttaaataggaggaagattcttttgtttcatttgaatgttttgccatgtacttatatttcttttttgaattaaaagccctatgaatttctaggagttaatgtatcaatagtttctgagcaaccattctacttaaggtttttaagcattatttaatatgtataattttaagattaaaaaagtttctttttcaagaatttatcaacaaagaagacaaattatgagtctttgaggtaagttatgaaaaaatatataaagtattacatggataaaaacaattctttcaaatgggtttgttttgctttataaagaaggaaatcattacacaccttcttagtctagcctatcttttgcacttctttgctgcatgttatcccagtactttaataagctgtacattaccttccacctaaagcagtacatagtatataatgtttgaagaactgactttggagtcagacagaactaggttgaaattctagctctgtcccttattagctctgtgaatgtgggcaacctactagccttgctcgactttctcatctgtaaaacagggatgataatatctacttcatagggttgttataaggataagataatgtatgtgttatgtttatcacagtgcctggtacaccataagcatataatatacgattgctggcattatgtttccattgatgctttttcgttgatgattcaatcattaggtatacatattttctgcctgcctgaatataattacaaacttgattctgggtgctcacttattaatctaagtatgtagttggagatgtaaaagttaccattgaatgaaaagtacttttgttggagtgacgaagatgtcaacagctgaagtctgctgcacagaaaggatggaaaatgttcattgggccctctaacaatcttctaaaacataccccttcctttgtgggcttaatgcagattgacacagtcagcacagcattatggttaatggtgcatgaagtcactgaatcctagtaaatgagcaggaggaaagaggaggcagtcccatgtggctgaaacactggcatgtacctgagcctgcaggaaagcctctccaggtgtctggcctctgggaaattaaggaaagtcagtgccaatcataatattcctgctggcacagaaattcacctgcaggagacttggatgcctgaatgtatctacctacctcacacgggtgttatatggattaaaaagcaatgatggtgaaatcctgaaaatgaaaagctctctgcaaatattaagcagtctattagtggttatgctcaggacaactcaagtgtagattttctagagaagtaagacaggcacaggcctcaactttgaaaaggaaatggttatggagcacatcaccaatgtttaatctgctttgattcttaaaagctgacaatacgcaggctctcaaagggaagtaatatccttccagaaattgctgcacctatgtgcaaaatacaacttttgaaatttattaacccaacaggcagattatgtcactgttattgtctttaaattcttgcaaagtcttcataagttgactactaaaacgtcttcaaaagttcacactaagcaaagtatcctagcaatgttattttattattttattttttttgagatggagtctcgctctgtcacccaggctggggtacagtggcgtggtctcggctcactgcaacctccatctcccgggttcacgccattctcctgcctcagcctcctgagtagccgggactacaggcacccaccaccacgcccagctaatgttttgtatttttagtagagatggggtttcaccatgttagccagcatggtctcgatctcctgacctcgtgatctacccgcctcggcctcccaaagtgctgggattacaggcacgagcctccgcacccagccccctaacaatattatttataggcatataaatgtcccgacaaaatagtcgtaaatgttttctccaaatagaacttgtgtggttagatttatactgcaaaggtatacacagtcatccatgttgctgtctccatattatttttacggtttagcttcagtaattaatgttcaaaagacaaagtctagatagactgattagtccagaaaataagaaaatgtactatttacagaagagaaacaatgttttttctattttagtcattctaaacatttgaaaggattaaatggaactaaaaatctaaagtcatactttcagttcaccagaaggacaaccaagaagggaaattattagacttttttttccctttacatcaggttggatgaggccaagggggagaattaatataatatttaggagggataccaaaggtcaaaccatcaaaatacctttctcaaagggttgctttgaggaataaaagctaccagacagcatttgctctagagaaagaaagtctaggttcaaactcttcctattccatttattaactgtttgactttgagcaagctaactttgttagggaagcattctctggtgtcctcgaactagactgatttttctgagtccatgtttttccagtattcagtacccctcctaggtgattttcacaattgtaactacatatcggttgatttgttttatatttgttctctggctagactgcaaggatccataatgaagaaacaagctacactgtattctgtaggtcagtgcttggcatacaataggatctcaatatgctaagtattaatatctatttcctaatttagctgctataacaatcctaaagttggtatcagtactactgtcccaagaagaaagtgaagtgccaggcacggtggctcacgcctgtaatcccagcactttgggaggccgaggcgggtggatcacgaggtcaggagtttgagaccagcctggccaagatggtgaaaccccgtctctactaaaaatacaaaaattagctgggcgtggtggcagatgcctgtaatcccagctacttgggaggctgaggcaggagaatcgcttgaacccgggaggcagaggttacagtgagccgagatcaggccactgcactttagcttaggtgacagagcaagactctgtctcaaaaaaagtactaagtgctatattcgaaacttaaaaccaggtctcatcaccagagccctacactacactgtagtgtctcctccatataccaacaaactgagggattcacagcattttgtccaattttgagcctaaatactggtaaagtcaactgaccaaaatacacacgtgcctaataaatgcactaatttactgtcctccctgtttataaataacccaacacctaataaacccactaattcattgtcctcctgtttataaataacccaacacaagaaacccaaataagggttttcaggtctatatgccattgctttcttattaatgaaataaaaataatagcatgagtttagaaggtacattttgtagaaataattaataaaatcaggaacttaggaggggagggaaaaagtgttcaactgactcatccatgacagtgtaactactctcttgcttcttcaaacaggaagtgtcctctgatgccatcttcagggtgtcagtgtgctaacgtgacaagggactatcctaggagtccgaagcacagctcttagactcaccagccacatttttgtcttgccttggccttgaattcctcatgtgcaaaatgaggactaaattagctctttgagatgtcctctaaaattagcattccattatttatattaaacaaggagaaggaaataaaagtaaccactgagtcaatcatcaatggcctgtagtatttggctgaaggcttcacggttaagtctccccaggctccattcaaacaatttgatggctgaagcctaagttacgcagtcattttttcctggcctatctaagctacattagtaagactgaaacctcccctaagatttaaccccacaaatttttaataaatatatgacttagtaactctttggggaaataattgtttgcatagcctttcagtctttgttttgcagtccttaaatccaacaaaacctgtgagacaagaaagatgaatttgaagtttttcatgcactgaaagcattcctggaattgtaacaaaattagttttgggaggaaggttagtctatttttattcattgtgtggaacacacaagtatttcacttggacctacagactaaaccctcctccccttccctcaagtctgagtgcacgcacacagatacttgtgtgcttctgaaattcctgggtcactctaagaattgctgaagggaaagacattctacagatctggtggctttgacctgcaccaagggcatgatttatgccacagcagttttgtgatgtttggacaacagactaacgaaattcttctaactatgatttcaacatcataaaaggaaatttaatgtactggcatttataaaacacaatcctttaaaagatatcaaaatctgactttctaacttgtttctcttgttggcttaacacatttgaagctaatactgaagttatttaaatgtcttcttcaaattttcatgaacattttcaatctttttcaaatatggtatatatccctagaagatgttttcaacctttttcaattcaaagtgttcagttttctctaggttattctccatgtaccatcaatatattctcctaagcctttagattccattcctctgcttcaaaaaaaaaagtgaacatttatgtaatctacagtttaacaacccctcttatcaacaaattcctcatacatatacagtaaaggaattcagtctggatagagttcacttttatttctagactaaggtgcaaattactcaaattttctctcctcaccaacaggtcctgctctctggaggatttcttggctctttgagttttgacaatttaagtatcttttaaaaattatgtcagaggtgaaaaattgctgaagttaataaaccaataaagtttgaattctctttctgaagaaaaggcagacattctcgccttgctgaaattaaacgaacacatccttctcatatgttttcattttaagaaaccaactctgaaggtagattctcttttcgaatgttcaaaactcttcaataaatattgcatttttaattggctttatattttcaagacattatagagaaataatttaaaagaataaaggttttacccataattcaatcacatcaataaagtacactgttattcttatagtttttctctagttttttaattcaaatgcatagttttccatggtttaaattcaaaaaataaatgtaaatctaatttttaatttttaaatagaagactgtatatattcttctaatctataatcattttgatcaagttaccataatgtaattaacaaactcccttgttgtatggcatttaaactaccttaaagttttagttgcaatacaaaatgttgcaagaaattgctttatgcatatagtttcccttaagttacttacttaaaataaattgccagtggcataattactaggtctgtgaacattttcataacttttgatttatatgaacaactgctttctaagaaaaatgctttccaaaaaaaagggatatcataacagtcataatgtaacaatcataatgtcacctgtaatacatgtgcataccaatgccactacaatcttaccagcactgactcgtctcataaagaaacagattttggtaaatttaagtataaaactaacgtttacttatctattctctagtaaagttaaacttctggtaaagttgaaacttttccattaatttgtttgccatttattctttttatgaattatctctttatagacttggcacagtttatctgttagattctagatgttatttgtaagtgtggttgaattctctaagagggacagccatatgcttatctgtaatatctgatgcaaatacttccaacagtatttttttatatttatcttaattttagatttccaatggttttaaatttttatatagttaagttccttgatccttcccttgtgaatgattcactggaggcctagtccagctattctgccatcttccacactgaagtctacatacacatgtggatttctgacttcctcaattcttttccaagttacctttattactattggagtttgctgtttatttcagtaccctccttccaccccctttgttcttctttacttacacacacacatacacacacacacacacacacacacacagagagagatacacacctgctatgaacaaccaaaagaattctggacctgggcagtaagtttgaagatgtcagcaatgcctacctcaaactccagcactgaacagttgtggatccccgataactaaagtcagcctgtgggacctcctctgctgcctattcgccaacccttctctaccatcagtaacttgtttctacaacatcttgccctcctttcactataatgaacacacaggtccaaacaccaagcatctaccccttttctcctacatcattacttcctgcctcccatggccaactcagcctcacctttatcattacagagccttctcagtgaatcatattgaaccttatctttcttaagaagtcttctccatgctccagcatttccctgcacattttttcttcctccatacactagcaaacagagcttttccttctcttatcagcgcctctcagcacaaactttgcttccttctacgcttttagaacacttcatcatagccacttgttaataacatcctacctgagttatgacgtttacttatatatggacctctgcattcccacctaccaattttcagggattttgttcatctatctgaatgaactcaatatttggctaacagttgtccaccacaccctatctgcttctattcttatgggcaacattcttaaaactaatagccagagctatcctctaagtttctgatagtttttcagatctctaaaactatcagctctaattcatatcaaccatctccagtttatagcaaagagttgtcgattcaattaaattttctactttaacaatcatgccatcagcaagtacgtttttatttattctttcacaaaatgaaagcattttatttatttttcttgcctgatttactggctagaatctctaccacaatgttgaatagatgtggtgagaacagacatccatgtcttattcctgatctgatcaggaaacaattcagtctttctccattaactctgacaacagctgtagggttttcacagatgccctttaacagttgaggtaattcctttctagtcctactttgttaatagcttttgtcaaaaattgatgctgagttttttttgtttttgttttttgcatatcttcacaggatcatagtttcatcttttggtttattgatattgtgaataaactgattgatttttgaatgtgcaaccaactctgcattcctagaataaatgtcacatgttcatgacatattatcctattaaaatattattgttgaatttaatttggtatatttttgcttataatttttgtatctgtgtccatgagggctattggtatgaagcttttttttttttttttttttttttttttttttttttttgtaatgtctctgtgtggttttggtatcagcttcatgctggtcttaggagttggggcatttttccctcctcttcaattttctggaagagactaaagaattggcagtatttcttccttaaaatgtttggtaggattcactagtgaaaccaactagacttaaaaaaagaaagaaaaggtatcaatttcttaaacagatataggtctatccaggttttctatttcttcttgagtgagatttgatggtttgtccttcaaggaaattgtccattttctctaagttgtcagatttactggcataaggttgttcatgatattcccttattaacctcttactatttatagaatctatattgatgtcacctttcttattcctgatattggttatttgtgtcttttttattttttctgatcagtttggctagagttttaccagttttactgactttctcaaagaactagcttttggttttactaattttctctatggctcttctatttcattgatttctactttgatctttattttcttctgcttatttgggtttaatccatttttcttccagttccctaaggtggaagctgaggtcattgatttgaggcccttcttttctgaatagacatttagtggtataaacttttcttaaagtcccgttttataggcaccacaaattctaatatgttgcattgtcattcagtgcaaaatcctttataatttctcttttgctaccttctttgattcgtgggtcatttagaagtaagtgagtttgtaaatacttgagattttttttttcttcttgttattgatttttaatgcaattctatcacggtctaagaacatattggatataacttgaagccacttaaacttatttagatttgctttcataaaccaggttatggcctaatttggcaaatattctatgtgtacttgaaaagaatgtcttctgttgttgggtggagtattttataaaatgttaatcaggtcaagttagctgttagtgttgttgaagtctgctacgtactggctgattttcttcccacatgatctataaagtattgagagaaactgacgtcgctgattgtaattgtgggtttgtacatttctttttgcagttctgtcatttttttgtttcatatatttttaagttctgttaggtacataaatgtgtagaattattacagtctcctgaataaatgatcccttcatcattatgaacttctttatccccagccttattcattgctctgaaatctacattgtctaatattaacatagctaccccaactttcttttgactagtgttagcatgatgtatctttttccacctttgtatatttaatctatttgtgtctttatacttaaagtttgattcttaaagtcagtatttggttgggtcttggtttttaaaaaaatctattatatcaacctctgtctcttaattaaggagtctagatcatttatatttaatattattattgatgtttaggtttgactgtatcacctttctacttgtttcctatttgtttcatctattcttgttccccttttcttctttttctgccttcttttggattatttttgataattctattttcatctcatttgttgctttatgggctctcatcctttgttttgttattttattggttactttagggtttacagtaaatctttaatcagtctaccttcaagtgttattatacgacttcacatatagtacaagaatcttccaatagtgtacttccctttttccccatgacctttgtgctattgttctcaggcattttacttttacatatgttgttaaccccataatatgtgcttattattgttgtttaaagacatacctcttaaagatatttaaataataagaagtaaatattatataattatccacataatttgcatttctggcagtctccattttatatagatccagatttccatctggtatcattttttttctgactcaaggacttcttttaacatttcttataatgcttatctgctagcaataaattccttcagattttgtatgtctgaaaaagtctagtctttatttttactttctttttaaaagagacttttgctggatattagttgacagttttttccctttcagatgctgctccaatgtcttcttacttgcatttttccagtgaaaaaatgtgatgccatccttatttttattcttactcatgtaacatcttttatctgcttttaaggtattttctttgtactactttgttctcaagagaaaaaaaaaaccaaaaggatgtgtgtttatatgcatatttatatgtatgtataggtgcatgtatggatataaatatatacctttgtttatatatatatatataaatagagacagagaaatactttaagaaattggctcacacaattacagttgctataaacccaaaatctacagtttgggctggcaggctggagacccaggaaagaatcaatacgcagttcaagtccaaaggccatttactgaagaattccctcttgttccagggaggcaagtcttttattctattcaggccttcaactggctggatgaggccaaaccacattatggaggacaatctgtcaaaatccgcagatttaagtattaagttcatcccaaactacccttatagaaatatccagactaatgtctgactacatatttgggcactgggacccagccagttacacacaaaattaaacatcatattctttatcaccggttttgaacaattttattatgatgtgccttggtatagttatattcacgtttctttctctctctctctttttttcccccacaagagatggggtctctctctctgtcacccaggttggagtaaagcagtgtgatcacagctcattgcagcctcaaactcctgggatcaagcaatcctcctacttctgcctcacaagtagctgggactacaggcaagcaccaacacatgcagctaatttatttatttatttatttgtagagatgggggtcttactatgttgcccaagctggtgtcaaattcctggcctcaagtgatacttccgcctcagcttctcaaagtattgggattacaagtgtgagccactgtgcccagccttgctcatgttccttttgtttggggttcagtgagcttcttggatctgtaggtgtagagttttcttcatgttcaacaatgtttcagccattatttcttcaaatatttttctgtccctttccactcaccttcatggactcaaattaccctagcttaggtttaaagttgtcccatagctcgctggatgctctttgcatttttttctctctcagattgtctctatgaacagatacaatacagtgataataacagttttaatgtccccctttgctacttctaatatttacatcagttctgggtcagttccaattcgatgattattctcattatgaatcatgatttctggcctcttcccatccctgataatctttgactgactggcagacattgtgaattttaccttgttgagtgatgaatattttttctttaaatcctatacagctttgtgctgagatgcattacattaccagacaaccatctgaggttttgggacttgctaatattatctgtcatgtgagtccagagtggtactccacttacggctgaccttgccaagtactctacccagttccttgtgagttataagtttttcagtccatctggtgattacaggcatagttttcaaccctgtatgaacaccaaccactgttccctctagtcctttaagatggttcttgccctggccttgggaagtttcctcacatgcatgcattgaatattttgctggatactcaagggagactctgaaaatctttagtgttctctctctgtacaactcttttctctggtattctattctatgaacattagccatcttggtctccccttgctctcggcttcatctcctcaatgcagggagttcactgagctccacctcagctccctctggaactgtgccacagcctggaaactctcaaggcattaagctgggacaatcacagagcacatctcatttgtttctcatttctcagggataactgcgtttcctggcttgaaaattgttgctttgtatatttcatgagctggttgctgttgttgttcttcttcttttagatgggagagtaaactagttccagttattccatcttaccagaacaagaagtcctcactcatccttgtgctcactgccctctcttgagcatattcagtcttgccttttcccctgatgaccaccctaaacctctgactactagcatgctcaagagaccttttcttatagaaacaaattctcttagcactattttctctttttctgtccaccttcttgaaagaactgtctatattccaaagagttaaggagtgaaaacgatggtctacccctcaattcctttgcttgctcttcatcccctcaattctcaggttggtttccacctcaatactctactgaaactgtttctaccattagttattaattaccacgttgtcaccacatccaatggcctttctcagactttagacttacgtttaccttatttgactggttcttttgatttcttgcccatatttgacttaaaggatattatatagaactgtctgacctatattccttatcaaaagcagatgctgtaatgtaagctccaaagagcagggttgtttgtatattttgttaactgatatatcctcagtccttaaatcagtggcagtcacataacagacattcaatgaatgtggaatgaattaacaaaatataattggtgcttagcacctttcttcccgctttctacccattacccctggacaagctcatccaaatctatgactgagttgtctctcaaatctctctagtctgcttggcttttagcatttggatcactgttggatgtcttgtcaaacctcaaaatcagcatgccccaaactaaactcattatttttatcttaaaactctgtcacattctccctactttttttttttttaacaattcaccaaaacataaagctataaacttgactcatatttgattgttttatcttcctttcctcttgaatacccagcataactgtcacttttacagtagcagtaacatccccacaagtattgtccctgctggatcacctctacatctaacaggtctcccccaacagcttctctaagtctctagccttagatcccaacatcccctaaatctctgcatgctgtgccttaacccagtaagaccactaatctttctctgaatatacctatgctttctatccctaactctcctcaccccattcctctctgcttagaccttacccatcatatgagaccctactcaaatgtaaccttaactatgagctttctttgaccctccagattagaaatgatcactctcctcttttaactttcatatttacaccattaatataacacatatcacattctgtcttagcacagagcctggagtatattaaataagcaatatatgtgaactgtttttatcaatacacaacttatcttcctaacctgggtgtaaacttcttgatggcagcttcctccaaagaggcctccaaaaagacattatgccaggttcagaacaatgacaactcaaagaagcttgatatccaaaaaattagccaacctaacaactaattcatcagaaaatagactagtgcacaattctggtaaaacgtattattaaaaaatttcataaaaacaaacacaaaacataacttacaagtaagaaaattatatacagataatcttttacactataattcaaaactgctcctctagcaatagtgctagaagataactctgataagtgaagaaaagcatactttgtgttactcttacacatattttagaagctattttgattgaaaagacttaagctaataaagtttatataacttcattgcacattactcaaaagatattcacagttttataaacaaccaataaagtacctacttccaccagaaatcctaaaccttggataccactaaacttcacttgaacacctgaactggcatcctatctctagctatgtaacaatagccatgtcaccatacctttgatcttcaggtaatttagaaacagaatatggaaaaagattcctacctgtcatataagggctgttataaggctaacagaagactatatagattcaatttactttcatttgcttattaacagacatctgtatccatgcctaaaccttgtgacagactctgggtatacaataccacatatgatgctctagctgcccttaagagattctaacccaagatggggagatgggcacatacataaagcagtgctacaggcactaactgggagaaatacggacaacgcccagtggggagaggagggagtactcagttctgtccaaggagaaaagaaggtagtcagaaacagcttcctgcaaagaggctacacatgagctctgctaatcttctctggggtctctactcattacaatccccttatcctttccctcatcctaaaatcaagcaatgtctctaaccctttaacagctccacagtttcttatctcaattctaaaatctgaaaagctctcaaaacctgcacttttttaaaacttacttgccggcaaaagctgacgtgaactgaagtaaggttcttgatcaacaatatcctttctactttttgtaggaaatcctagttaataattccatcatccaaccatcacgtaagccaggaattgagacagccatggctttctcactctcaccctccaaacccaactacactaggctttgtcaattctagctctcaaatatatatcctacctattccttcctcttcttccccctgtaactgcctcagccaaggccttcatcatctcagttgcaccatcacagtaatcttctgcctccgcctccaactgcgctactcacaatttagcctccacatcatggccagcttgattcttctcaaatggacatctgatcatgtagtttccttgcttaaaatactctgatgtctctgcactatctacacgaaaagcccaaactcctgagcacagtatgaaaggtctgctaagattcagccaccactgaatacaatttgtctcctggcactctattaaacatacactgcagccacacacaaatgcagtttctaggagttgccaatctgtttgacactccttaccttcacactgcccctctgctcctaagtcctctttcttttccaccccctcaccttatttcttgtaccagacctacttatcaacctcaaatctaatgtagcaaaccaaatcatgcatccttcccttccccaggtccaggcaacactgtcatgccccttccttccatgccccatctatttctggatatgaacttaatgtttatgcagccagtatactgagactcctggaatgctgaaatcatcgcttatctcatgtctaacactggacctagcacatagtaggtgctcaaaataagctggctgatgaacaatcttttcaactttccagaaaacatctcacccttctccttccttctcagctctctctgcacagcagctctgttctctatctcttacagctgttcttccattatttcctcttatactcttctttccttcttcattgtcagaagagaaagaggacacatttgggaagtgaagaaaaaccctagccaggatttctcactaataacttgacactgaaaacattttgggcctgataactctttgctgtgggggctgccctgtacattgaaggatgtttagtagcaccactggcctctatccaccagaagccagtaatacccctccccacaaatgactccaaaatgtcccactcagaggcataatctcccctgattgagaaccactgccctagactgactttgcttggctccatcaggaagcaataggggaaggctgatgcatgatctcttgcactgactttcctccaggtgaaaaatgacaaggaaagaagattcagactacatcagtttactattcagggagtgtgtggccaagaaacataggctggagtgacacttcaaggaaggaaagtactctatgggcccaagatgaatccattttgtcatatatcagagttccagatttcaggattcatttgtattaatattttcccaagcttcatttattcagtgccactgaaatgacctgctagagggatataggatacagcaatttaatgctattaaattcatttcaaatcttttttgaaaaagagatagtgtttaaaattaaaataaactgattaaagcattaaactataagtagaagggaggggataaattgcacaggaaactaggacatcttgggatgagaaagaagaagggacagaaccccagcacagtacccacctgtggtcgacacgacgttatcggggctttcactgcagagtttggacaacagactggttttgccagaacctgtgaggcctatgcaaaccaggtcatattctggtcgtgcaggtggtggtcccttgcagcaaagtgctctaaaacactgccaaaagaaggggaaaaaaatgttcctttaaatgacagtatggaaataaaccatagtcacatttaaaatgactgagtaagtattaagaggtaattgaataaagtattacctataaggaagaaaacggtaactttagaacagtgaaacctggagacaccactctagccaagtgatcaaagttaacattcttagttatgaaatgtttttctacttcatgcctcccttcctgctatggcaggtgcactgcaaaaagcatgacatcatcccacagcttgcctgccaaaaccacacaatctgaatctaagcatgaggaaaccagataaagccaatctaaggagtattccataaggcaactggcctgttctcctccaaaatatcaatgtcttaaaagtcaaagaaagactgaggaactgttccatgttaaagaagactaaaaagacataataataaaatgcaatatatcttggactggatcctagatcaaaaggggaaaaaaaaagccataaatgacattattgagacaataagtgaacactgaatatagactgcatattagataagagtactgtataaggttaaatttcctgaatttaatcaatgtactgtggttatgtaagaaaaatcattgttctgagaaaatattctaattatttataatacctctaagtatttagaggtgaagggtcttgatgtccacaattaactggctcagaaaaatctaaatctccagctccatctttatctggtgaggagagtgacaaagccaacatggcaaaatgttaatgactagtgatgctgagtaaagagaatagaggaaaactccttgttctggtcttaccactgatattatttcaaaatacaaaaatttttaaaatcattaaatagagtctctatacataccactgcctttctggcctttgctaaattctttttcaggtcaatcaaccagggtactatgaactgtagtatagtttgctctgcaagagttaaagacaaggggatctgggccaggcacagtggctcaggcctgtaatcccagcactttgggaccagtctggccaatgtggtgaaacccagtctgtactaaaaatacaaaaagaaattagccaggcatggtggcaggcacctgtaattccagctactcaggggactgaggcaggagaatcacttgaatctgggtggcagaggttgcagtgagccaaggtcacactattgcactccagcctgggcaaaaagagcgagactccatctcagaaaaaaaaaaaaaagaaaagaaaagaaagaaagaaagaaaaacaagaggatttgggagacagggtatcatttgtgcagcttttgatctttctacttatcccatatccataggggccaactatgtgccagcttatagagcctgaaacatttagaccctgaatgattcatgagagaaagagggaaagggggagacagggaggaaagaaggcagatccactcacttttgggtcatctggagattacgagagaagagacctataaaaaagcctgtgttgattcatctcactcagataaaatctgagtactaattggctgtcatactctcgtaaatcaaacttgattatttctctccctcatttctcacatctaatcaacaaatctagttcatatgacctctgaagtagctctaggatctgtccacttctgtccagcccaggccatcatcacctgaacaacatcaatatcctcccactagttccagtatatttgctcttgtgccccctattctccacattgcagtgactggattgcttataaagagaaaatctgaccatacgtgcttaagccaccccagtgactttgcccagctctcgagcccaaacccttaccatggtctaccccacactccatgatctgctccagccaagctcaccagcctcattgccctcactcccctacatcctccagccatgccctctcttacctcaactgaggcatctaatatgctgttccttcttcccccaattctggacttagccaacacctcatcatttttaggtctcaacttaatcatcccatcctcagggcagtctgctccaatcctaagattgtgttagcaattcacgtccagctctactgggcttttataaattcattacacagacaattgcagtttcttattcatcaccagcctgtgagaaccatgtctgtcccccttcatctcagtactcccagtgtctagcagagaacatggcatagaatctaccctcagcagataattgttgaatgaagaatgaacgacacttaaattttacctaagcaaagaaaaaagaaaacatagagactaacaggatgcttgatctatgttctctgagccctccacgcttcaagaaaatactgtcaaaataagaaaccgctgactttttcacttcgcttcaatgccattagttagcctagttcccaaaagagtggttttggtgtacaggatcaactttcttggtaaattagagcttctttttgtcctaaattcacttttcctctgttctcaagaggttctgcctgcttctggtaaacaattctatgacccatattcttcatgggtttattcatgctaattgtatttcctctcagtcttttcaagcctgaggagtcctacttatttcagtctgtcttcatcctatgagatgttcttctctgatcttcctttagttccagcacaccctctcccacaagattaatgaccataactactaacagcattctaaacgccaacacatcacttcatggattcatatgaaggctggctgatactgtctgactttaacaagcttttttataaagtctgtctcccagactcagaatgagagtttttctcagagataggtttatttgtgtatgtgtctgttccctcaaagatggccatggctagcagctgttcagacttagaagtggtcttccacattcaattaggacagacaacaaaactagtcacacagtttcttttactgggctgcgttggtcttgtttggggttcaaggaggagagatcccattcctgccctagaggccttcattctcactcagctccttgccagaattcctctggactatctcctggaggagggctggcctgactaccctggcccaaactatcataaaccttaaatatcaaatgaaactgtatgtgaatgattgctagagcatccggtttaaattattcatgtcgttatcactcatatttttgccaaacactccagaatttcatcttcatgttctttttaaaatccagagtagaaaaactttgtagccaactccattaatatctattttacctgtttattctaggtcacctaagccacttctgacataaaagatgattttgcaatgatagcagtgatattctactccactgtcttttctcttctttctttctttcttttttttttttcagacagagtttcactcttgttgcccgggctggagtgcaatggcacaatctcggctcacagcaacctccacctcccgggttcaagtgattctcgtgcctcggcttcctgagtagctgggattacaggtatgcgccaccacacccagctaatttttgtatttttagtagagacggggtttcaccatgttggccaggctggtcttgaactctcgacttcaggtgatccactcacctcagcctcccaaagtgctgggattacaggtgtgagccaccatgcccagccttctcttctctttctttttctctcttttttttttttttaagacagtctgtctctgtcactcaggctggagtgcagtggtgcaatctccactcactgcaacctccaaatcccaggctcaagcaatcctcccacctcagcctcccgagtagctgggattacaagtgtgcaccaccacacccagctaatttttgtatctttgtagagatggggtttcaccatgttgctcaggctggtctccatctcctgagctcaggtgatccactcaccccggctgcccaaagtgctgagattacacacgtgagccactgagcctggtctctcttccctttttatattctcaccagtgatatcatctccagtcccatggtttcaatcatataaccgaatgtcataaggacatccaacatgacatctccccctccgtctccccaagctctttctctaagtccaggctctatagttccagctgttctataagaacccaaaccaaaactgaataaaacaaaagcctccccacaaaaccacaggctgtggaaataaggttctttggaacttaatggctagattgatagttattacaaggcaaaatctttgacataaatcacagactcttagaaatcaacatgtatttgaactgactgaataaatcatcctatgggtaacaggaatagtgtcagattttgagtcaacaagataaaactttcaacagtatgctacttccaatggggaaggaatggtcatgttttctgagtcagttcctaaaaactgtaaagagttttcatttgttttttgttttaaaacttaatgaagctttggatcctatagtcaatttacttaaaattactcattttggcctctagactatactgtaccaaagttcattgtgtgtgtctcctacagcagctcttgcattgttaagagtaagcccctttcactgttgtacaatgcgaaacacaatgctgtcggcagtcctgacagcaagcggcaaactcaggcctcattcccaggccaaacactaaggcattgtgtaactctgttcaagcctcataaacctatccatgcttcagtttccccacgattaaccagtaacattttaacactctctgccgcttcctttcttcaggaggatgttatgaggcctgggtgcaatacatcatgctactaagaaaggcgccatacaggtaaataactgctcattgcgattttcatttttccaaggtatcttaagtgacagttagcttccttagacaagggcctggccacccaatatacagcccagactgtagtacttccaacagcccacagcagcctccacatgctccattctatcccagttcagcccaagacactaaacacacacaacctgtccccactcccctggtagcagcaaatagagaacagagccagtctgaatataagtataccctcttggggggccaaccaaggtcatggtctccactgcctagactgcttcagctcacaggccttttcacacgggacaagttatgacttggtcttttttaaaagaacccagtgtatctactatattatgtcaggacacaggatgtttccccattctgtgtacccacaaacttctagtgctgtatttgaggaaatggtgtgcctaggtcttgagagagggcaaagaccagaatcaccagtaataactgactatatcgtagactttggacaaatcatgtaatcatataatcaacagctgaaataatggattagcttgaaagcagaagcaaaccccttagaaatatgtgcttaaaaaggaaggtgactacaaatattggaaagaaaagaaagcaaaagataaaattactagagtaaaataaggacttgcatttcagtctgatgacctagcaccaaggcagcaagattatcttaaaatgttcccatttctgtttggaacagaaataaggtatttatttccccaacagtgccagacattttgtaggtctagcagagcactgtacacaatcagtacttgatgaataacccctcatgtcaacattgcaaagcactaatcaagcatttaattgtacatttcattttcctctatatttctaccttaatgactccggccaccctccaaatcaccactattccttcacatggtctgagcacttaacgtttctatgccaccctgttcctgtgcacacagaataaaagttcctccccactttcctacttggcaaactcctgctcaaagttctgtttaaagggcacctcctctgagaagtgttcaattccctcagagagaaataatcctttcttccacttcttggtcctgtacagactagcactacagttaatactatgacacatgtattcttttctaagattcactggctgatagaaatatgcacacagacacaaagacatatccattcttggtcctattataggttcaaaaagcttaatcttacagctaccaaggggtggccaggcaccaaaacagaacagcaaagttgtcctacaaatatgtgttactagacgagaatctagctcaaaatcctcccactttggcactggcccctgcattgccagtgtttcctaccatcctgtttcgctaaattcccagccctttgggacatggcatttgtttcaattgatgctctgtttttcatcatgaatacatgattttattctgagcatgatttcaatttgattgaagctctgtatagttgctggaaacttttcttcagtcggctttgggacttctccacagccagactacccaagccccacactgttcccttctcatttcaatactggtctcgccagacagaaacacaaggtctcctatgacagctcaccaggtctttttctatgtggcccaagggtgaggccaaggaccacactcgataaatactttttagattaacgaaacatccatgagttagtacctaaagggaagagaaaagtcacccataactttaagtggatatatttcttacatagttggcttccaaaccaaaaagaggcagctattcattctgacccttctccaactctcataatgaagaaaaaaagaagcttctaaaaagaagtcaatttctagaagtgttttctaacactaagcgttgctcaatgagtaaaacattaagaagtgcttaaatatgtaaaatgacttgatttagaacaaaatattttccaggtctgtaacagtcagttatggctctgtcttttgaaaatgtaaacccagtacaaaatacaacacattacaaaatgtgttacgggatttgtcagagctgcttgagctctgtaggagacattgggaggggcgggtgtcctagtaaattaaaaataaaactgtattgaacagcagatataagtgacttatgggtattaattcatctattccctagaaaagtaccatatgatttcaatttaaagaggaggaaactgaggctcaaagaagttaagtaacttgcctacgtggaacaggattcaaaccctggcagtctggctcctgagctgttttccaaacttctgcaatgataagcctctaatttctgagggcgtgtcattcaaaggaaactttagatccattctgtgttgatagagggcaacaaagagataagaaaatgtacccgagagctattaagtggcagagctggggttcgagccagggttattccactccagagccctagttcatgccctcaagtcagggatcagagcatcagaagtggggtgttctgttcttttgaggaggtgaaagagtgctttaagtaagtttgcctttgtaactgaagagaaaaacaccgggcaaaggaaggcgaagatacaagtctttgtattgcttctttacttgtaccagcaggtttatggccaaagtatctctcattccaggcaaaagggacctgcagctctcttggagttagagaagttgggtgagaaatagcatccttaagattcttgccctgctgaattagagagcaggggaggaggaggagaggagattgactgggatggaagaaaaggggataccaaagtgctgctggcttctctctttcacactgtttgcttctttcatttaacccttttttgtcctctggaaaggataaaacttatgtattaagagaagccagccaggtgcagtgactcacacctgtaatccctgcactttgggaggccgaggtagggggatcatttgaggtcaggagttcgagaccagcctggccaacgtggtgagaccccgtctctactaaaaatacaaaaattagccaggtgtagtggtgtgtgcccgtagtcccagctactcaggaggccgaggcaggagaatcgcttaaacctgggggactgaggttgcagtgagctgagatcgcgccactgctctccagcctgggtgacacagcgagactgtctcgagaaaaaaaaaaaaaaaaaaagagaagcccatgtgagctgcagagatttccaaccctaagcacagcagtaaggaaaaaaatctcttttgaaacagcctcaaattatatgtatatataaattataccttaaaatatatgtgtatgtaaattatatctcaataaagtaaaataaataagcaaatactaaataaaatatgttggaggagagtataggaggaaatatatgaataaactgggttgtgcagaaaggcatgtgaaggagaaggtctataatgagcatgcgatctcttagctaatcctatctttctagttgtaagaagagaaacaaaaatcaaatatgcttcgatgtcttagggtgactagtggttcttgcaaacaagttcaaaatggcatctatagcaagaaaaataacaaacagggcaaaggagtgctgtgaagaggcccctggctgccagacacagcccagctgaagacttctccacgttccaagagcaacctatgttttgaggtggaaatcctgtcatcctttaagaccctagtgggaaaaaaacaacaaattgtttttatagaaggtgggtcaaacctttcagccatgtgggctgctgggagcacacagatgaaggctttggactggaattgtcccagggctgaggcttctggccaatacatcacactgcctcaggacactaaatctgtctttgccttaccctttgtatttctcaatccacattcctttttggggtgaaatactccattatttctgctttgttctgggctgtctcctgtctctgtccctattaactcgtggcaacaaaagaaacaaacagaagcaggggatttcatgcttagcagctatagacattggcctcacggctttgcagaggggcagacatctgagactttgaatggaagagagtgctgctgcgctgaaccagacccggggcccacgtggctcccagtctgcatcagtcatccccgatcagtggctttcaagagtctcggtatgtggaattcaagatgaaccaaaagtgagattttaaaagttagggcatgtatctgatgattagatttaaagaaatgaattcaagattctcatataattcccagctatgcataatttcacatcttctcacattggaaatagatcagaggaataggatttttttcttttactaggaaagaaaactaagtaaaaaaataaatgtttcttttaaaaaaatctaattcttacattgtaatggcttgaagggaaaaaatcaatttttataaaaacagaattatgcaataaaaccagcaataaaatacccaggcataaatgtctgtaacgagacctaacctttatatgccatattcataaacatctccaaatcagggcctcatctaggtcagtttcagaccatgtactatttttttcctaaagagcaaagtaatacaatttaaaggaaagtgaatgagaaactaatgcattttacagcaaatctctttttttgctgattacctgaacagaacatttctaaacaggaagtaggccataaaaatacacaaacacttttaacattccttaccaagggcattttctatattttaaagacttaagaagggtcaggacatgaaaacatttaaaaggagctaggtggtcgggcacagtcgctcatgctggtaatcccagcactttaggaggtcaacggaggaggatcacttgaggctaggagtttgaaaccatcctgatgaacatagcgagaccccatctcttcaaaagaaaaatttatttctccacatcctctccagcacctgttgtttcctgactttttaatgattgccattctaactggtgtgagatgatatctcatagtggttttgatttgcatttctctgatggccagtgatgatgagcattttttcatgtattttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcctgtttttctcaggtttgtcaaagatcagatagttgtaggtatgcggcgttatttctgagggctttgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtctttggtagcttgatggggatggcattgaatctataaattaccttgggcagtatggctattttcatgatattgattcttcctacccatgagcatggaatgttcttccatttgtttgtatcttcttttatttccttgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgtgatttttgtacattgattttgtatcctgagactttggtgaagttgcttatcagcttaaggagattttgggctgagacgatggggttttctagataaacaatcctgtcgtctgcaaacagggacaatttgacttcctcttttcctaattgaatacccgttatttccttctcctgccttattgccccagccagaacttccaacactatgttgaataggagcggtgagagagggtatccctgtcttgtgccagttttcaaagggaatgcttccagtttttgcccattcagtatgatattggctgtgggtttgtcatagatagctcttattattttgaaatacgtcccatcaatacctaatttattgagagtctttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcgtttttgtggagaaataggaacactcttacactgttggtgggactgtaaactagttcaaccattgtggaagtcagtgtggcgatacctcagggatctagaactagaaataccatttgacccagccatcccattactgggtatatacccaaatgactataaatcatgctgctataaaaacacatgcacacgtatgtttattgcggcattattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattaacaatgagatcacatggacacaggaaggggaatatcacactctggggactgtggtggggtggggggaggggggagggatagcattgggagatatacctaatgctaaatgacgaattaatgggtgcagcacaccagcatggcacatgtatacatatgtaactaacctgcacaatgtgcacatgtaccctaaaacttaaagtataataaaaaaaaaatcaaaaaaaaaaaaaaaaaagaaaaatttaaaaattagccaggtgtgatggtgtgcgcctgtagtcccaggtcctggggagggtgaggcaggaggattgcttgagcccaggagttcaaggctgcagtgagctatgactgtgccactgcactccagcctaggcaacagtaacactgtctttaaaaaaaaaaaaaaaaaaaaaaaaaaaaaaagagagagagagagactaggttccacaagtagaccttcaaatggatttaaatatcaccacaaaaatccctaggaggaaagatctcaataaagtagattctttccattcactgtgcttttggaactgaagctagaaaggcttataacaaaaaaaaaaaaaaaaaaaggaaaacaaaccaaaattgtttttcttgtagtccctaaaagtggaaatcctattctattcttcacttaacaatcttttaggctccataaagatggagctcagtcccatatattctactagtcaccaattcctatgaatctgtccaactttgcctctactatttccctgttcctcctggatcccagtgcctttctttgttcaggacatcaccacagtcctttggataaccacactatcttttctcctaactggtgtcattagttcaggtcttatcctactccaattcagtctccagaataccatgtttttcccgtgatttaaaatctttctatagctacccacagctgtcaggataaagtacagactccttatctgggcagacaaggagctttatgatctgacctttgccttcatttctggcatccaatagttgttatggggaccacaggaaataacgtctataacagctaaaacatggtttgacacacaaaacttaattgataataatattaattattatttttcccaccaaatacatggccctcaaggcaatcctatgcacctccatgcagtttctgatccattctctttccggctccatgtcagtaaaggggctgaccctctgcctacacatccttcctcactattttcctctggctggctcttagttacccttcaaaattcagctcaatgatcatttctttcaagacaacttctgtgaccctcactctgatttagatgaccttctccaaactccctgagtatcttttctatttcactgtcataacactcatcattctgtcaagtacagttgatttgccatccatcttcccccactggacttagagcacttgaatgcaggcactacttttaattcaactttggaacatgagtgtctgaccaagccacatggccagatgtgctccccagtgatgtgcgtggctatgattaaaagcatggttagacaagcctgaaatcaaaccctatggcaatcaggacaagttacttcactgatagctaatctagaaaatagggatcatctcacaggattgctgggagtagcaaataaggtactatatacaaaatgctcagcacagtactcaataatcaataggtgttattatcatcatgagtgctaatattagatttttcagttacaatagtgttttcccaaagaaaacttatttttatgaccacacatcaggattcttctcatagtagataattaaagataattcagggtttaggcttattttaacaccaatttggtcaaagatctgatatgatatgccaaatcccaatggtggctaatgacacagaggcagtccatttggtttgcaataataacaacaattaaaagctcgtagtatgacatatagtgggacaatcgttggattattttcttcccctaaaggtgaagaaaacccctaaaaacacactttcaagaattactggtctattctaacagttaaatcgactctttttgaatataaatttctatgtagacctagacaaaagcataacagagcagaagtgtccgtaatccctgtacatcctcaaatcacactgctttaactgctgacaaagacaaatgtttactatggtctagcgcggagaagccaatacggtgagcaaaatgctatctcgcctcacacatcaacacacgtgccagacagattctgactgcaaagtctgttattggtgatgagagaggcagagagggcacagctggatatttcagatccacagctgagctggcagcagtgggagttcaagccatcttctcactttaaaagctggaatgaatctgtgagagttatttaaaggtgtgctttattaaagaggcactttctgactactgtcaaacttcacgagcaaaagctgaacacacagataaaggcagatctatgtggggtcacctatcagatgtcagctgatctctttcagcacccacaaatcacttattgaaaattaaataccaaaaaaaattttccttcaagattaaatgtagcatgtggacttaatttatattactaatccttttagtatttgctttatattattccctgaaattagtacaggcacaaatgccttaaattatgtttcttgaatttatagcccaaattacatagattatacaagtaccatatacagattcatgaagatattagagaggctccatgggccttatacatttaactagagctttactagaataaagtctcagtagcatcgactttttttttttttttttgtcaaacaaagcactcactctatcaaaggagttcttaaactaccaggaaaataagattcttgaacatcccaagtgtttcttaaaaagggatgtcctcattttccttttgtacaaaacagggttcagattgcaaataacagaaaagcaattcattggaaggatactgataattcacagaattgatgagaaggctaaagaacagcaagaactaaggcagcccaaggtaacactattataagtttaggagttgccacttatgctaactgcttgccaccctgcaccaaactccactgcagccacgagaatgacatcagaaggctccaaccccgggcattgtgccactgagctggagaatctaaccagccaaaccttgctggctctcatgctggggccctggctaccaggttgttgaggaaaaaattgctgccccctaccatcagcaatggaaggagggaaccctgtctccaagttcttgtgggattttctcctaagcagggcagccaaaaccagtatcaactatacatttggtccactggcccaacagacagcagaacttatctagtactacaattgaaggacataaaacagaacatatttattcatcttccaattccacagactgattctgactgaatgtgccagagtcttgggaatggctaagagtcagtctgaaccaaggcaggtgacaggatgagggctggtagaaaccctggagtgaattttcctgagcaaacatgttttgccctcttagtgtcccacttgttatttaatactcagctctcctattctacatgtattcccttctccctttctattttcctactgatacattattacatgtaagaagatgaggctggctgtgaatgtagaggaagcaaatgcctggcagttcttatgttcatacttgcatatttttgctttcctttcaccttcaatgtcttatggggagaaaatgggacaggacatacttgaagccatgtgtagcacctagcttttgttaaacacaaaaactccatgggacagtctgggctattgtttgtcactagcagtgtagatagacagaaactccttaaggatgtgtgactagccattcttttctttctttcttttttaaataaaaacattctggtttttgacatgtttgtctaagtaaggtacaatccctcaagtctcccttttccaatttgcatatcacaccataattgtgaagcaactgttacaacaagaataaaaaaaactactcatctggaacatgcaacaaaaaatggagcaatcatatttatggttagcaataaataaataaaggtccttggctaacaaactcagctttcccaaaaggaaaaaaacctgaaggctcacagtaaactatcatgttaagaaaaagcagtgggggaatgggagtgggagggaaaggattaggtaaaggcatgtattttatagaaaaggacattaggcctcatttgcttggtgaatctgtggaaataatttatgatattctatacaaggaattatgactccatcctgaacagactgcttatctccccatggctcttcacaagcaagaaagggcatgctcatgactctttgactttagtgttaacattgattttataattacaataatattggataccaaggtcctcaagggaattagacatggacagtatttgccagagataaaatattcatcaccaacagagtatataaaatgtatctgagaggatcagggctcacttgggacccacacaagaggaataagacatcaccagaaaaatgcaagaattctctgatatgtaaaaatctgaaacaaagaatgtcagtcttaacaaattctgcacatattaaaataagacctcattgtcacataatctgggggcattccagtagggcagagaataaaaaattgacctgaaattttcttagagggcttccaaagcaaatacataacaaggcccacagctctctttttaatcctattaattttaaatttcttacaaatcacaaacttctctttgcctaaggtttacgtctcaagctaaccattttttttgtgcaatctttagggttttctacatacaggttcatgtcactggcaaagtcaatgtgcaaaaatcagttgcatgtctgtacactaataattaacaacctgaaaaggaaattatgaaaataattccatttataatagcacgtaaaagaataagacacttaagaactaacttaaccaaggaggtgaaaagcttgtacaataaaagccacaaaacattgctgaaagaaattaaagaagatacaaataaatggaaacacatcccatgttcatggacaaaagacaataatgttaatctgtcaacactacccaaatggattcaatgcaatcctatcaaaatctaaataatttttttatggaaataaaaaagcccatcctaaaattcatatagaatcacaaatgacaaaacaatcttgaaaacaaagaacaaagctggagctccagacttacacatacagatttcaaaacaaacgtccggtaatcaaaagaacatgttattagcataaacacagacatatagaccaatgaaatagaatagagatccccaaaataaacctttgcatatgtggtcaaatgattttgggcaagggtgaaaagatcattcagtgggaaagaacagtcttttcaacagatggtgctaggaaaactggatatgcacacacaaaagaataaagttgtacccttacctaatgccatatacaaaagttaactccaaatgaataaaagctttaaatgtaagacctaaaagtataaaaaacatagaaacatagaaagttttttcttagaaaaaaacacagggcaaatgcttcatgacattgaatttggcaataatttgttggacatgataccacagacacagatgaaaaaagaaacaataggcaaattgaactttatcaaaactaaaacatttggtacaacaaaagaaaatgtcaatagtgtaaaaagttagtccatagaatgggaaaaaatatttttaaatcatatctctaataagagatcaatgtctggaatatgtagacaactcctaaaactgaacaataaaaaaactgttcaaaaatggacaaagaatttgaaaagacattcctccaaagaagatatacaaaaggctaattaagtacatgaaaagatgctcaatatcactaatcatcaggaaaatacaaatcaaaactacagtgagggctaggtgtggtggctcacgcctgtaattccagcactttgggagtcaaggcaggtggatcacttgaggtcaggagttcgagaccagcctggccaacacggtgaaaccccgtttctactaaagatacaaaaaaattagccaggtgtggtggtatacacctgtaatctcagctactcaggaggctgaggcagaagaattgcttgaacccaggaggtggaggttgcagtgagccaagatcaccccactgcactccagcctaggtgatagaatgagacgttgtctcaaaaaaaaaaaaaaaattacagtgagatatcattaggatggccactgtcttagactgttcctgttgctccaacaaaatacgtaatttacaaagaacagaagttcattttctcacagttctggaggctggaaagtccaggatcaaagcactggcattttgtgtctggtgagggccttctgctacatcttcacatggcagaagacagaaggatgaaaagggcctagctagtttcctggaagcattggataaaggtattaatcccattcataaggccatagcccccagacttaataacctcctgaaggcctcaccttttaataccatcacattgggtcttaggttccatcatatgaattttggggaggacatgcacattcaaaccataacagctactatcagaataatggaaaataacaagtgttggcaaggatatggagaaattagaacccttgtacactgttgggaagaatgtaaaatgatatagccactgtgaaaaacaatatggcagtacctcaaaaaattaaaaatagaattatcatctgatccaataatgccatgtctggatatatactcaaaagaactgaaagcaggatctggaagagttgtttgtacactcatgttcatagcaacatcactcataacagctaaagcatagaagtaccccatatgtccatcaacaaatgaatggataagcaaaatgtgatatatacatataatcgattactatttagctataaaaaggaaggaagttgtgacatatgttacagcatgtttcaaccctgaggacataagactaagttaaataagccagccagccgtaaaaaagacaaacacagtttgactctacttatataagatagaattagtcaaagtcataaagaccaaatgtagaatggtagttaccaggaaataaggagggggatacaggcagttattgttcaatgggtatagaatttcagtgttacaagatgaataagagttatgaagatgtatgctggtgatggtggggatataacattataaatgcatttaataccactgagctgcatacttaaaaatagttaagatggtgaattttatatgtattttacaaaaataaaaaaaaattttgaaaaaaaatcccacaatttataactcatcccaaacctattcctcctgaaactttcctccttagttaacaacagctccattttttcagttgctcaggccaaaaactctagaataatccttggcacccctttttctctcaaaccacacatccaatcaatcagaaaattctgtcagcaatagcttcaatatatatacagactccaactacttctcaccacctctacccttaccaccccaatctcttgctttgattattccaaaagcctcacactggctccctgctttcactcaaacctccgtatagtctatttacagcacagtagccagagtgatcctgttaacatatgtcagatcaagtctcttttccactcaaaatactccaaaggctcccatctcactcaggctaaaaattaaagcccttatagcagactaaaaggtcctataaaatctgcctccttcctccttcctcccccactcctaattatttctatgacaacatctactactatttcttcactcagtcagttactccaagcaacctggccttcttgcagttcctggcccacgcttggtaacatccaacttcaggacctttgcacttgccattccctctgcttagaaatctcttgccctagatatacatatggttcatagtcactcctttatgttgtttgggtctttgctcacatatcacctttcagtaagacctgccctgattactcttaaaaactgcacatgtaccctaaaacttaaagtataagtaaaaaaaaaaaagccaaaaaaattgcaacctttcccaccacaacatgttctaactaccttacatgttttcccacagaacttactgtcttcttacttactcagtaatttactatttatttgtttattgccagtctcccctcactagaacataagtcccatgacggcaagattttttacaattgttttattgaattatttcctaaccttttatcattggacagaggttgatggaattctatattctagccgcatttttcttgaatggaaggaacatgcatccttttaaatcacatcctattaaatttggcaaatcttatacttttatgtgactcctcctgtgttttgtcttcctctagaattataacactaaggtcatgctaatgacaaagagttggggtggggggcgggtctagacagagttttaaagttttctaatctttacaagaagacacaagaggagaaaccagtcagtctgttgagagaaaaaacagaaaacgtaagtgtcatgaaagtaagaaaacttaagtgtttcaagagggaggaggtaagcaactaagatgaatgcttctgagtagttagatcagaacacacagataaccattgtatctggaaatatggaggatattggtgatcttcacaagcaccatcttactggggtggtgaagacagaaatcaagagtatgtatgtaggtccagtgacacttttcatttgacatgtttcacgtaggacattccttccattcccatggcttctactattttgatggcttctgaatcccatatctgcttcaacgtcctgctctggagagccaaactagagtttttaaacttcctgttaaacatctctatctagatctcccttaagtactctcaaactaataaaaatccaatttcagtatcaatcctaccacccacaaaagaaacttgttccttctttctatatttcctatttcagtaaattgcagcatcatccaatccatcatccaaagcttatcctcaatcctgtgtctctcacaatgtccaaaattgatacaagtctcttacttgtattgatttcacctcttaaatatttctgtaatactctaatccaggggtcctcaacccccaggcagtgaaccggtactggtccatggcctgttcggaaccaggcctcacagcaggaggtaagcagcaggtgagcaagggagcattgtggcttgagctctgcttcctatcagatcagctacagcattagattctcatagaagcgggaaccctactgtgaactgcacatgtgaaggatctaggttgcttatgagaatctaatgcctgatgatgtgaggtggaacagcatcaccctgaatccatcccctccaccccagtcgatagaaaaactgtcttccacaaaactggtccctggcatcaaaaagcttggggacctgtgctctaatctattcctattgttttacaataaagccttcatttttttttttttttccagaactgtaactacttcgacttatgtactctgcctagcacatcataggtgctcaataaatatttgttgatttcctgaaatagctcacatggctctgttataaattgctcagatctaggtttataaaattaatgctttcccttaaaaagcttggttgaatttttttaaaaaactgaataattgggggctaggatgatattaaataattgggggcatggatgatattaaatacagttatttaataactgtaaataaaaacatacaagttctgttggatgtgggtgtcccctgggagactatggtagtgaacactaaaatcctaatcgccatgcattggaattattccgactattactttctttagttccttcttatccacccagtcttctttgaaaacatgtttccccttcataatttagctctatattgtctaaaagctataacttcaatcaaagaacttaagcatttttaaagccaacaaaatacatgacatcaattattatcagaggcatggacccactgcgatgttcattttgaacaagacgagataagtcattcctggaagaacataggcaaggataaaagatgattcaagcctaatatgcaaggctcctcacctctccatcatttttatgagacccacaacatagtcttaaccccaataacctccatacggcctcaccaagaaaggatagaaaagacctcagaagtattttggccctaaaacatttttgaatcaagctagagaaagttatgaaactcagttgtcacacttgacttgcatccagaaacacaattcaaatgaagcatgtagtctaaatggctgatagttttcagctggctgtactttccagccacctaatatgaaaaatctaatctcaccctaataaaaatcttagacctggcaaaaaaagaaacatatagctttgtggtaacgtgaggagaggagggaggtaacagaaatggtagaatgacctcacagggttttgacttttaaacactaatatttatagattaaaaactgtctgaaaggttaagcttggaaagaatctacttcagatacctgatacagcacaggcacaaaatgaaccatgtttgatctaacttgtaccaagggagaattttacctttagctttaccaacttcccaagaggacttctagtcatgctccttcaaatcccaaaggcctgcgtagtgaggtatgccacaaagagtagggtgtctcagtcctcctctactagtagatggaagtcacaaggagatatctcgagacattcaggatgtttatttactcagaaagtaaatctacattccttttgtccaacaggcaatatcattcttatttctcaaggcccaaggtccataactacttctccccacttaaggcttacactacattctgtactctcaaaatacttagttaatgttgctaatgtactatgtacttcactatgtacaagccaaattaagccacctgtggtcaatatatacctgggcagcaaggctcaagatagatcctatattcagacatcatcaatgaaaatacagaaaaaaatcaacccagactttactgtatttatcctttattcattaagaaacatgcaaaaagctcaggagaattttaaaaggttacaaaacatggtgatggtttaaatagctactacaacaactgaaggccccacagtcatttcacaaactagagaaggaaataatttgctccttccactaatctgacagttggcccaacctctgatttcaggagaccttttttcttttatctctagtccacttataagcacatatgaggacacacacttaatttttctctattttttctcatgtctaaagtaatacctgtaatgaataagttgatcaatcagaaatgtgtaaaggaaaaaagaaatgtcccttcatattcaaccctcctagagatgatcagtgctcaatccttcaacttttctatgcatatactaatatatatatacatctttctcttttcttttagtacaaaaatggaatcatagtatgcatacagttatacaactagctcattattttcctgacaactatgtattagtcccattttaggatgagaaaacagacccaaagaataggtgatttggcaaaggtgactcagctaataagtgatggagtgggaatcaagcccagaaatctggctgcagagtttcagtgctccccttccaaatagcagaaaagctgtagcccatcttctcctgtgtgctaccaagcaaacctgtgaatatgctaggacatattcatcaaagcagaaaaggattctacctgactctttttaatgtcagcatagaattctattgtatggctaccccaaaatttatcagtctccatttggtggctaaatacatggttaattttaaactatatagaatttagatttttagagctagaaaataccttaaagagtatgttttatgacatcaaaagttctcaacatagatgaacttactaaagccccaaatcttgaagcacattcatcaaaaagatcacaggattgcttggtagcagacaggagaaggtaggctgcagctttttccactatttagaagttgaacactcaaatttgagagccagatttctgagtttgattcccactccaacacttactcagccacatttgccaaatcacctaaaaaactgggccacctttgccaaatgacctaagttacatatatggtcctgttttctcatcccaataatgggactaatatacagttgtggtcaggactaaattagttataatgtaaaatacttagagtattgacttacaaataaagcagtaagtggtaataacaataattattatttatgccatactagttcaagcttaccttaaaaaattattaaaatttctgttctcggtgtgggtagaacagaaaacacaaacttttggttgttatttgagattttggcatttacacattcagtgctctttcttcattattctttaattattaaaatataaaactgtgattaaacagctgcagtgggatatattgaattataaagtatttgagtatattaaactgaaatagaattctaaatagaaatgtgaacatacagttatgccagaattgtttgttacctatagaagcctccttcaaatgagaaatggaagaaaacaagaaaataaaaatcatcagtgccactgcattttcattcatatgagtttcacaataaaggatgaaaactttaaactctgaagaatatactagtcaatatatattgattcttcaatagtaaaaacacctgggatatttttgggaaacagataagttcatttcagttcttcacaacacatagatttgtacttcctttcatattggtggtatttgttttcagtttgttttttttttatttttttacttgaacagactagactgaagtgtagtagcagagtccaaattgtttgaacatctttcagcagcaagaacacaatgttatctggcaattcattgtaaaaaagcagcatgaacttgtctgggtgctctccaggtaatgagaaatatctcatgaatgccagggaaagaactttaaatgactgctcttttaacacacctttcaggcaaatgtcttaaggccactgtcacagaaaagcacctgattgggagggggatgcccctacttcatgatcacactagcttggaagataattaaaactaatccttttacctgcctacatttcttacaagcactctgttcagcacagtacataaaaaagatctccatgttttgcaccaagattcaatcagtacttccacattttggggggaaatgcaagtccaaacaacagctcattcacttatttaaaacattcagctattttaaaaggcttagaaaacagagcataaggagctgaaattgtggcaataatcaatagcttaccaaccaaaaagagtccaggaccagatggattcacagctgaattctaccagaggtacaaggaggagctggtaccattccttctgaaactattccaatcaatagaaaaagagggaatcctccctaactcattttatgaggccagcatcatcctgataccaaagctgggcagagacacaacaaaaaaagagaatttataccaatatccttgatgaacattgatgcaaaaatcctcaataaaatactggcaaaccgaatccagcagcatatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgttaaaaactctcaataaattaggtattgatgggacttatctcaaaataatatcagctatctatgacaaacccacagccaatatcatactgaatgggcaaaaactggaagcattccctttgaaaactggcacaagacagggatgccctctctcaccgctcctattcaacatagtgttggaagttctggccggggcaatcaggcaggagaaggaaataaagggtattcaattaggaaaagaggaagtcaaattgtccctgtttgcagacgacacaattggatatctagaaaaccccattgtctcagcccaaaatctccttaagctgataagcaacttcaccaaagtctcaggatacaaaatcaatgtacaaaaatcacaagcattcttatacaccaataacagacaaacagagagccaaatcatcagtgaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcatgaaaatagccatactgcccaaggtaatttatagattcaatgccatccccatcaagctaccaaagactttcttcacagaattggaaaaaactactttaaagttcatatggaaccaaaaaagagcccgcatcgccaagtcaatcctaagccaaaagaacaaagctggaggcatcacgctatctgacttcaaactatactacaaggctacagtaaccaaaacagcatggtattggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacatcttatacaaaaatcaattccagatggattaaagacttaaactttagacctaaaaccataaaaaccctagaagaaaacctaggcaatactattcaggacataggcatgggcaaggacttcatgtctagaacaccaaaagcaatggcaacaaaagccagaattgacaaatgggatataattaaactaaagagcttctgcacagcaaaagaaactaccatcagagtgaacaggcaacccacaaaatgggagaaaattttcgcaacctactcatctgacaaagggctaatatccagaatctacaatgaactctaacaaatttacaagaaaaaaacaaccctatcaaaaagtgggtgaaggacatgaacagacacttctcaaaagaagatatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaacaggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttatggcagcactattcacaatagcaaagacttggaaccaacccaaatgtccaacaatgatagactggattaagaaaatgtggcacatatacaccatggaatactatgcagccataaaaaatgatgagttcatgtcctttgtaggaacgtggatgaaattggaaatcatcactctcagtaaactattccaagaacaaaaaaccaaacaccgcatgttctcactcataggtgggaattgaacaatgagaacacatggacacaggaaggggaacatcacactctggggactgttgtggggtggggggagggggcagggatagcaccaggagatatacataatgctagatgacgagttagtgggtgcagcgcaccagcatggcacatgtatacatatgtaagtaacctgcacgttgtgcacatgtaccctaaaacttaaagtataataataattaaaaaaagagaaaaaaaagaaaaaaataaataaaaaaaatttaaaaataaataaataaataaaaagaaaatagagcataattgtgtatcaaaatgacaagtcctcatcggaggcactgcatccaaatttgcttacctcaaactttgagaagcagccaagatatgaaaactctagagaaggaaaaacttatgccatgactggcaataagaaacaggctatagaaacaacaagtgtttacaaaccaattgagggtacttaagttacaccaggaaggataataaaaaaaaaccatctcaaaaattagttgatataatcataaaccaacaccctaaaagggttacctgtactagggttaggcagaggtcagtgttgctctgtcctcacattcatggtatgactgagagaaaatacagggaatatcttaacttaggtgccacagaaaatacatttcaccctggcaataagcacttcagctgttgatggcaaactttttattcatctttccatactctatcacagataggcgaaaacaacaactcaataaactgaaccataattatacttcttctgcagtgcttcttctcacactttattgaaacatcacttgttatagtaacaaaaagcctaccttctcaactaatcggatttactttcaccacttttttgcagctcagttggatgatcacgatacatacaacacctacgccctttgtctccaattaaatccctcaaattcagtgggttaggaaaaaaaaaaagagttgagtgattctcatttatctcaatagctttccttggttttaccctcagttcaaatctatggcttaccagagagaagaccagagcgcaatatctccgtggccttagtcctgactctataatgaatcacttttagtttcttttcccaggtgcacctctttccatctttctcaattccttcaccctatacttcaccaactaccccacacgctcctcaccctacaccttaccaactaccccatacccaccacatcaccatgaaaggaataagcttttgtgttttcagagtctgagatatgaataagattctttccttggtcaaacttcagttaggcttccgaaccttctcctaaacccatctgtgcacttctttgtgaaatcccattttagcaaagagcctggctaagtcagttcagcaagaacccccatatctaatttgatcatccttctcctccaccatcccccaggtgatgtctgatcaccccagccagtcttccgcaagaatcctgttaggttggtttagccagagtcccccttaccccttatgcttcttcttagtaattttccatctactgatccccaccctgctctttggctatgaattcctacctccccatgctgtacttgaaattgaactcaatctttcctcttgcactgcaagaacccaatgcagtggtccctatacctatggtgatggtcctgaatagtcttcctggcctttactgagcatcattgaataatttttctttaacatgtaaccctaagtcacaatggaccatctccttgacctcctaactttagtaactagggcctcttagaaaacctcaagtcagaaatttaaaattatatagggataaaaatcaagagagcaagctatgtaactggcaggaaattcaaagcaagaaggaattccctcacagcacaaaaacatgggtaccaactagagtatatggcacaaataaattcgaaatttgacattttaaaagtcatatgaatgagctctctctttagctcaataatgactcctgtccctttaagaagtttattatttaacttatttcttaggcaagtataattaagaaacaaccactcatattgtagaataatcaaggcagaaaaattatatgtatttgtgtgatacagtattatggtaggcagaataatggctcctccaaaagatatccatatcctaacccctggaacctgtgactgttacgttacatggccagggggcatcaaggttactaatcagccgaccttacaaatattattctgaattaatccaggtaggctcaatgtaatcacaattgtccttaagcagaaaggaggaagtcagaagagtcagaatcagggagatggcattgtaagaaagactgactaatcactgctggctttgaaaatgaaaaggggccaatagccaaggaattcaggcgacccctagaagctggaaaaggcaagaaaagggaatctcctctaaaggaatgcagcctggctgacatcttagtttcatcctggtgagacccattttgaacttctgaccaccagaactgcaaagtaataaaatggtgttgttttaagctacttagtttgtggtaatatactagcaatagaaaactaatacaagtgggatgccaaaaaatgaataataaagacctagctcttttcagttatataaaaggtcatttcatatgcaattatccttaaagtatttggaggggagggtgttgtacttttgttttctttgtacctatttacaaggtttcctaaagtcaaattattatctgaaatatcacctttcatgaataaaatcaatagaaaaaagtcttcatagatttctgatgtgccagaatatatccaatacataagcaatatataccagaagtcctagggaagcaccatttttccattataaggatagaaaaagttaatgtaattattccccattctatgccatgatttcagggggttccctattttccatgtacttatataaagctcccaaattatctttaaaataatcctagcttgttttctcctcacaacttggcctcatttactctcctgaatcaacagtaagtcccatcccactccacccttactatactcagctccccactcccccctcactgttaaatacacatttcttggtgtaaacctcagaggacacaaatcggctttaataccaacagaaaatataattatccctaatcagatacaaagagttttaatatatttcaaaaccaaactgaataacatttaacttctcttggtcacttaccattaacattaactatatagcatatcgccaagaatatcgacttttttaaaaacaaaatacttcgcagcatcacaactcccctttctcatctattggaatagattctggataatcaactattttatatttaacactatttgatgtctttttataagcacaaattaaacaaaaataataatctcttgtttttctttccttatataaagtctttgaaagtatgagaaaatatccaatgactaaagtcaattttataaaattatattttgggagatctccatgtcacatacacaagcttctacctcccctcagtaacactggttttaagattcttgaagataattttaatcatgacaacatttttatgtatgtgtagaaccatcagctagtactattccatacaaggaatcactcactgttggtcaataatgttttcagtaatccaaagtgaactgaggaaaaccaagaacaaaaagggttggttggttggtttcccataaaactaccttttttcaatttaaaaggacttatttattcaaagattataatgttcctacaggcaggggcaggagggtattaaggtcatgaaatgaactcagtaatagtccctgagggttgtttttctaatgtccttattggcaaactaagtcccacctttgcccaccccgccaaggtttttttgtttgtttttaatattatggttctataaaatccaaaaatctggaagctgctacctaaacaactttgaaaatttgagtggtaaaggacatagtgttaagttatatacaattttcttttcgagagaggaaatcaatgtctgtgtttgtaaaatgttaaccaaaccacaaaatatctttttgtgataattatattaataacagtgagggtgaagacaagactgaacttttccatccatgaagacacatgatgaaaaacaaatcacatataactattatctacgccagactccattctatttgctgtaattcccacaggagacatgcaggaattctgcactgcccatgttttcagaaattaggactttgacttttccttccctctgcacgtttctgctgagaagccagtcttaaactgtcataaataaggtaagacttttggcagatgcacactgcttcgaattgctcatctgtacctatattgcctaaatatgaatctccattatccccttggcaattacattaactccagactgtggccttcttaaaatccagacaaattacccaatgcccatacttctttctagaaactaaacataatgtacacactctaaagtttccagtcaagtcttgcactttttttctcaacctctttacatttcagtgcagatgaataagattttaaaacgtaaaggagttgatgcttaaaagcacaccgtaggtattgtggatcaaaggccataattaaaggatcagttctgaacattgtgctgattttggagcaaacaaagctcatttagtagttatcgctcagaatccaatccaggtatttgtgtagcttgtgcactgtttttcatggaagtacctggaggaatgtatagtcatttacgaagaatcatctttgctatcaattcccttgccttttttttttttttccttgagatggagtctgactctttttgtccaggctgaagtgcagtggcacaatcttggctcactgcaacctccacctcctgggttcaagcgattctcctgcctcagcctcccaagtagctgggatttacgggtgtgagccaccacgcctggcctcccttgaacttttccaactccttggttgcacactcctcaaaaatcccaacaactgcaatggcatgaagagcgctcactttggatgaagtactttccaagcactttgggaggattattgtttttaatcctcataactcccctgggaggtatacactttacatcaggcccccatgacggtaaaggcatctgctcagagatcgcttgcccaagatgacactgctaacaagatctgggatttgaacacgagtctaatctgctttcaaaacaatataaaccactgcattgcactgcctgttagggaaaacccatcagggaataaaaaggtattccagctagtttgttccaaacagaacaaaagtttagggaccacccttggcaaaataacaacgtcccagaatcattgcctctccttactggctggcccatctgacacttaccgaagagcagttctttgcctttagagtataaccttacagaagctgagggctttgttagttaaactattatgctagaatcccaaccagaaactgaaacctgatatcgtgttcatgattaatcattcaacaaatcttatttgagcaccaccataattaactgttaagtaacttaaattctgctgtggaggactaaatatgtgaaagccatgttcctgtcctctaggaactcctggtcaaaggcacagtaagaacaaagactgctccagaaacagtaactaaagttacctgatgaccgaccaactctctaacttccttgtccttttcctcaaattcataattttctggtgaatggagaagaaagacatgaacactgtttaatacttaaaaagtatctagtggaacagactaaattgtcctccttcccccttattcttcttctggtttggccctttctcctccacccccagaatctgtattttttctttggctaatctagattaatgataccagattaagagaactggacaggaaaaacaaaacaaaccaaacagtggcagtaataaatagattatattgatctggcccaaagtctatgtctgtttaatgctagtagttacatagtttatgtagagttgcaagggggtaaaaaactaatcccagcacctcaaataccataattaggacttctcgaagcttgaaaagggtgccagtaggatcaaccttctgagtttgtactcttcattcattcaacccatattgactgagtgcccaccagtgccaagaggtagatatttatagtgaacaaggaagatatgcccacagccctcattgaagttatagtctagaaggaaagtcaatagtaaacagagtcagaaatgcatgtttaaatactgtcaatgagaagcactatgaagggaaagaacagggtgcctcttaaaagtttaccagattgtataccgttatacttcaaaaagctgagagggaaagaaatctaagaggtaagtgatcttatttagatgaagagttaggaaaaccctctgtgggggataagaaaacaaaaaatatcttagctgaaataattaggagttagccagacaaaaaaaatgaggagaacaacgtttcataaagaaggaactatatttgtgtaagcccagaggggaaaaagaacttgatttgtcatagaaattgaaaaagctagcatggtcaagaagtagccgtcagggaaagaggagaatagaaacacaagaaaatgtaagggcagccaaccttatcaacacacctaaaccagaagtcttcaaatgacttctaataatgtctctgatacaaaatcataatgaatatacaaagcccagatgtaaaaaagtaagcaattaaaatacaatgcattttcaaaattctcaagtgaccaagatttgtaactggaaaggctcgtctagtccaatgaaccctacatctttcaaatgagaaggggaaccccacgcccatgcgtgagatgctgtcatcctctctgaatctcctttctcaaagcacccacgttcctctagcagagaggagtcttgcttttcctgaagggttcttctacaccacatgatgacaatatcctatacaaaagggacacagaagccactggacagtaggtgcacaagatgtggcacgatactaactcccatggcccctttcaatatacaaatgtatgtgggtatctgtctgcacagggagactaagagaattttaaaaagaggccaaactgcacttaaaactcctccagaagagatattttacttcacccccaatgttacctcttcttaaaaacatgacagttacaagcatctaaacacagacagagcatgcttctatttagtcttattcctgctctacagaattgttcacactgcacctacactttctgaccaaaccgcctattgagaagacaatctgcagttacacaaatgagaaaagacctctttaaagtggcaggttgaatacagtcatttagttccactttctcctaaaactgcactaaaatgattttaaaagacatttttttaaaaaagataaacacacttggacataaaaaataactacattttggaaactagaaagcagaagaacaagtggtaactggtccagcagacaagaagctgactctaaacaggcagtgaaagaaaggtgggccacaagacagtttgttccctgggattcccaagaagctcaggaatggctggaatccaagatcccttataaatgggcatgaaggagggactaaaaacaagaggattggttcagatctctttaaagaaggacttaagagttctagatcctctctccgatttcacaagctgggcaactggctctgccaccctggtagaaggctacaccttttattttctgtactgaagatcactaggcacatattaaagcaggagtattgtacagaaaaggagaattaagtaaaactttagcatagtgaatattgagagcccaaggccccttttcccccttgcttcccccaccactgaggcccaggcttacattctccaggtgggagcctgaaagattcttctttggaatatctaactaccccaagagagaaaacctaaagatatgttattgggagctctctgataaaacagccaaatacccacgggagaaacacacagtagataaatctcactcttgcacacagaactctgaattagcttcaaatgccccacttttaaatataaatagacaagaactgccaggcgtctaagaagtcattaatatgaaagacagaaacctaacacaggaaaaaattttttaaacttggggtatgcagaactatacaatgagatgaaaatctaatacatatatacatgcacatgcgcacacacacacgcacacacacacatattcacacaccaaagcacaccatgaaatttcagaagactggaattgccaaacaggattaaaaacaaaatcatcaccaccaccagaaaaagtacttcagatacaaaatgttcaggatcaaaacaatgatgctgctctggatagcaacagctagaagcttagaaataaatggcatcatgacttcaaaactatgatggacaattatttccaagctagagttctataccaactaaaccatcagtcatgagtccaataagcaaaatctcaaaaaaaccgacttcccatgaactttggagtaagctaaagaacacaaagacctggaagccagcaagcatcttacagaagaaagggtcccctcaacatgataattcagggggccccccagtgacgacagccatgcagcagggctggtcaacaaccagtccagattggcgtagatcagaagctctgagagaatgtcaccaagaagatgaactagatacaattttatagcacacctatttgaaattatgaagaggagatttatacaactcaagagagacagaatattgactgaatgatgaggacgtagcaaactaagtaaatgacaaaataggacaatgactaactcaagagaaagtagagtttaataaagaagaaatcataatatgacagcaatgaatggcatttataaaggcataataatgtaaacacatggatttacccaaaatgagaacattaactatatgggcagaatgaaggagtagggggaggtaaagatgtgtgttggggtgaatggagagagaaaagagcgaaatcctcaatttccaaagcagaagccaatagacaatgcctaaacctgaaaaatcaagaagtagctatataagtacattaactagaatgatggtggtaaatataaaaagagaaagagagagagagagagagagaggctaaatacagtagttgaaatggagaaagctagagaaagagaagttagagagggcatttgaagggagggaaggaagaagaagttcaccattgaccactggttttcacataataagttctataagattatttgatcttttagaaaatgttcatatacaaccctgataaaaataaaaactaaataataaaaagccaagaaatatggactagaattgaatatccatttctgtctcccttatactattagaaaatgtatacctgtattttacagcacaagtagtaccattctttttaaaggactattttgaggtcgtctttagcttaaagcacatataatgaaaaaaaaaatcattcacctcaggtcatttcttttacctagacattggccagacatgctgtataaagagactaatttttgaacagttacttgcaaagtcaacattcttccagagtgtttgaaactgacagcctttcttattttttatcttttatttattcatagcctatcttctccctcaaagaagtaagaaagctatctttttcttacatggcaactttctcttcaaaatataaagatacacagtgacttagaggattatagaatgctaataaaacagaagagctaaggagttctttgaaaaaggaagaaaaggtgaataaatggtagaaataacattaatttcttctttgtgtcctaatatttggcttgaatacaatgccaacttttttttccttaatgtcttccatgaaagctgaaaaggcaaagaggcataacaagtaaaattaacaaaaatatgctttttctttgttattaagtattcttctaaaaagcaagacatttttaaacgtacccacttcaaaatatattgtaagattctgtgacacaggcatcattaccataaaatcctcccaatcaaattataattttctttttcatgaactatatttcttaagcaaggcaagaacattttattaaaaataatgcctattatctattttattttactataatccactcactttccagccaatttgctccgaatattctcttggaaacttgtacttcaagacaatggcttcactcattacgttatttcaacaaaatgataaatgtattgtgaaatatattatatttgattatcaagctaaagcattgcaaatggccatcacagaacccaaattcacccataacattctatcccccagaatagtcctctgacaacaaatgataactgtacatgacaaatcctttgaggcatctgggccttaaaaattaaagggccattctgactaaagtatgttgattttccaaaggaagttttgttgcagttgttgctgctgttgctattatttgaattgactaatcctcaagtaggttctagccaccctgaagaatatttacaaatacaaatatattagaattgaaagagaccttatatgccacatagttcaatctcttttccttgagatgcaaaactgtggcacagagaagttaattcagttgacaaacaactcatggttaattcagtctcatagaacccaatctagtgctttttctgcaataacacattacagagtctgcaaaaccagcacaattactacctgacactgtcagcaaacaaaatgaaaatacacatattttaataagtagtttttgcttatttttgcagtcacacataagatgttatatctttacacaaaacgaaactaggattatttttattgttcaaaagacagactgtccaattatagctattactgaactagaaatgtattttcagtttatcttcccaaatcaagttagtggtttgtttggtatgcacaaagtattccaaaatgtcacagagtgggggctattgcagggttttctcctgcttccaccagaccacaaagggcaacaagtttggaggggacaggaaggttgggagcagaatacaaggagctgtagagctgttctatcggttcaggttttaagatccatgaatagaccctactcaccgagtgaaagccctgacaattttatctgagcattagaaaataattccttgggcagttaaaagattggaatatcaaagagctgacattagttttaggcagcgcttaaatgaaacacttttttttttttttttttttgagacagagtttcacttttgtcacccaggctggagtgcagtggtgcaatctcagctcacggcaacctctgcctcccaggttcaagcgattctcctgcctcagcctcgcgagtagctgggaatacaggtgcccgccaccatacctggctaattttttgtatttttagtagagacagggttttgccatgttgggcaggctggtcttgaactcctgacctcaggtgatccgaccgcctcagtctcccaaagtgctgggattacaggcacgagccaccgtgaccggccaaatgaaatacttttatactcttatcttacttttaaaaagaatatgataatcagagagttcaggaaggaaataaagaggagtagataaagtccaaaatgaggaatatgcttatctggagcacacctacttaaccagaaaagagtaatttgagtaggaagaaatgccaagtcactaatttgtttaaggatcttggttattggttgattccattaggaatgtgtctggctacaagtaacagaaaattcatgttaggtgctttaaacggcatcaccaaacctaaagggccagagagtaaatatttaagacctgcaggccatatagtctccgtcacaattactcaactctgtcatagcatgaaggcagccacagtcaatacgtggctgtgtttcagtaacactttacttacaaaaataggcaatcagccaatgggtcataatttgccaaccaatggtttaaccaaaatgtcaatccctggtttaaacaaatgagacttaattaaaaagaagctggccttttttgtaaggtagtaagaagggcacatcagctccagatgtcacatttctgtttaagaagaggaaaagggaaaaggaaggtagaaaagggaaaaggccacatctgtcccttttcacaggaaagcaaaaactttccccacagaacctcaagcagaccccctcccccataagatcactagtcagaaccgagcaacacagccacatctagttgtaagagaagctgagaaaacagggaacacaggagtctaagtggcttagaccaatcatggttcattcattgcctggggctagacacattgctgcctcagaccagggtattttagcaagaaggataaatggctattgggtgtacaatgaacagtgtttgtcctgttggactattttttctgttttctctattggcataatctgctcaaagaaaatatgctttcttagctgtgaactaattagtcaaatggagattgagaaagattaagcatgtttggtggtaggggtggggaacaaataagagtgaatctactgttagctacctaaaagtagtgatttaatgggggggagatgcagagtgagaaatctgaatagcagtcctgccagcccagttttatgaccttagccaaaacacttaacctacccatgcctctgtttctccaactggaaaaataaagttgttaaattagatgtctctaaggtcccttgacacactaacatcctgtatctcctttaaatatgttgtctgatcaagcaaacatagcataatgtatccagttaaaatttcctcctaaaaatagtaatgcccaaatcacaaatgtggaggattcccaggcagaataaagttttaaaccaaagaagaaaaaggattttattgaaataacttttcacacattgctaaaacactggcattccattcaacccttccaatttctaagaaaacacacgtgtaagaagggtagttaacttttttaaaacactataaatgtgtcttgtaaaaattatactgtttcttacaacaaacttaaaatagttctcaagtccaaaatggtaactgttctagctagacgactaactgaggatgctcgagtcaccccctccactgccacaaccccaaataagcattgcaaaagataaggtggcaggaagtagatttacttttgagatgctctctcaaataaccgcccttttaacaatgcactggaaattaatcaaaacacagtcaggaccattgaggttccttaagaaacagacttttcaaaaggaatccaaatgaataactcttttagcagtttgaggaaaacaggaataaagaaggaagacaagaagagaggcaggaagggagagggagagaacgttctggaggaaaattttgtttagcaaaaatgttcccatatttttttgagaagtcttccagttttatatccatatagcagagataataaaaatcttcaataaatgggtcataatttatccaaaaaaataccacaaactaagtgaaagctctaacactccaagaaattagtgcagaaaattattttaacttagtaccattaacccaatattcaaagatttgaagatggacaaaactgaaaaaatccatcagtttattgtttggaaaaaatgtaatcttttgagatttaatttagttgagcaacaattgtttttgctacaacttatcagatatacttacgactaaatttgaacacatatatgagagagaagtcttttaaaacaggccaaaatagcagtcccaaacagagtaatcaaatgattactgtatggcaagagcaaaaaagaaaggaaggaaaggaggaagagatggaaggggggaaaaaaggagagaaggaaggaagggggcttgatagaaggaccactacccagagatgcaggggctgctgcaggttaataagaagccttcagctccagcacatttaatagagaatactttattcactaactgatataactttgctacagccactggagtagataagagatatctttccagtaaaaattctgcaaagattctgccctgtactagaacaggcagcagttctcaatcctgacataccaaaggggttagcaggagtttccccaaatgcccattctcagacagatgaaagaacttcctttgaaaaatgctggagcttttcacctccgcaaagcttttttccctacatattgtcctctgtggccatctcagcattttcatcagctcccagcctcttcaccatttgtcatttgcaccaacatacaataggaaaacacattttccgacatgcctcagcgtgtccaggatgagatgcaccctcactactaagccgcattacacgaaaatgtgtgaaatgcattgcttgacccacttacacaaaaagacgcacaccatgtttaacacgaaacgtcctgaacacttcctgtggccatttccattcttctgacttcatttcaatgattgagaacttaagaaggtttgggtcatatttatttatttattttaaaccctcatgtctctcactttccttgcaggaacctgtgactcttgcatagcatagtagctgtgaccccacattggaaggaggtatgatcaaaggcagcctggccagacttgggaaaacatttccactgagaatggacatactgcctgtcaaaaggttattcccaccgcgttggggcagcagatcacgttactccagagtaacaacatgaaagggcaaaatctggccatagtcacccacatacgtgtttttctttccaacaagggcaaatgggagacaccagccagagcagaacatccttcttatcacttgagggggcttgggggtggggaggaggcctttccctaatcaatactgctcctaagccgcagccactgtttaatgccttttatatttttcttttcattcagaaacagctcacattcaacaagacttttctgtcttaaagttttttttttttaaatccaagcaatcacaagctatattctgtggaagacaaaataactttggaggcgtaaatcttaatgtcaatgacaggaaggctttggtgaaccattaccataaatctgacaaacgctaatttgatgggtggctgtatctgtctgctgcacggccagtctagacagtctattgagaaatcctaaaacacaactgtttgttccctgtaacaccatctggatatggcaataagcgccgacccagcgccattcacacatggatcaaagcacatgctaatgctatcatgaagtcatacacataaaaaattcaatctgagaactcgaagcaattttcctaagtcttcagcgaagaaaccccagacttagtgcgactcaagctaagtgcgcgaaggggggagggggggaaaaaggaactgaatatttaatgagcttgggcttccagaggaatgttaggccacccattgtattggaaaaggctcatgtcacacttcagtcatggtacccgtcagggtgcccctttacaaaaattgatctgaagacctttgtaattacctgtttcagtcaggggtggggggctgggggagtggattcatgacaagaaataaaagaatggatccaaggtgtaaatctaacattacattatattggtctgagctggcacaaattttcaatattgcatacaatattaaaaacctttctcattaaactgcactgtggcattagatcaaagaatcaagggcctcctattgaactcctttaaatattacaaacataagagcaagtctggctgtgcataaaatagaaacaaagccaattttttttgtccaccctcatcctatagctggctggagagaaacattgcttgagaaatctattgtaagtcaaacacgaagaaactttacttctcgcaaatatttaacaggcataaatgaatactagtctctagaatttcactttgacagaaatttttcagtaaatatgttactccttcaaaactttaagctactctttcaaaaagtatcactcaacagcatcacttcaattgcaaatcatagaggcagtggtttcatcctcaccaccctgtgatccaaacttctcaaggaaacaaagttcttactacacgggggtgttattccactgtgtacttctaaagtaactttgactcatgtgcttcttggctggcttatattgtctatcagtatctgatggaagaacataactaacaaatatcttataaatttgttattactatacttatctctgtttgctgggagacactgcatatgttatatcccaaatttccacatactcagcataagctatgcgcaaattcccaccagcacattttattttatagcagttataatagttgtctctatattatgggtatatgtatatgtatgtgtacacacacacacacacacacctaattaaatccccaaaatgtactaatcattccatggagggtgagtaaaaaaatataacagaaaaatctgttgggaattacatgctgtaactaagtgcttcagctagcacaggttgtggcttatgctgcaaatttctagtttatacagtagttaagagaatgtatataccttagacccgtacaagttaagcataaaatgataactgaaacagaacccatctacttagactacccagatgttttatctctttctattctacctgctaatgcctttaaagacaatagagaacaaaaaacattaacattacattttagttttttaaatagtttaaggtaaaaacaaaagccagattaagtctctaatcaatcattttacaattctagatagaaattaggtaaagaaataggaaaacgagataaacagttaagccacagttttcttaaaattcagttcgatttaaaaggaagatttatcctcccaaagtattttgtaaaacaaaatatatttatcttttccaatggaattttagtaagacaatgcttttctttttttttttttttaaaaagggagaaaacactaccaatttcacctcccatcctatatgaaatcttccctaaaaatatcttaaaataagagaagttcaggaaatataccaattgcaaatttactgtgaaagattccattttaaatgatgatcacagatcgttagttatatttagcctagagagttaattattataatctgaatcacaaagacaaacagaagagcagcctatttttctgtaatgcatgttcctaagggacctgcaaaaaactaatataagaaggtaaaccacccttccctaaggatagcgttattccctgactttccaaataaaaactgtagagatattagctttcttcatctacaagttagttgtatatgccaagatatcttagcagagttcaaaagtattccatttgcaaggcatacatgtagacctgtaggggtaaaaagaaataaacatgttcatagaaatgtacatctcagatgattcaccgtaacgatcagatgttaccctcggtagaattagaggaaaaaacactgatgcaaagtttaagtgagaaattataatcattattgttaaccattttatatatttatatagccattttacaaatataattaaaaatcggtatgtcattctctatgttggactaaattacgactaagaatttgttgtctaccagtaatggctttctttcaggctgtggctataattctgttaagtttaaaagggggaaaaaaaatcacccaaacattgcttaatgtaactaatcaagcattttcaaaattaagactgggaatgaaatgttaggcagtatttgcagggattaaaaaatgttgtagtagaacagtactgccatctaccgacaacttttaccagtgcctagggagtgtttccaagagcaacctcccatttatttgtgtctgacccaaggaagacttcagagagacactgttcaagtaaccagaaagaagtaacattcagattggccacggttttacctctgacttttaaagacttaatattttctctctttctattcaaaaagagcatggtttttttaaaaaattttgagttgttaaaatatagtgacccacacaatgaatacttcctagtaactaacatccagccgagaagacggctatgcctattgctacagaatgctcatgctcctacagacaaatctccttcaatgcagtaatacactgtatcccgtatccccgatgcagaattagattcactatatcctctaatgacaaaagcagatcacaaaatttcataagcaagattggatgtatttatgtgtatgtcaatcataaagcatccatattaccacccaggaatcactttatttggggtcactgtgggtccaagtctggcactggattcccgcggtagcataaaaaccccttagggtttagttggtggggaagtcgtggggcacactgacatcccagatttgacagaactcagtaaaattctatacataccaaagacggcaatggcatcaccagcaggaagagccattgcacaccttctataatgctcaagataccaagtagatgctttacacaagttctatcagttttgtaacttaaaagtagatgttgagtggggaaatatgcaatataaagactctttaacctatgtgatggagcagctgaagagcacagctagtcttctaattttgtacatggatgctgcatcccattaataatgtaaaatatatatataattttggtctatggattttaacgttttacggaaaaactgctactgctgttttttttttttttaagacagtaatctgaaaacaggttacagacagaaaacatgtaaatgacagattttaaaaaggatttagtcggcactaacatagcccttttaggccacataattgaagaactccaaggaaccacaaaataaactgaaaaccccagacataaagagatccacttattaattaaaagcagctctctttcgctattaaaataaggttggccatgcatactttattgctgtcacagtctcacatgaggcagtattcaaaacacataaaagtaaagttgaatagttctctatgtagggaatggagttaagtcatgtctgcttgcacaaaactgttttgcaaagcagccatatatagaagatcagggtggaagaaaaaaaagactaaaatgcatcaaatctcaaattcaatgcctttctttggtagggacagtgaggtgtgctatggacaacatgagttgaatcaagaaaggcctaaaactttccttgttttaaaactagaactagaaatcaagacaatcactgcaaagaaagagacagggaactaattaaataaattacatactaattaaatacaagttatttgggaactttttttgtaagtctaggttttgtttttaaacacaaaaagtctgtatcatactggtttatctgtgagaagaggcactggtcacaaaaaagagagacggagaaagaaagggggaaaaagaaaagaaacagaatgacaacagtaactaccaatatttcaaaatgtggtttttaagaatttccaaaaatcacacttccaaaaatcacagaaatgttgtggctaaaaagttcattcctgatactaactgttctttaaaagccatgggcaaccatatggcaaaatctagaactaaaatgaaaaggacaaaatgtgtccttccatatttaatattcatttcttgaaatggataatctagtggtatcttgaaggaataaacatatttctttgcaatgacttgctgaatgtcagagcataacaagattatttacagtctttaagaaaagtatggaaacaagaaattcctataacagattatttaaaaaaaacactaccaccttattttatgggttactaataatcatgtaactctttcaactgtagggtaactgccatacaattacaatgcctagttatttatgtctcacagattatatagtactaaagaaagttacctgttaccatatgtagacacttgtggttggcagatgtggaaaatactttaccataaagatcaaaattggcttaaaaattgacctagcatatgaacgtgatttatttatctccactcccctcccccacctctgttttgtttgcttttcctgtggatgaaagaaggaaaaatagaaacttctaaagagatatacagctttccagagtcaatggtttaatctaagtggagtcagctactgaactttattcagctggtttctccccagagcacgtcttcaccgaagtttctgtttgacctgtttcatttccttggaaaattctggcattaaatgcagctattactggtcttaagttagaaacattcttcttgcttgattttttaaatatgataatcaccttaattttttaatataataagcaccttcacactcatcctatgtttcatggtactaagagaccttcggacgccgcatgctagttccactttcctacaagtttgtttactagtgaaattaaacagtcaatcccatttatctctgaaatcagcagtgtcccctagcaagagataagagacaatgtgtgttgtataatttactgggaactaattcatggtgaccaataaattgtgcagtcctcctaaagcaccccctttgccgtggtgagatccgcagtgccgactctcgtcctggcactaagatagataagtcctaagagtgaaatcagtagacatgtgtcttttttttttccctttaattctgaataaaattccagaatttagggagtgaaaaacacttccccaacccccgccaaaaaaatctgacattttctttctgccgaaagtctaatttctctttccccaaattgcttcaccatatggaaggaaagaatctccaccttttatcttcaatctgtatcacagtttgggcatatacgagaattttgtgttcacttttaattttcttgctagttaagaacaactaacaactttcttgtatgttaggactcaaaatacgtacctcaagagttgtggtacatttcacacaggtcagaagacaagcattatggaaatgaaatgattttatgatgactttgctttaataggggttttacacaggggctttcctgggaagatgtccaggcaaattgtgtccaaagcccagaatgaagggaaaattcaccttgatgtaacatagttgaagagggatttgctgatttgtcattttaaatgaaacacaaactccaattccagcccagttatgagagcattcctttgtcctcttacttaagggatttttctttttcctttctttcctttatttctttcaaatcctacaatttgagaaaccactcaagaagatggggtgtgtatacacacacacacacttcatacatacatctgtacatgtacacacacatccattttcaaacaagcgctaataagagtccagttggctctgagataatatatccaaaacgaatcccactcttcttaagcataaacttcacacaaataactagatataaacaagccacatttaataaggataaataaaatctctgtcaagcttacaacaggaccaaaaaaaagtcatgggggccagagaagtaatttttaggttatttggcaagaaacatgcacacacacacacacacacacacacacacacacacacacacacacaaaaccctcatgcacatgtgtgcatgcacagtgtgtgcgcacacatacacagtttttcgtttggaacatttttgaacaatgaaaaggcaagagaaatttaagcgtcttgggaaatactcttcctgtgccaaataagcataaacaaaataaattctaaaagcaaattttaaatactagaggatggaaagtaaaaatgagccaagctggagtggaaatatcaatcctgaaagaatcagaaagcaagtttctcttgaaccccaatgaatcttgcatttctaagaagcacaattcagttacttgagctgtcctttgaacaaaaatttaaacttaaagaatatatttaagaatataattaagtcagctacctgggattttattcaaaaagtgatactgattattttccccaaaacatctaggaatagtgtggcaataaagtggcactgtgtttcaaaaggagccccccaaaaccttcaaagctaagattctatttagtcaatgatttggctaggactcaccacataaaaaacacaacacaacaaaaaacaaacaagcaaacacacttgagcagcctgtttggatattgtagtacttgttccacagaagtcatcagagtgttctaggagcttctcgtctaggttaacactgacactgctggtcagcaataaatcaaagctatgctcgtcatacaagcacgtaaaatcatcaccttaaatggtatgaaagtatttgtgctgttagaaggtagggaatggggtgaggggaggagcaaggataaggattccttctttcccattccactctcgggttctcttgatcttcccagggtggaggagcagtaggaaactgttcacccacccagttactgtgggaaaaaactggagggctctagtgaaaaatgggaaaactcttccccacacctttatctcaagccttggcttaaggtataatactttttattttttattttttttgagacggagtctcactctgtcgcccaagagtgcagtggcacaatctcggctgactgcaacctccgcctcccgggttctagtgattcttctgcctcagcctcccgagcagccaggactacaggcacgcgtcactatgcctggattttttttttttttttttttttaagagacagggtttcaccatattggccaggctagtctagaactcctgacctcatgatccgccagcctcggcaaggagacaagttacttgatagtcaaactgggccttaaaattatcacgcatcatgttattaaaaggcagtgaccatggaagggtaaatgtcctccctcctcctttcatgagaacactaaaccatcctcccaccatgtaaaaaaaaaactacttatattttttattaaaatttacatcatgtaaaaaaattatgtccaaaacggcttggttaaaaaagaccacctaggatatgtttgtgttcagatttgttaaaatgcagagatttaaagaactaaaattctttattaaagaatattttcaataatttaatggtagctttcttgtggcgttttagagttcgcacacagtaggctgtggtttaggagctaaagttgaatgcgatcccagagtttctttaaataggtcattttagagatagaaaagggtctacaggttgattgacaattgacaaactatttggcccactaggcataaacttctattagatagattattggggctttcacagataaccttggtaacagcattatctaaatatgaaaataacaataaaataacaatcaattttatgattctcaaatcagagctttaagaaaatagatccaaatagcatatgactaagaacttactatgtatcaatcaaatggcataaaaatacttgcaacatggtcatcttgaaaaatttacaatctacctccacggtctgtctgaacaacaaacttaacacaaggcagaatggactgaatactgagaataaatggcaattatgagagcgccggggttgggaagagcttccttgacttgagtactggaggcatgtcaggagcaggttataagaatgctgtggcacttgagcagcaccttgaatgttggctgcattcagagcaaaaagtacgcatcagtacaagcaggagaataaaaattcagggcatcatccacaaacagacatgccagagcttacatcatattaggatgttgtgtgcttgtggccatacaacgcagggacacaatgaaagttaggttttagaaagttaagactcagcagagtggagtgaggaggagcgaaggcaatcacaaggaggccggggtaaccgtccaagccagaggatatgtgggctgaactccaaaggcggcagtgggaacgcattgtggtgaccctgcacgcaactgaaaggagataccatctgactgcatggcaatgtgaagaagggggatgagacaaggatgacaaggcagatggcatcacaactgagataaggcacaggaaatgaggaaatggaactgatggagggaagaaggagaaggatttaatcttgaagaatccaagtatacgaggccagcaggacagacacgtgcaataggcggaattagagattaatcagttgactgattaattgatttcacatccactatccaacagactttcaatgactcaactatgggagtccagaaaattatacggaaaaatataaataactataaatcagcatctgggctcaacattcagatactggattgtgaaactcaagagggatctagggactgaaactgaaaacctggacatcatcagtgtaaaaatgatagttgtcaccaccccttgagagtgggagtggtgggaagggaagggagagaatattcatttttttactttataacaaacttttattgtttgaatttttatcaacagcacatactactttttgtggtcttttaaaagccaatgttttaaaaaaaataaagcaaaaagactgaagccataggaacaggcagtatcacaaattgacttctcaaatatgtgcagttaatgtacacaagcactcaggtgggaactgagaaacacaaaggtgatttcaacccaagtcctgtgtgaatctaatgggaaaataaaggcactggagtcaaacaggattcaaactcctctcccactaatagttacataggtgaattcttaaattccctcaagttcaactatttttctctaaaaatgaggcaaacaatacctcatagggttgctgtaaagatgagacaagttaacgtaattaaagcccctaaagggtagcatttggcacacagtaggtactcaattaagattccctgatttttcatccttctgccaagatggggaaactcaaaatttcagtcaggtttaaaaagagactgaaaagaagtgatcagagggaccgcagcagaaaaaaagatggcaccatgtcatggggactagcggagagaagcaaagcgcctttatccatccactcaacataaatgtactaagcattaacacctgctggagtggataactatgtcaaaggtggtggagatggtgagaagtagattatttgacaactaggaaagaggtccttgccgacttgcaagaagagtcccagcagaacagcaggagaagatactacttggccagagggctaaggaatgactgggtggtgaagagtgacagtaggaagaagtgacagttctttgagaaatttgtaactaagggaatgagaggctcttgtgaagcgaaggtttcaggaaagttaagtagctcataggataaaaggaggaaagtctgtggaaagggagaaagtgatggcagggaggaggtggcagagttcattcacagtgtaaggccctgaagctgacaagagggtgcccaaagtgaggaggctgaccttgggaaggagtaaggacacaccatcgcatcgggaagcaagtgtgagaagtaggctggaaatacagacaaaggttcaggtgtaaaggagagctgaagaaattcaattggattaccatctaccttctcattgaaaaaggaagcaagattactagcaaaataaggaaagctgatggaaatgggaccccagggtgaagaaggatcgaaaactaaaaagactttcccaggagcagtgaggttccagcagagggaggtggcacacatcaatactaagcatttagcccaatgtgattgggctaatgtgatttcctccagtgattttcagtggcctgggatatagacacggggggagtgggaaggcagtcataatagtgggcaaagcagaagttaaaagggcaagggattctaaggatgccagtgagccaacagctgacacggtggactggggaggtcaaggcctgaaggttgagcagggaaggaaggatgagactgagtgacaagaaaagcggcaggtggaaaatggccgttaattggatttaagatgaggaacaagcacgtttagaggaaatgaaggaatgagtaagtgaaagaacagaaggctgtgactggaagacagctccaagcttgaatccttagaaatgaggcaattccaggccatggaaagggttgaagctggctgattaaagggaatgcagaaattcctggaatcgagaggccaggcctccagccattcatgacactggaagccgtggttagctatgataatatcagaagaccaagctaggcaaagaggaagagatccaaaggagaagaaaatggaggaaacagaaaaaatataactttctgaatagactaatttcaaagactgttaaaaataatctttctttagaaataatgccttgcttttagtctaagttattaaaaaaaatgagtaaaacctttaaaatccacagcagaaaaagccatttcaccatttatatgtcttcaactgaagcaaaaatcaaggacctgactctttgttcttcaactcaacacatctgatacggtgtggctatgtctccagccaaatctcatcttgaataattgtagctcccataattcccaagtgttgtgggaggggcccagtgggagataactgaatcatgggggtggttctcccattctgttctcatggtagtgaataagtctcatgagatctgatggtcttataagggatttcccctttcacttgtctctcaattctctcttgcctgccgctatgtaagacatcccttgcttttcccccatgattgtgtggcctccctagccatgtggaactgtgagtcaattaaaactttttcctttataaatcacccagcctcaggtatatctttattagtagcatgagaacagactaatacactatttcaaacaagatggcaaagtaactggtaacaactgaaggaaataacgctgcttctgtaagcactgaggccaagttgtctgagctcaccttctcccttcacacactggggaaggaggaggcctgatgacaggatccctacacagcttgctcaagcacaggtgagccacagcacatcctcctgcagcaagcaaggtggcatgactaacacaagacctaacctcattgcctttacacagctctttcatatccattacctctcttaatcctcacaggctctctgggaggcaggtattactatgagcggctttttatcagtgaaaaaatagagacttgtgggccagaagacttgctcaaacgctgagtctggcagaaaccaaggccctcccactccagaatttagccctttccactaaatcccaccaactgaatgactgcaagggccagatgcacaggagacagcgcagttcagaaaggcctgaatacttctgggtcattctcaaagtcacacagggcagctaaaacataaagcaagataagcagcatcagcaggtattccttagggatacttcacttacaactgaaagaaaagataacttttccacatttgagcacattgaacaattgtcagtgtgctcacaattcatgagaagacaagaaaacccagagtctacagaaatcaaaagtgacagaatcatcatttcagagctgtaggtacaaaacagtaagtggtctctgggtgtgcagaaggagttaacattttctacagagtaacaccttttctgagaagagactggactggcagaagcaggagataagaggatgggttggaaaaaaccacaacatcttctcaaaccaagagaaagacaagatagaagtagagaaggaaacttgggacttgtatgtctgtaacgccagaggaccctgggcaccttacatgaaaattatcagaaatgcaaattatcagatggctaatttctaaggtcacctggtgccaaacacattacaatttcagtctctgcctcacacatctcacatccctaaaaatagaggcaaaggggacaaaaattatcttcagaaagcctggtgtccactaagcctggcaatatattctatgacaagccacattttatcacagaatactacaatctgaaaaggttccctgagatacatactgctaatctaaagaagtgttgaaccaaaattgtaactaaatcaccaaattctgcataaacccagggggtagaataggttcaatattcaggactagctcaaacaggtgaatttactcagataactgatgaaatctcatcttctaaagtccttattaccacgaggactgacccccccacccccacccacccagacaacaaaagagaaagtcaattaataattatgatataaggttattctcacctcccccattactgtttcttggagtttttatgaggttttgcaataaaaatttatagctatctgaaatagttctaacctcttccacaagtagtttgcttatttgttcatccttttcctctagcccatgtaaataaaacacaaccttcactttcatggtaagaaaaatattccctttaatgaatttcaggaatcaggaagaaaactgcgctagtctcatggatctcatgttaaggattctaagaattctttacttaagagatctgttttccttattcctcaatctcctttaaagaagctgagcatttttaaaaggatatcatagtattactttaaaagcaccaaacatagcatccctgaaaataacatgtttcctgtcgggagaagcatgttaaggtgtctgtgagagatttctggggtttattctaatccatgtttctggggggcatctgggacactctaggaacacaagggcccctctttccactttggttgtcactagtcacacagattttcttactactcactgcttgactgagtcgtctcaattcattaaacattctctgagctattggcaagacttcaaccatggtgacatttcctttacactagatcatccaactatagccttcctagaaaacaatgcttggacagtagcaaaagcctgttgggtcagctaacgacatcaagttataataagatctcaaagtttgtctttctttttaatttttgttttcttctctagcagttacaacatgcaccttgagatggtaatagtcaaagtattgactgaatgtgcctgccccctggtggctggtggggtgaaggacacactgtagaaatccttcgggtacctgcatcagaatcagacacgagagatatgaaagcaagcacacaaatcagaatttgctgtagtggagtattacgaagatctggtataaaatgaaataaaatagagtttaaaaaaggaaaacattactaacaaacagttttagagacaagtcaccaagatcttagcttgagatacactaacccaggctcctcctgccaaattatgagcaattattgtgctaagtatctatgtgcacctgttgttgtcctagcttcttccaattaaattataatcttaagattattgttattcggaagaaggagtctaggttagcatatctcaagctaagagcttggaaactgaaacacattttaattgtggtcattgctccacaccataggggctccctctgggacatggtctcaactggctctggccgattctgatccccaccggcaatctcacttcccgttctcccctttgaggccaaattgtccatggtgactttaaacctggattcatagatgccttcaggacagggaaaaatctaagcctgtgaggcagcaatacggggagtaaaggagactgaggagagacctgtggtgactaggaacatggcttcctacaggcattcaaactccattgtttaaaattaactctacattgcccaaaaaacatttttagagcagtgctctgctcacccctgtaatcccagcacttcgggaggctgaggcaggtggatcacaaggtcaggagttcaagaccagcctggccaatatgaaatcccgtctctaccaaaaatacaaaaattagctgggcatggtggcaggtgcctgtagtcccagctacttgggaggctgaggcaggagaatcgcttgaaccggcaggcggaggttgcagtgagcccagatcgcgccactgcactccagcctggagacagagtgagattccatctcagaaaaaaaaaaaaaaaagaaaagaaaagaaaaagaaaaagaaagaatgaaaagaaaagaaaaggtgaaccaaaaaagcacaaagaaggaagaagagaatgtcctgaatggcctttcccaaccaccaaagacatgcacccagatgcctcaatacggtctcctcaaatgccatgggactacgtcaaaaatatatatatatctttccaatgaaccagctcctgctcttgattttcctatttctctcaaagaaatgatcactttcccagccagctggacttggaaaaggtgtcatctggaccctctcctcctctgtgaggtatgagcaagtcttccctgtaatcctgtcctctccctctgtgcgccctcatccaggttctcactccctagggcctttttcttgttcctatgcatccagcattttcccttagagatcccagtataataaattactcaaatatgtgcagtcctttgtagttacaatgtgcttttgccatattttctattttagttttatttttgagtatataacagcttggtaggtaagcaaaaaaaatactatttctattttacaggagatgaaagaaatattgagaggaattaagtgatttggccattgccactacagaatctcactaatagcatttttacctagatcagtagcccatttctctctcctgctctctgttcctctttctctctctccctctttcccctgctctttctggtctccagcactgtataagccagttgcttggggaatgtttccacgtggatatcccacaaacacattaaactcatcatgatgaaaaccaaatgcacccttggctcctctcaacttgctgctctgctgttctctagttcagtgaacaaggatcacccacctagaaacctggaagtcctgactcctcattctccttcactgacccatccagtcaccaattttcaagtctacaaaactattaaactgtttctcgaaaccaagtttctctcaatccccactgcccacttctgccaccctcatccagcctataacatccacttctctgtctctctcataacactcttatctgcacagccccagtcaatccatccctcacacttcaccttgaataatctttcactctgcttcttacaacattttgatgtctcaccaaaaccctcaaaataaaaaccaagctccttaacaaggctggcagagctcatcagcttctctgggtggtaactccttatcttagcttaggctaccatgacaaaataccaagaccctgggtggcttaaacaacagaaatgtattttctcacagttctgcaggtcggaaagtccaagatcaaagtttgagagggttcagtttctgatgagggctctatttctggctagcaaaccattactttgtcctcacatggcctttccttggtgcatgagtgtggagagtgagggagctttctggtgtttttaaaataaggacactagtagtatcagattagggccccacttttaagacctcatttaaccctaattccctccatatagaccctatctccaaacgtagtcactgggggacagagcctcaacatatgaacttggggagacacaattcagtccatactccctctccaatctcaagtgaaggcctgaccacttagcagtctacgctgcggccacactgactgctcatgtgctgtctctaaatccaaatccttgtggagccctctccagaaccctctccttttccttaggctccctataccttttgcttaactaacccctcactctttaagtctcagcctccatagtcttagttcttccaaaaagtcctgcaatctgacctgcaagccctttcccctctgggattagaggccctcaccaaatgttcccatgatcctgaccacatttgcctgtatcctttactagattcttggctctttgacagcaggtactgaggctgtctgttcacggctgcaaccctaacataacccaagagcactattaatacatagtgctctttcaataaatatcattgtcaaatgccattctcaaaaaggtaggcagaaaaacaggaagggaaggagagaccagagtaagcaatggctccttactatctatggaaaaaagtttccagttgttctgacattcgaagctcccttccactgggcctcaagaccctaagttcatatttgaaaggctgcacaggagaaagcagagccttatgctgcatttgggggtaaaaatagaaccaacaggtagaaatatgggagaaacagggcagagtgggaagggcaggggtgcttaattaaagacgcatgcccacctaccaggaaagccacaaaattgcttctcagaacttgtgttcagggacctctccggtctgctctgccttcaagacacattcttttctcctctgatttcctctattcccacaagagccatcaattggagtctaccctcagccccttgttcggctgacactcatgttcacccctgccctcatacaccatccttgtttgcaatggcttcacaacacccagttctatgcttctcctagtccagccgttttcaatgtgtgcatggactcctgagggtccccaagaccctttcagaggatctgcaggatcaaaactaatgtcatcatactaagacattatttacctcttgcattgtgtttgcattaacattgatggagagagtgagtgagtgaaactgctggccctttagcacaaatcatgctggtggcaccaaactctaccagctgccattgtgttttacataaaaatggccttgatgaagcagtaaactatcaattttattaaatcttgacacgttactattctgtgtgatgaaatacatacaaaacatttctgctctatgtaaaagtctaagggttgtctcaaggaaaagtactcgtgaacctaactaacttctcttttcatggaacaccatttttacttgaaaaaatgacttacaggcaaactataattattcgaacttgggtatttcacagatattttcttaaaaataaatgaagtgggcatgtcaattcaaggaaaacaactgttagtatttgttgccagtgataaaattcaagctttcaaatgaaaattaaattcttagaaaacttgtatctgccatcatgaacttgacatatttacaagactgatattgtgttaacatttggaagatttacataactagatgaaccaatattttccaagaccaatgtgtaatattacaaagtcatgcctgagcaaaagagtctttcaaggtccaagagagactactggcttttaacataactaactagaataagttcactgatatggtttcaggttccacatggcaactagcccctaaggaactaccatttgattgtttagatatagaatcacagaagactactcacaattatcagaaaaggctattaaaatattcttttccaacttcatagctgcgtggggttgaattttcttcacatactttaaccaaaacacacaacagattaaatgcagaggcaaatatgagactctagctgccctctattaacccagacattaaaaagatctgcaaagaggtaaaacaatgccattttctcactaatttttgttttggaaaatatagttctttttcatttaaatgttattcatattaacatgtaatgggtttatttttatttattttttgagacagtctcgctctgttgccaggctggtacaacggcaagatctcagctcactgcaacctctgcttccctgattcaagcaattgtcctgcctcagcttcccaagtagctgggattataggcgcgtgccaccaagcccggctaatttttttatttttgtagagatggggtttctccatgttggccaggtctcgaactcctggcatcaggtgatccgcccgtttcagcctcccaaagtgctgggattacaggcttgagccaccaggcctggcccgttactattgttatttttaaatgcattagtaaaaaaaaaaaaaattttaattgctagaacattaaatatcaatacccacattaataaaagctatttgggagccttaataattatcaatggtgtaaaggggtcctgagaccaaaaagtttgacttcaccaggtgtttgaacactacagatcccatcttgcccatgaagcttccctagacatccccaccccaccgtgctcccttctgcatcctacaatagcatccactggtaaggccactattttaataatgatatggttgctttatactaatgaattatgtttttgtacaacagtctcctagtgtccatgtttaagaatttaagggactttgctttccaaagctgttaacccaactagctctgtgaaagtgaaacaaaattatggacttaaatttctgtctgtgtcaaaaaagagtaaaatgcaccctctagtggacttgtaagctcacagaacacaaaataaatttattggattgtcagaagaattacaactccgtcccagaaaattcagattataaaataataatatatgagcatagggaaattaattttaattttttgataatatgtttttaaaagagctaagaaaatgtgaaaccaaatctagtttgaatgtagttcataactaaatgcaaaagtaaacctgaggtcacacacaaaaaacttctttcttaaattcctatgaattgattatacatcggctatccaaaataatctgttcaaattatgtcttattaactacttataactttaaatacatagaagcattaacatggataaagttgggattattattagttcaatttccaaatattaaaactacactcaacttacaacctgggcattccaatggccttcacaaaatctgaaaaaggacctttgaaggataagaaccaatgcttggggtatacttttaactctgtatgttaatgttaaaaggatttaattctatgcatctttctctaggatgacataagaaaaacagtgtaaaaatacactcaaccttatcagataaaataatgtaatgacatggaaagaagtctgaaatatatggttaaactaaaaaatgtagtcacagaataacgggtggcatgatctaatttatgttttaaaaaatgtacgcacgtgtacccatgtttatgagcacatatgcacgttaattctatagttaaaccttttttttttttttgagacaaggtctcgctctgtcacccaagctgtagtacagtggctcgctcatgcctcactgcagccttgctcctgggctcagcctcccaagtagctgggaatataggcatgtgccaccacacccagctaatttttataatttttgtagagacagggcttcaacatgttgcccaggctggtctcgaactcctgggttcaaatgatctgcctgtcttggcttcccaaagtgctgggattacaggtgtgagccaccaccccgggctatagtaaagtattaacatttgttatttctggcaaggaatatgcattagtagcaaaaataatggaagggcatttgactatacttctatactgttaagatgctgtgagcatttttaattcaaaataatcaaatatggaatttttaaggaaattacagttataattaattcaaagaactgtatgaaatgggaattgttatttcatcaactaggacattaaaaggtttgagtaacaataagaaatttgatatagctatttggtttttaaatcattagactggaaaagaaaattttttaaatggctttatcaccagaacacaatgtctgattcctctgatgataatgcaagctgaagtggtatataaaatcctctctgccacttttaaactctggcagagatagctactccttccaactgatagtgtctgatcggataactatgttcctttttaaactctcaaattctataatttctgaagtgctgagatactgtcatagttatggaagcattttctagctttgagtttttatagatctagcctcagccatacagcctggtgggtacaggtactttaagtgaataactggctttattaatctcaactggaagtggccgagttgaactgaaactaaacacagacacacacacacacacacacacacacacacacacacacaaatcagtagtattaccaaactacaaccactaaggagcatactcatccaattttaatttgagcatcagacgcaaaaagacagaaacaatatgtatgcttcgtctgtcattctaatctgaacacacaatgtcttcaagtcaacaacttaggtagatggagcagactggccaaaaataaatttctattggcaacacttctgtgaaattctactggtcctttataatgtgccagtgtttcactctctaatcatatattgcccagtgcatacattcatttaaacaaaatccttcttttcttcaagtaattaaaactctttaatcttttatctattttaagcctacttccattaatatttgtatttagacatttgtctaaagtgaaaagtgtcccaccagagcatgctgaaccttggtatcttccttgtgaataaaatttagctggacacatagccactcaactacagaatgcagtttccagactcctttgcagccaggtatggccgtacgacatcattggaacatgagtgaaaatgatgtgtacaaaggaattgtttgttctccttttccactcttttcacttctgatatggtttggctgtgtccccacccaaatctcatcttgaattgtagctcccataatccccacgtgttgtgggagggacctggtgggaggtaattgaatcatgggagtgggttttcccccagctgttctcgtgatagtgaataagtgtcaagagatttggtgggtttataaaggggagttcccctgcaaatgctctcttgcctgccaccatgcaaggcatgcctttgctaccccttcccattctgccatgattgtaagtttcctgaggcctcacctgccatgtggaactgtgagtccactaaacctctttttctttataaattacccagtctctagtatgtctttattagcagcatgagaatggactaatacaacttccctattggtagagaagtaccctgaagtattagaacattatacaattatcttaatagaaacagcatgctgacaatgcatgatcagacaggtagatcaatatagacaccaaaaagggggaatacatctaagtacatacagggaataacaaaaagcagtagcattttatgtaaattagtattgtctatttaaaaggaaagaagactattaataaagtcagtaaaaacgcatcaagaataacacaatctgaaacctggcacagagaatgcaaactgtgtttttaagactgttaccacctgagggcactacttcagctgactagaagaaatgcgggtgatcctttgtagaatttgtcttgaatttgccaaaccttcaaaaataattttttagccaaaaatgatcactgtcgtatctacggttaatgtagcatgtcaaaaagcgggaaacagatggatgactcaccaaatggggctgggcaaccaactaaccatatgagggggaaaagcaaagttgcatccctacttcactacttactctaaaataattccactgggatttgaattttaaatagaaaaaacaaatccacaagagtaccagaggacgtttactataataataatttttaaatctttatatttttaggggcagggaagagcattcaaaggatgaaggaaagcatctgaccattctttccatatcactaactccccaacatccttcctggcattatggttaccccacccctgagtttaacaaagttaaaaaacaaaatgggaatggaaaacgagggagcaacccagtcacttaatttttcatgccaaagtcactcaattttttataagcccagattcaggggttgaccctttgtgccctggaaacactgcacgtgaccccagcactgctagctccagcttctgagcctgaaatactctttagcctaaacctggccctaatacacacaacaatcacaaaaaacaataagaataataaagaacccagcaaccgttggaaccctgaggaagccgacggtgagtgaaaccttcccgacttctaaaaccagctccaagtcaagtctgtgaatttgagtctcgcaggatgcccctttcttcctgtatcactccgccagagaatattttttaggaacatagagcactagaatgagtggctatctctaaagccatcttaagtttatattcttcagcagctgactcaataacctgactttgacattaagccgacttcacagaccaactgtcacttcaaagaacaagaaaaaccttgagtaaaagttaaatgaaaagtgttttccaaatcactcgcaaaggaaacagatcaggttgttgtaataaagaatgtaatcaactcatttcatgagctaaaaaggtatcctcagaaacaggaacgcttgactcagggtagactgactctgtcaaaggtttggggcctgatgttgacgactggcaaagaccgagatgaaatgaactcattttgacattcaagttagagttttctaatctaatccatagcaatcatcctgaggtaaaataccaaggtgccacttttatagtcattgatggggaactaagccattaatgactcttctaagtaatacagcagttagtgagtgacagaatcaagactcagatgaggtcctctgactctacaatcaaaggtgtttgactccatccctctagcaccctccatggtggaaacgacatttaggtcaatttataacatccgaaaaagacagactagctgtacaactattaatagataggaaattgacttatctttgggcaatggcaagggaaaaggcttttatgaatgccattttttttttttttggaaaagtaactaaccctattatcctaggcattggattttaaaaatgccatctgaaatatacagttcaggtatctcttctgaagtaaaatattggtatgtatcagttggaaaagactcttttccaccccccaattgttagtgtagctaagatgatacacttaagacttacacgagtaaagaatcacctcaaagaaatgctcagtaagtctttggtttctctggattggcataagggagtctgtgtccctgtagaagaggctgccaggggttccccaatatatattctcctctcttttgtagtgagagaactgagtacataggcttatgtgttttccagcctcacttgtagttaagtgtgaccatatgtctatgttctgaaatatgaggacaaaaagaagttaaattctagaatgtttccttaaaaaatgggggcatattttttgctcttcttcctttctactgtctgaaacgtgggagtgatggctttagctcaaataaccattttggacaatgatgtttaagccaccattgcagatggtgaagcaacgagatgggaggctgggtcctggaaggttaggaatccccatactagccctagactatttacctgcaagtctgtttccctgggacagaaataactttctaacttgtttgaactgttgttcactggagagtagaacttaattctaacacatcatcggccgggcgcggtggctcaggcctgtaatcccagcactttgggaggccgaggcaggcggatcacgaggtcaggagatcgagaccatcctggctaacacggtgaaaccccatctctactaaaaatacaaaaaattagccgggtgtggtggcgggcacctgtagtcccagctactcgggaggctgaggcaggagaatggcatgaacccgggaggcggagcttgcagtgagccgagatcgcgccactgcactctagcctgggcgacagagcgagactccatctcaaaaataaaaaaaaaaaaaacacatcgccaataatttttttttttttgctttgtaatattcaagtcatcagttggctcaaaaggtgtcattaaatcatcaaaattttaatttacttcaaattaaaaaatattttccacaagcacatgtctgagtatacatgcaggtagagtggggacacttgcagaattaaaaaggatcaaaagtcccactgtaaggtacatcaagtatcgttgatccacgcttgcacagaaacctacttatgtccttttcacaacacctaaaagattgtgttgcctaacatactgtattgcaagtgttcgtttaggagtttaccaacaccattcccactccctgccatctagactaggaagtttctggttcaccatcaaatcctcaatgcctagcattgtgccaggcactcaaaaaactgggtgaacatgtgaaagactggccttcgcaataaggacccttctcatgatttgaaatcctctcaaaatacaagttgaggatccctaatccgaaatccacaaagctccgaaatccacaaagctccgaaatctgaaatgctccaaaatccaaaattttgtgagcgtcaacatgacactcaaagaaagtgttcattgaaggttttgggatttcagatttttgaattggggatgctcaaacggttaaagtatctgcaaaaatccaaaagccaaaacacttctgatcccacgcatttcagataaaaagtactcaattggtactagttagatatggtactaaatgagttctgaaattactcacatcccatcagtaatctgacaataaataaacagtcattttaacaaagtctccaaacttctgaattattaatgatgcttaatactatataatgatacttaatcaaagtcccaattcttaactattttactaaaaataagcctgcctatgtttataccgttctgtccataaagaaagaaagaaaaaataagccagcagaacaaccagtaccagaattatatttagattaccctggtaacctagattacctaaaaaaacctaacatctaaaaaatccctaatccagattaccagagtaatctaaatataattcacccaatggttgtggtagtaaaaatatcaccctgtatgtcattattattcagaatcataaggaaataaaccactctacataagaatattctttctaaaatgtaatatactcagcctttttgtcttttatttctttacctatagagataattatagttactcataggttcttttttccaagaccacatgatttttaatgtgcttctcaaataatactctctcaatgaaaggtaaaataatagtgtttattatataatttgctaccttcttaagtagaatacattcaacataattcaactttttgttatgactcatgagagtaggtcatcttaaaaataactaattatataattccgtgttgaatccgattccttatataataggcatgtgtagacaagatatgtagcaagcacctaaggtttaaaaaacatgagcacatcttgaaatggacaaaaagtcatattaaatgttctcctttttcaagatttcaggatgttgcagaaagaatgccataacttctgggggctctgtcatccactgagtttgaggaccaactagagcaataattttgaatctgtatttcttttaaggctaatcttaatatctaagtcataaaggacttgacagaagtataaaggaatagcctcacgtatagcctgagacacatacaaaggcagaaatcgggctgaatgacctagtcaaacactgcacacagcctgggtaaacacccaattcacggtgtccttacctgcctcgattagcaagatggcccagcaatgcctcctgagggacctatgtgcccctcttcttctcctgcatcacttttaacctgtacacgtacacacacgcacacacacacacacacaattaagttataagttacatgttaaatccagatggtttgaagggctaaatggtaaagtaataatgataacagcaataataacaaatatttagggaatatatagggaagtatttttacaatcctgcatagggaaaggccttctatacttttcttcttcaacagtgccttgattggtcctaggggaccacttactcccactcagtccacgtgatttgggccgggatgagcaacctcaaactccgaagataagcatggatgtaggcctggccaatcatagtctcatacaccctcctggtcacagggtctgttcatgaataggacacataacctaagccaagacaatcagaggaaatgagactctagaataagacttctgttgaaactactgggaacaaatattttcttggaagggttgctgagaggccagaatgcaaacgcagagctcccggcagccatcttgccaccaggaagggaagcctcttctgaagatggagacagcatagaatgaggcggacctgaaaacggggttaggtaagcaagtcaactgaatgatgtcgctcgtgcctctgaatacagaactgcctaaagttgcacttacccctttttttcctaggtcagtttacagtttggggctgcaaacaaaaattataacgaacacacctccttagagcattccaaatgaaattaaaattgcaaaatgcacaaaggaaaaaaaatctctttgctcataccttttcaatatagagaatataaatcaagatctgaataccaatccctagatgtagacaatcttaccaacataaaaatgtgattgcctgtcccagtatgaaaaacatcctcctgtaaacattgctacaacaatttttgaatcatttaattatttgaagattacatctccaagtatcaacaataatagaatattattacctgcttaggaatagacagattcaaaaagattttaaaaggaggtggcaggccattaaaaacaacatgacaaatcatttctataaaactattattagtgtcatgaaactgtcctggtagtatcttttgagaaaatatgcaccaaagaattcctgaaaatatgctgctaaaccttgattacagccttctgtaaatagatgtaatctaggaaaactcaaaagcctgttatttgtataaatataacatattcaagctgacaagctgaaattatccgccctttgtattctcctcataagcacagactgtgttataaacaaatccttgctagtctaggcaccagttgaaatccccccctccaaaatggaggctattgataaaaggcttttaataagtcgtagtacagatagaaacacatgtatgtggtgactgatagtaaagtattaagttttcttataatactaaaaattcaaatgcttagagtccagacaagacaaaagcagggaccaaggaaatggttattgatgaccatgtaatgaacctgaaggaacgagtcccaaccaaagggggcagcagtcactcatgaatacatcttcccaattctgatttttcaaaagaagctagaaaacaaattttgtgtgtaatctcttgatatcaaaaacatgtggcccattggcctctaaagtattttgcttgacacacaatttcttaacatttgtcacagacatttaagatctagagatttcacacaaaattttgcagtgactgttgccaccttgtccaagatgtaagggtgagagattcggaccaatctctaaagaagctcaaagttaggactgagcaagtatgggctggaatttgagcaacgatcaaagagcaagtatcccagcagttatgcacaaatctctaattcttagattttagacaagtcatcttccctctctgggcctgtttccataaaatgacaaaactagattaagtaataatatgaacgtttccttcagcaatacaattttatcattctataagaagtccctaaaatagcatccctataagtgaaaattctagatttcacccataactaataatgtacaaaatagtttacaaaagagaaacacccactacctgtactattcatattagtaaatgagtgtgtaaaaataactgacaaactaatgtaattcacagacctgtgtattaagtagcttcatgaattttatgaagtttttcatgtcaaataccattagagaaaccacgctcaacctcaaaagtctcacaatcacacagaaagggtctttatctgtaggaagtatggaacagaactactgaacaaaatgaatgtattttaataccactccctaaaacacgggaaggaattctctcctgtatacacccaaaagtttttctaaaacgggaaaaaaaggtgaaatcacaaaatcaaacacaataaaggtcaagctaaagaatcatctagactggcagcaataccataacttcctgttataaatataaagtaatgggctttcaaatcagaaatgcaatttgatagaaaggccattctaccaggctctggaaattgagtccaaggtggacactatctgcctctctccagcactgtccctccccatcattatcaccattaatgatttccctaattccacacattacgtaaacaaagaaaaaggtagccataaaaaaaaaaaacatcagaaggttaatcatcagcatttattaaaaattaatagcactactggtgttttcagcatttttaaatttgaaaattttaaaattaaaagtataattttaatattaatatcaatattaattttcaatgtgtgctatttctaaaatgaagaaaatactctaataatgatcccaagtaaattttctttatgtaaccagaatcaattcagcgggagaggaatattcttctgtctgggtataattatgtttggggctgcctgcattaacttcaatcttccctcctgacatctttataaatttaacttcatgataatgttctattcctttatcctacttctttaaaataatctctcaaagaaatctttaagaatgttttataataatcacaagaaattagtaattatggatttgtaattagtaaccactgaatcttagcaggaattacgaaaaagaaaatctatggaatagtatgtgtcaaacaaatagtcacaccttgcttgccttattcaactgggcagaaatcagacttcagtgaaaacttttaaaaacttctttcaggttaaatgagcagacactttttgaattaacagaattctaatttttaaaatctcttaaaagagacaatctgatgtattaacaaaagaacaaaacagaagcttggtgatctggactcaggtaccagctggtgctactgctgactggctatgatgtaacttcaggcaagttcaaaaatgctccctgggtcctaagcactcttgctctgtgaaatcaggatggggacttcttttttttttgagatggagttttgctctgctgtccaggctagagtgcactggcgcgatcttggctcactgcaacctccgcctcttgagttcacgtgattctcctgcctcagcctcccaagtagctgggattacagacatctgccaccatgcccagctaatttttgtatttatagtagagccgagggttcaccatgttggccaagctggtcttgaactcctgacctcaagtgatccacccacctcggccttccaaagtgctgagattacgggcacgagccactgtgcctggcctaggatgtggacttctgaagtccatcataattctatggtaagcccctttctgataatattgtatccaattcacagggtaattaaaatagttcaaagagttatcaacactgcacccttttgtcagttcttcattgtatatccacccaggggaagtgtcattgatagatttctgagccttaatcccttaaatcataacaatatcccagaaatattaggtgtgtcctagaaagtctataaagatcttcactcactttttttttttttgaaacaaaactgccttcccttcttcctcctgttctttttctctgtcaaattaaaatatttcccttaaggtaaacttcacaaataagggtctacaaactcctctatgcgcccttattctgggttttcttttcactaacatgaagctattctcatctacacgatccctccgacaacttgcccactccctacatttcagaagacactctcaaagctcttgctctgtagccccgacctatcccccaagcttcagactctcacagaaactatgtgttgtacaaagccacatggacatcccatggatgcctcaaactcaacatgtccaaaactaacctcccccaaacatgttcctcctcccaaattctctatcccacttcacagcacctcatgcccaccaccatcccaggcacccagccagagacggggaatctacctcaccactccttcatctccctgactcaacacacatgatacacagacaaggcttttatctcttacatgtgttttgaaactgcccccttctctctattcctgcgaccatcaccaagttcaagtaacttttcttttattcacatgttttcatcaagcttaggttctcaccacctcctgcttaagaggcaaaacctctttttatatacaaagcatgcatacacacacacacacacacacacacacacacacacacacacacacacacagagtacataaaacatatacacagtatctctgtggtattaaaatgtcataagggagagggtgattaagaaaaaaatgtctaaaaagcccaggatggtcggggaagcataatgatgaaaaggttgagaaatgctacagttattggatttatagctccttatcagcaaagactgtataaatgtacatgataaaatctctaagataaataattcaaattaaaataatttgcatttttgttttctccaaaaatttcttttgtatcttggatattattgaatgtaatttgccctctgccaaagggatgatgccactggatagtcatgaagatgaataatttcctattaaaagtaacctagaaattaaggagttaaagttttgttttttttttttaaggaaattgttttttaaaacacattataaaatatgtgtgagaaagtagctaggactgaattaagattgaatagttatttatgtctgtttcctgtttagccttttgacaatgttcagccccatattttatagtcggctttggataaggcttcccagaataaccttgatgtggggtcggctggtagggaggaccccagaactacatcctgcaattcacaccctatgaacgcatactctgctaaactcaacaacttcaaaacaaaaaacaaatgtcactgtcccatttcctctgcaaagccctgttttcaaactccaaaacacaaagaatgggaggaaaggaagagaaaaaaaaaaaaaaaacccgaacacgtttagaaacaaaggcacattgtgagataacattaagagtcctttcatattttttaaattcagctaaaaattccccttcaaaatctgaaaaatggaacaggtgagtctatgagagaaacaaatatcacattagcaacgtatttttgatgtgtatagaacatccttactcaatataacatactaatttatggacaaatgcttgtcaggttgggcagttataaaaatgaaaacctcaaatcacagaaaaaaataaataaaataaaatgaaataataaaaacctaacaacagcagaggaacttccatgaatggggagagctggtgaatgtgaaggagaaaaagatgatggagcttttttacagcacgaagacaaaaattcctagctttggaagtgggtctctgaaacatgagggcatatttgattaaaaaaaaattaagaacaataaagggaagaaagctgatggtaaagaccagattcttaatacaccatcaaaaatggagggcttctagtaacctgctatgaactaaattgtatctccccccaaatgtatatgttgaagctccaacccccagagtgatggtttctgaagatggagcatttgggaaataactgggttttgagaggtcatgagggttgtctcactcagaatcaaagtcaaaccaacaaaactatctcttaccatgaccaacaagaccatctctcttcaccatcctatcccaccccacctccaaccttacctatctccatcttctctttctcggactcactctcctgcaaccatagttggcctcctggctgttcacttactaaccaaggttgctctgattcagggcctttgcaatactgtctcctctgcctagaaaggacttccctccactgtctgcatggcttactcctatagcttcttcccttacagggaaataaatttctctgactcccatcccatacactcttttttctcactgccttattaatcaccagagcccttaccaccatctgacattctttcatttacttatttgctaattgtaggtcttctctactcgaatgtaagttccatgaaggcaagaattttgtctggctcatcagagcaatgtcttacacatactaggtgttctttaatatttgctgaatgagttggtcttgctcatctctgaactgttagtgcctggtgctagctgtgtatatgttgaactaatgagtattcaaaggaagcaagtcatgggaatagatgaattcactccccaagacagaaaaagagaaaaaggccaagcatggaacactgagagactggtaatacttaaaaaaccagactgacggctgggtgtggtggctcacgcctgtaatcccagcactttgggaagctgaggtgggagaatcagttgagcccaggagtttgaggtcaacctgggcactgcagtgagaccctgtctctaaaaaaaataataaaaaataaaaaaaagaatcagtgatggaaaagaagccagtggaggaaacagaagaagagcaacccaaaaattagaagaaaaattaggatagcgtattatggaagccaaaggaaaaatgatcagtagtatcataacttggcagacaggatgcgggctgaaaagaagtggatgcatataaaattagttgagctgaggtagtagagtccaactaatgacccagttgcagttggctaaaaaaagtggaggtagaactttctatgtacatctcttttagaaagtccatcagtaaagagaaggaagagtcaaatgtgcaatggcagggaaatagagcagagaaggtatttttcagaatagaagatacttgagtcaacgaagaaggaaagacagaagaagatataagaggaagtgaagataacagagaaaaaagttcagaagggaacgggaagagtagaggtaaccaattaaccttgggaataaggaaggagagagataggtaacaatatacagaaacacttgaaggagagtaaaagtgcaagaattcccatctctagtttctaagtgaaggagttcatgaggtcatatctgagagtaagaaaggagaagtgtggttgtggttaagagcaaaaaaaaaaaaaaaaaaaactttaacagctgtaggagaaaagaaggaaatcaatccctagttgtctgaggaatacacagaattcctaaggcacgacagaggagccaggagagcttgtaagtaattaatcagtatcaaagccagccaacagggctatagcagtttctgtcacacagcaattggcagcctgccaggagaaaaaccgagttagagtggctgtgcctgggactgcatctcaagggtcctgtggagaatatattcaatgactggtcatagggtgtgtcagaccatttttgcattgctataaagaaatatctgagtttgggtaatttataagaaaagaggtttaattggctcacagttctgcaggctgtacaggaagcatggcactggcatctgtttctggtgaggtctcaggaagcttacaatcatggcagaaggctagcagggagcaggcctgtcacatggcaggagtgggagcaagaggtgggggtcgagggaggcaccacacacctttaaacaaccagatttcctgagagctcactatcatgaggacagcaccaagaggacagcatcaaatcaaccataagaaatccacccccacaatccaaccacccctaccaggccccaccttcaacacgaggaaccacacttcaacatgagacttggggggacaaacacccaaaccatatcacagggcttctggctaagcagggaaataaaagcagcaggtttgggtgaggctgacagaattggagaacaggaaagagatcagattttcaaaatcagcatgatgatgagaagcaagtttagttaaagttggagaagaaaatacctgattgtgcagtctctgaagtgggaagaacaaggttcagtaagttctgaggagtagaaatgaaggtcgctaagagacgaaggtctgtgattttggtggtcttgatgagagacatgatggtggagagagggagaagtacagggacatgggtagtagggacgggaccaaaaaaaacaccaagagctggtgacaaagggccattgaagatggagcagagtccacaggtcctgggggcagcctggagggagaaccatgttggctgtgaaactaactggaaatcccacatcttctgatcccagaacaacccagctctggagagatctagacttacaagtaggcacagtgaaggtcactagggtcaccattttagtctacctgaaacacaattcactctctgaaagaagttataaaaagcaaggtccacctcctaacagtgacaggctaactttatttaactaaatatagttttactatatttagtaatctaacttcaaatgctttcaatcagatgctatattaaattgaatcagcctatcttcctaattattaagcatggcttggaaaagctgaaggaaacacaacactgctaatttgcacagaggcttagaaagtgattcacttgaaagcccctcccctaattcaggtaagaaggaagaagataagtaaacaatgatgtaaagctttaattactggctcacactttttatgataaaacacacactgcaaaattctaaggtggccaaacaactcttaagcatgctttgaactttagtgcaaagaaagagatacgtctgtaggcttttgacaaacatctaggtattttcatttaattttcccactcttgtttgttgagtatgtttttccacaagcagaattaaattaaggaaagccaggctttttaaaaagtaattgaatattagcattagtcaacagcaacagtttgtaatatggtatttccactgcagcacctagggatggcagaaaacggaggctgctgataaactgtactggcatcttatctgtacccttactagatttctaaagtttatttaaatggttattctgtatctgtgtctcataaagggatgtcatcagaactgccacctaaggagctattcctaaagacctcagacctactgattcagaatctccaagaataaggatccaacaagtagattttaacttcttcagtgtccaccacactgtcctgtttaagaacacctgtagtgtaataaggtaagcatgaagtgtccccaattaagaacacaatcagctttagagcagtggttctcagccttgtctgcacaatagaatcaccctggaggacattaaaaaatcccaatgctaggccacaccacaaaccaattagtacatcagaatccctggggtaagacctagatattggccttttgctgcccatgggattcccatagtcaatcaaagttgacaaccagtgaagcagaggaccacgtcaaacaactgtttaatgaataaatgaaaaagactaatttaaaattctctgaatttttccttattgaacacaagaaatgatattccatgctatcagcaacatgcagactaggatcaaagggctatggaccttatagtaactggagagattgtctgtgagtcatcaggcagacaacagaaaccaaactaagcaggtggcaatgtgttaggaaactcctgaatgcatttaacatttagtaaaaggatctcgacatcactccaggcaaaaggaatgttgatctagtagttaaggtaaattttctttatggaagagactgcctcattaagtcaccttgtgcaatccagttcatttcttcaaacctttctgttgcaaaatagcatcaagaaagttctgaagtccaggttttagatacttattttgctctttttaaaaggaaaacacttgctacttagaagttcatctatgcttttgctccctggactttctgaagtttcagcaaacaagtctttaataaagataccatgcatttaacaaaggacaagatttctctcaccagtttaaccaccgacagggttcatgtcacaggatgagggtcaatcaggattggtcaaagtgatgtctaaaaggaagaagctgaggcaaaattaacatggagttcatttgggccaaggctgaagactgcagccagggacacttccaagttgccttagggggtgctccagagaactcaagagagaacaagtttgttttgttttgtatttttggagacaaggtctcactctatcacccaggctggagtgcagtggcccaatctcggctcactgcaacctctgcctccgggctcaagcaatcctttcacctcagccttccgagcagctgggaccatagaggcgcgcaccaccatgcctggaatgttttttattttttgtagagacagggttttgccatgttgcccaggctggtcacaaactcctgagctcaggtgatccacccgccttagcctcccaaagtgctgtgattacaggcataagccatcatgcctggcccagaggtcaagtttttttttttaaaaaagcaagaatcaggagaggggacaattacaatcattgttcaccaggaattctcattgtcttacaaaaataacattgattattggctatacattgttgaactataggtatacggcattttatggcttctcggcagcagtcagcatagcactcaaatagcaagtggcttcaagaggtaattatttagctcaaggggagtgatatgactcctgtttcattccaatgcctctcttgggcctgaaaatttaaaggggctcacgttcttcaaataatggattatgaagctgggtcataccacttccacagggcaccaagagcagcccaagtaatcaacatgtaaccccatgtaatcaacaccagcccagggagctgggagtagaggttaggaagattgaagaactgataaaaacaaagtaccaccaaatgaaaatctgtactcactcaattcaaacacaagtgggttccctgccaagcctcaagagaaaactggaaataggttaattttaaagttacagttagttatgtaattgacttaaggaatcagattttttttttttctttgagacagggtctcactctgtcacccaggctggagtgcaatggcgtgatcacagatccctgcagcatcgacctcggagctcaggtgatcctcccacctcagcctcccaagtagttgggactacaggtgcacaccaccacgtccagctaattttcccattttttgaagagacaggattcgtcatcttgcccaggctggtctcaaactcctgtgctcaagcaaccctcccaccctggcctcccaaagtgctgggataacaggcattagccaccatgcccagcccagatgatacattataagtacctacataaggttaagaaaccagtgagattattttcctaaactaaaagaacttccacaaattttggcaatctttgaagatcactaacaagtttcttaagacatgggagcattgcaagataggagcttgggggtgatgaaatagagccagaaaaactggactctattctgcataaattttctttcaaaattaagacaatcttttgcagattaaaataaggatcttcaaactctgtttccgtggatcactgattctctgtgccctgaacagagtcattctactacccaaaatcagataatgaagatcctttgtcaactaacacggaggaatagttaagaagattgttgtcaatttcatgatgcactcacattttgtaaccttgggtacttgctatatagcttgtctacacaagcctctattatataaggagtctgacttattacaaaattatacattagctattcgaagcttattttttaacattttgaggtgtcacaggaagaatgctaaaacttctaggggctctgtcaccactaaatgaatttgaggaccaaccagagcaacagtctgtagtctgtattttcttttatgactaatcttaatacataaatcataaagaagttgacaggagtaaatgcatagtttcttttagtagaagagctctaaatcacaaagaccctcatgatggttttatgaaaagggtcctttcaattccctagcacctagcctggtgcctggcatgtagtaggcccttcataaagtggtttgacctgaagatggagacataagcactgttgtgtgtccttacacgagttacgtggctggcacagccttgctttcctcatccagaaaaaatcaacaggggagaggggcaggggataaatgttatcacaaaattgtttacctaaagtttaataggaacttatcatttgcaaatcatattagtgaaggttgctttttgcattagagcaactgtgctctcctttctgctttggacactagcaactctaaattggtttccagtctttcacagctccgtgctgtgctttcaaatcctcactccagtcccgttgtgatctgaatgtttttctatcacgcctgtttagagacaaggtctggaaacatggcacagagtatagctaaccaccttggccaattataggcatgaccctgtaaccttgttttttcactgctccaatccttcaattccaggaacttatgttcccaggaaaagctagttactgaaatggacacacgtataattagtttagagaatgttccaaactctactccacgtcattttttttttatccttgcatttactgtttgttttaatggctggaaagggaagtttaaaaggaaagtgccagaaacaaaggagaatgtttaaaacatacaaatcaccctataaacataaaaaataaaaaacaaaggagaatgcttaaaacatacaaatcaccctataaacataaaaaattttaattcactggtagtaaaagatgcaaattaataattactattaacttaataaatccacaagatactttatcttaggtagtaaagattttgtttcgtctccctttaaattataacatctagagttgagataaggaggtgaagaaaaggatagtttctctcatactaagctggtggaagtataaataacaggttgagcacacctaatgggaaaatccaaaatctgaaacgctccaaaatccaaaactttttgagcgctaacatgataccacatatggagaattccaaagttgaactcatgtgatgggctgcagcataaaacagtcaaaactttgtttcatgaatgaaatatttaaaaatattgtataaaattactttcaaacgctcaaaactacacaaatacctggaaattaaacaatctcctcctgaatgatttttggggttaacaaatcaagatggaaattttaaaattcttcaagatgaatgataataatgacacaagttttcaaaacctctgggatacagcaagaggaaagtgctaagaggaaagtttatagcactaaatgccaacatcaacaagtctgaaagttcacaaaatgacaacctaacatcacacctcaaggaactagagacaaaagaaaacaccaaacccaaagctagcagaaggaaaaaaaaaaataacaaagatcagaacagaactaaatgaaactgaaacacaaaacaaaagattaataaaacaaattggttctcttaaaagacaaaactgatagaccattagctacactaaccaagaaaaagaagagagaaggttcaaattagttcaattggaaatgaaaacggagacattaccactgacaccacagaaatacaaaagatcatttgagactgctatgaacaccccatgcatacacactagaaaatttagaagtaatggatagattcctggaaacctacaaccctcctagcttgaatcaggaagaaatagaaatcctgaacagaagaatacacacagcaagatcgaatcagtttaaaaaaaaaaaaaaaaaaaagccaacaaaaaaaaatcacagggccaggcagattcacagccgaattctaccagacattcaagaaaaaattggtaccaaccctactgaaactatgccaaaagactgagaaagacggaatcctctctaactcagtctatgaagccagtattaccctgatagcaaaagcatgaaagaatgtaaaaaaaaaaaaaaagaaaaagaaagaaagaaaactacagatcaatttccctgatgaacacagatgcaaaaaagactcaacaaaacactagcaaaccaaatccaacagcatatcaaacagacaattcaccatgatcaaggtggggttcatcccagggatgcagggatggtttaacatattcaagtcaataaatgtaattcatcacataaacagagctgtaaaaaaacatgatcatctcaatagacacagaaaaagcattcactaaaatccagcattgctttgtgataaaaaccctcaacaaactatgcatagatggaacatacctcaaaataataaaatccatccatatatgacaaacccacagccaacatcatactgaatggggaaaagttgaaagaattccccctaagaactggaacaagacaaggatgctcactttcaccacttctgctaaacgtagtactggaagtcctagccagggcaatcaggcaaatgaaagaaataaagggaacccaagttggaaaagacgatgtcaaactctctctgccaatgataaatgaattcagtaaagtctcaatttaccaaatcagtttacacaaatcagtagcactgctatacacaaaaaacgaccaagctgagaatcaaatcaagacctcaacccattttacaataactacaaaaaataaaatacctagaaatacacttaaccaaagagatgaaagatctctactaggagatatatatatctctgtcccaaaatccaggctcagcagaaggatcaaagccaacacttcaccaaagaggaacacacccctaggaaagccaacatttgacttttgacctgagctgctaagataaactgggccaaatttctatttattaggaattcctatttggaagcccagtcgtgcttgtaggctctggatctgaggtgctatgaatcaggatcagagccagtgaccatgtggaatgtggagccaatttcaacataaataagcagataagttgtatgatgcatttttattataatcatatattactttcaaaattaaaaacaaatgcaaaaacttttggtaagaaataacccaagtatctgattgcatgtcagagaagaggatactggtttcctgttggtgaataccacctgcatctattccaagcccacacaaagaaagtgctggaggcaaaacagggataggtacttgttttcagaccacaattgttggtttctgctttcctgttggtttttttcagagctgtctataaacacaggagtattgacttattactgccataacaaaaacaccttgtatttgcaaaacatacttaagtggaggtacgggaactgttctgtagacactggctaagtcagacacacagtcatagaatcacacgggctgctgagctcaaagcactttataaatcaacccatccaggccaggagcagtggctcacgactgtaatcccagcactgagggaggccgagaggcaggaggatcgcttgagtccaggagtttgagacgagcctgggcaacatagttaagactttgtttctacaaaaaaaaaaaaaaaatttatgagtgaggcgtggtggtgtatgcctgaagtccaagctactccagaagcctgaggtagggggatcacttcaacttgggaggctgagctgtgactgtgccactgcactccagcctgggcaacagagtgagaacctgtctcaaaaagaaatcaacccatcctcccgttacagatggatactcatggagggacatcaagttttcacattattcacgagctatgtctgtctagccccatttttttaggggatctgaggcaagagattcatagagaaaaatcaaggtgctgggaaaagagcaattactaatccttaaagaactacactctaagagagtccaccttctcttgaaaggaagtcctagatcacaagctgatcctaattcaactataattcccatactgtccctagaatagctccagaatgtacaaattccccagggcacttaattctacctggggccaaaaaagtccccaatgcagctcaacatcctctggagtaatggaaagccaccagatcagaaggggaatggaaggagaggggcatgaaatgaaaaacagattctccctaagattcagtgatcaagccaaagctgccaagaaacatgaagatcacaggcccaaagcacccaccctgagcccctccaggctaagctgaggtggggaaacgggggcagtgtcatggaatggggagaacatgatgccagaggtggttgcctcaggctctgtaaggaaaacacacattttgaaacatgaacaaccatatagacaaattcaaagaaaggggcaagactgtattcagtctagacagctacttcaacccttgttgtccagtggagacactttcaatccagccaagctatcctcttggctctcaatttaggacagagaggcctacgttgaatgattagagcctaatagggtgcacctatgatcattcatcttggacccagtattcatcaggcctctaaacaaagaacagaacagcctggggtcaaccatgggcactcacccatttgaataggcaggactcactcaccccacatacacacacatactcatatatgcacacacacacatactgatatatgcacacacatataaacttaaccttggggttggctgctgtcaaacagttctgtcatccattcctgatgactcacaccagagaaatagatatataagtaaactggaaaactacaaatcacccctaaatcatttctttccaggaatgaggatgtgatttttcagcaactcaacatttctattagcttatttatcccacacatcttctccttcccaatactgaaactagttgaaattccctgaagtgacggcaagtgaaagaaacaggttagagatgagtggaaaaaagaaacagtccaggattttaacagattttcatggttgggaggtcatcaacattcagacacccaaaaatcaacaatatctatagacccctacactgcaggggaggtaaatgactacaataactcttctgtatctcagagaacatacaggcataaagaatggccaagtaatgtgctatctgacaaataggacaatcagcagtatacaacattatcacatggtcttacaacatcacagcaaaattataacattgctttacaatgagcaaaaatccttttcgttcctggccagcaacttgattgtaatacagatacccaatattttaagaatcatggaagaggatgcctacccaaaacacttagaatttccactacttttagtggtacaactgattctgtgaatacagacaaacaggaatgcaggaaatgctagaattcattcgtcaacctgaaataatttcccccaaataaaccctgaatgtgttagaattcaagagtgatgcaaaccattgtctaagcccatagtctcagaggaaagcacatttattaaagcacgttaatgttcccttggccatcctagcgtgaggtatacagcatgcgcatctttaatggtgccactctggaatgcacatcctgcactctgcactcttctttctttccttgtcctactcctactcagagccactctgagcttaaatgcaaaccagcttctctgtactagcagaaaaggaagaaccagggtagatgggatgaaagtgtgattccttcaaccattatcataacaattacataggtactaagtcaccactctatttgacattacagattcattaaaatgaattccataattccaaatcgttttcttttgatatgtctatgctgttcagagtctggtctgtcacttttggtacctcaggaactaattcaagagttgaacaagtcctagaagctccattcatattaacccaactcaaagaccacaatgctccaagtagaaataaatcccaagagaccacagggttctagttaggctgatttaccacttaacaaagaaataaaagtcctactggtttcaaccctgatttgaaaaaattctttatataatgcatatttttcctatctcaagagggcagagtgctctaaacaggatgaaactctctgacaatgactcaaggggcattcttctgaacacagaatcacagacatcttccacgctacagtccagccctcttgttttacagaagcagattaggacaagtgacaaatgtgtccaaagtcatatcagcacttacattcctatactcgatcattaattgacaccaccaatcccccaagtatcccaatctcagaacttggaatatagcctggataatgagtaaactccatgcttctctgaataggcttcaacagtatgagccaaagaaaaaaataaattagttccccccgcttctgatctaaacccctagaagacaggccagtaggtagcaggtcttgccctcatttgtgaggaatgaggggctgcaagtggggaagtgtgagaatgtcagaaggtaacttcaccatgagtttccttgtagacccagtaagagacacatggtacaactggtcattagcaagacagcattgcctgccacatccatcctatgggaagataccaggactatgatattctataggcaataacactttcttccttgccagctgcacccattaacagaccacagtttgtttttaagtgatctagtacttacatttcacaatccagttgaaccatgggaattcactgggtaggatttttgataaggtatctcacccggctcaaatatattaagctaactcagaaaggtctcctaaaataatcggtagattcctgaagggtcaggatgctgtcctgattctagggccaaccactttacttaacatatagtagatattcaatagttatttgtcaaactgaactggacatatgttgggtatgttaatattgggactaaatatgcaaaaaaaaaaagagagaacttcagaagtctgggttttattattacaatttgtaatgatgtagcatatgtactgaaaatatccccagagaatatctagtcaagtcctttatattcatacagcagaaaattgaggctcaggacagataagtgaatgcttccatacttacctgttatatggggtactgaaccagatcttacacacacacacacacaccccatgaccacaccgttttttcgggagggtgggggtcacttgctcttatcatctaggaatgaacaagcgaaaattccaatgacaggctggtaaccttggttctcatcaaattgaagtttcacattaatgtgttccagaggataatgtgctaagttaaattaatcatccaattatttagttaatagactaagtttatctgggataatgtatgttttcaatataagaccttttctaaaaatcattaaatcaatggaaaaatatgaacatttgaaataaatactcacatgtaagttaagggccatttctcggaaggatctggtatctcaacctctctcatttaagaagtctattttcctaacctttctgtatataaaacatcaccctcccacacacaatcctagattaaaatatatattcctgtctctcaacaacattttcatccccaagatccaagccaccatgtaaacctctggtttcaatgatgctttatagccaagactggactcttaagaagcagaattgggagcagaatagtgagaatttcattcaaactcaatgtttttcagaagagaaggcccagattataaaatattttaccccaggtcattcaattaaacagcagggcctgaatcagaacgtgcctttgtgatccacaaaactgtctgcctttatggaagtgattttgagactctcaaagaacctattactgaaaaactgcctcttccctaaaaaatggatcaaactccagttacctattttcattcctgttaataactatatttctacttcatattttatgtctagaggttgctagttttgttatttcttcttcttgtagctaataattattgtctcctatctctattaagtaaaataatggcaaagtatactgatccttttgccaagcagagctgagagccccttcttgtactcctcatatgatctcattaaaataaataattttcatgttccaaacttttaaaagttttatttaatttctaaattcacttattttttccccacaaaaaatttccatttgtctttctttcgtattaaaggtttagacaggaaaccagataatgaaattcagtggaatgaacaggcactttaattctgtttgccgggcactggcaacaaaaagtatttgggaacataataggcacaaagggagtcactgggcagtaaaacttctggcttatcttctcatccaggttgaattcatttggatggggtgggaaagtaggataacaatatggcaaattttccactttgttgccaccattggtgggaaaatgttaaggcagagactgcaagccctgtggcatggtacaatattttagagtttttttctttatggcacaatattttagttttttttttaaagtataatcacaggctgaagtgaattatgcatttataaaaactagaaatgcaaaaaaggaattctaatatcattagtggttttgtaataacacaactgtaattaataatttgcatcttgaacctgtgcagataaagctgaagtcaaatggcagttcgaatctcccagttaaccactgtcactgttaacaaataaaaaaagattagataaaagtaagacacaatgaagcaacttttgtttaaagatttttctacccctacagtgcagagagaaaaacaaaagggaatcacataatttaaaaagataagggtgaaggggaaagggagcattttaatcacagagtgtaaaataataaggaagatgcatgtatgtatgcttcccagcccattattgtctataaccctatggttccacgaagaaaggaaacaggaaactggagcaagccatctaatgaaccaatgaggccaaaagggtaaaacagcaaccctctccatttggatgacttccaaaattgcatccatccatctgagaaatgatcattgaatgcttactttgagtgaggcaatattctgagcaacagggatagagcagtgaaccaagcagagagcaaccccatccatacaacccccatttctaatactgcttttaggctgcaaaaatgtatttccaacatggcacctccaactcacacatctagttgcaagatcatcttctttgctccccaaattactccttctatgtgtcccctgtctcagttaaaagcattaccatccactcatttcttctgaccaccaaattgttgtcatgttaaactccaacctctccatttttacctctaccaactccttcagtatatcacagaatacctgattgctgaatatctacaaagtttcttgactctgtctccaccttttcattccctgtaccattagggacctaatcatcttttgcctagattactgcacaagcctcctgaggattttaggtcttccctctgaaagctgctcaatacatcctccatttcacttgatgaaaatcatatcctttctcctccctaaaaaacccccatatgaatccttgactcctctcttcattcttccgcacatccactccatgagaaaattctattgattcagtctccaaaatacatccatattctgaccacttgtcacctctccccttatcacactgttcaaaccaaattcatctctacaatgactataatacttcactggcctcccagctttaacattgccctaggttagcctattctcaaaacagcagcgagagtgatcctttaaaaatgcaagttagtcaatattgttccctactcaaaaccctatgaggtacccccacagtcactaagagtaaaagccaaagtccttaaaaaggcctgaaagccctagatgatctggcctcttatttcctaacctcatctcctctattctctcagtcactcaccctactctttctgcttcagccattggctcctaaaaattcctcaaacacagaattgctcctgtcttaggacctttgcataggctgttccttctgccaggaacattcttccctacatatccacatggctaactccctcactccttcaagacttttctcaaatctcacctcctccatgaagcctaccttgaccacctatttcataatgcaacttcctcctatatactcacaacccctttatcatgtgctattttttccccaaagcaattatcatctaacatacaatatgtagtttacttaccatctttattgtttactgtgtctctccccattagaatgtaaactctacaaggggagagattttgtctttgttcagggttttatgccaactgcctcaagtaccatgccatagttaaatgttcaacactgactgaatgaatggactgatcaccctggttgcaggatctttgccccaaggtcatctttttcaagcacagctcatgacatcaactccctgctgtaatttttttaaataaaagtataaatcagacttcccctaaaaaaacccaactctttttgctgatccctttcaacatttttgctttaatatcacttttaatgttcttagtacaattgttatattttacaaaatactctttctggaatgtagtggttgtttggccttctgtatgacattttaactcacctagtttcctttagaaagttactgactttaaaagaaaatctttttgagcacgagtgctgccactttaaagactacttacaggacattttaggggacataaaaacaatcctaaataatcacaaatattaaagtaagagcatggtacacttgcaaaaattctgccagagataaggttcagccgatggtaacatccatgagctgtattcaggcactttgcaattgaatgtatcatagtgattctttttaaattgaagagggactccgaattatttcagattttgcacttttatggtactttctatcatgccctttcaaatttatataaaaaatgttaactattgtagctaagtttgccaagaaaatttcagtgaaacaaaaggtttttagactcagattttctgtttatgtttacaagcacatctattccatatatttagaaatacttgtatttagacagacatacttaaagaaagccccttaacacattttataaaacactacaaactgactttgtgtatgagttttagaatgatggctgacacttacgaagcagttactatatatcaggttccatattaagcctcgtttaacctccaccacaaccctgtgaggttggaactattactattcgtatttacagatgagaaggcaggggttcagagatgttaagtgacttgcccaaagtcacagaactactaaatatccagttttttatttcagatccctgttctaaacggctccatgtcaggcttactgctttgcctcacacttaaaatgtatgaaagagaaacgactaacttcattaactgccagttgcagcaacatcttttgagcctaagcaccttcactagtcccagagtcatagcagccatatttgaacaacagaatcccacctcaactgactagaacagagttaggaaaatccacctcctcgggaattcagagttggaaatgagagcagacctctccccgtggctgtacataatagatgaccttgggaccagcttctgcctgctttgtaggcaaagtagcagaaaatgtcagtttgttgagaaagaagcagatgtgtagagaaaaatcacaaagtagagacaaaaatcccagagtcactaagacctcctgggtttggttccaagtcttcctgagtatgggtatgtccctgcttttggatttcatgagaaatcccagaaaccggaaaaatctattatctctctgtatttagtggtttaagtgggttcctgttacttcaactaaaagtttggttattcaatactcagatctgggtttatacatggggctgaaaaccaaataatcttcactgagcaaaaagaaaacagaacatagaaggatttgaaatgctggcatttagaaatatagtcaattaatctaaagaacaaagtatctttaaaataaaattgtgatagtctcaagacatcaggaaaatggttttatcttggagagttagaagatgaaatgaacttacaggaaaaccatgtgagatactaaaacacaatgagcagcagcaatagaagatgacccaaaaaaagcaagcttcttgccatcacattactaacaataaaatgcacacacacgtgagaagcaaaaaataattggctctattttcaggcagacaaaaagtaatttccatatattccctgtatctgtgttcaaagattttaggcagcagaatcatctggatatttattaaatggtggattcctgggtctcaacacagagctacagaatcactccctggggatggagctgtgtttttgtttttgtttgtttgttcgttttgaattggggtctcactctgtcacccaggctggagggcagtggcgggatctcagctcactgcaacctctgcctctcagattcaagcgattctcctgcctcagcctcctgagtagctgagactacaggcatgtgccaccacacccagctaattttttgtatttttagtagagacggggtttcacattgttagccaggacggtctcgatctcccgaccttgtgatctgcccacctcaacctcccaaagtgctgggattacaggcatgagccaccgcgcctggccagagctctgttttaaagcaatgatcctcgaaattgtttgtttcagcatcctctgcattaatattctgaagctatatacttatactcacttatccatttttaagttgacatctagtttgataagttgcataaggacataatttccaacttgttataaatatccagatttataaataaaactgttaatcattcccttacattgataaaaatctctctaggtatcacagagatttgaaaaacattactttttttaaaaaaaaaagaacaagcctggtggtgacaaaatctctcagcattagcttgtctgtaaagaattttatttctccttcacttatgaagcttagtttggctggatatgaaattctgggttgaaaattcttttctttaagaatgttgaatattggcccccactctcttctcgcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaatttggttccattctccccgtcactttcaggtacaccaatcagacgtagatttggtcttttcacatagtcccatatttctcggaggctttgttcgtttctttttattcttttttctctaaacttccttctcgcttcatttcattcatttcatcttccatcactgataccctttcttccagttgatcgcatcggctcctgaggcttctgcattcttcacgtagttctcgagccttggctttcagctccatcagctcctttaagcacttctctgtattggttattctaattatacattcgtctaaatttttttcaaagttttcaacttctttgcctttggtttgaatttccacctgtagctcggagtagtttgatcgtctgaagccttcttctctcaacttgtcaaagtcattctccgtccagctttgttccattgctggtgaggaattgcgttcctttggaggaggagaggcgctctgctttttagagtttccagtttttctgctctgttttttccccatctttgtggtttcatctacttttggtctttgatgatggtgatgtacagatgggtttcattgtggaagtcagtgtggtgattcctcagggatctagaactagaaataccatttgacccagccatcccattactgggtatatacccaaaggactataaatcatgctgctataaagacacatgcacacatatgtttatggcagcactattcacaatagcaaagacttggaaccaacccaaatgtccaacgatgatatattggattaagaaaatgtggcacatatataccatggaatactacgcagccataaaaaatgatgagttcatgtcctttctagggacatggatgaaattggaaatcatcattctcagtaaactatcgcaagaacaaaaaaccaaacaccgcatattctcactcataggtgggaattgaacaatgagaacacatggacacaggaaggggaacatcacactctgggaactgttgtggggtaggggtggggggtagggatagctttaggagatatacctaatgctaaatgacgagttaatgggtgcagcacaccagcatggcacatgtatacatatgtaaataacctgcacattgtgcacatgtaccctaaaacttaaagtataataagaataaaataaaataaaataaaataaaagaacaagctccttttcagtcatatatcctcttttaattttttcttgaattcatacatcttttccatatccccagcagaacttcaataacatatttttatgcttgtaaatcttttactgatcactctatcatgctccccacaaataaactgtgtacataattgcagtctcacattttacatttcctgtggccgtaagttttcaatatttttaaattttctcttatggactaagttcctaaaattattattggtccacaattgatcaaaattaatatataataaatgttgacaaatccataatgtataaaaagtaaaacttttcagtaatacatctcttaatgagatggataggttatatttttatttacacaacatagaggattttttaatttttttatttttaattttttttgagacggtgtctcgcactgtcgcctgggctggagtgcggtggcgcgatctcggcccactgcaacctccacctcccaggttcaagcgattcgcctgcctcagcctcctgattagctgggattacagatgcctgccaccacacccagctaattttttgtatttttaatagagacagggtgtcactatgttggccaggctggtctccaacgcctgacctcctgatccacctgcctcggtctcccaaagtgctgagattacaggcgtgagccaccacgcccggcctgaggattattatttatcactaggatgagatacagttcagcatcagttctattcctatttttcacattttttaatgtagatataaaatatacgaaacctgctctcataaataaaataggaatagaagtttagcgactgtaaaatcattcaattctttggacttcttcttaattatgtaacaaaaaattgcacatgaattatcaatatttttaaagatcagctgacaatttgagtatattttgttttattgaaagcaaagaactgaaaatggtttgttatctggtaatattagagtcattcactttctcaacactaacatcatattttgagtttttcctttggcttgtgccctggaggtttttatttccaaggccaatgcaccaagatttaggatgagagagtagcgcctttctctcctaactgaaaatagagtagtcgtgaaaggggaagcgataaaggagaatccacacaaatgaacaatgattttcttagactcctatcactgctacctaccataacttagaatgcccacgtatccccaggggcatgtgtatcctggtttcgacacactaattggagctctgttcattcatgcattcattccacaaacatgtattaagcacttgcaacatgccagacacttatctaggcactggagatacagcaatgaacaaaacaagaaatcccctgccctcatggcccttctaaaggaagcacacaatctgttaggtctgtgttgggtgctacggccacctgcctgagcctcctgtggcctgctcttctctctactctaaagaactgtattcccactgtaataatttgaaatgccaactagactggattaaggaatatctagaaacctgtaaggcattgttttggaatgtgtctgggatgatgtttccagaggagattggcatgtgagtctgagcggactaggtggggaagatccaccctcaatgtgggcaggcaccatccagtctggtggatggtggtgaagacagtaaagaaacaggaaaaaggtgaatgtgtcattctatctccaggatctggaatacactcatcccctgccttggacaacagaactccagggtcccaggcctttggactccaaggtttacatcagtggctccccgggttgcctggccttcagccttggactgaaagttacaacattggctttcctggttctgaggccttggggacttgaactgagccacactaccagcatcccatggtctccagcttgcagatggcctgttgtggaacttctcagactctataatcacataagctaattcccctaataaatcccctcttatagatctaaacagttgtacagttgtccctcagtatccaaggggaattggttccaggacctccttcaggtatcaaaatccacagattctcaaatctagatataaaatggtatcgtatttgcatataacctatgcacatcctcctacatactttaaatcatctctagataacttagagtatctgatacaatacaaatgctatgtaaatagttacattgtttgggaaatactgtttagggaatgacaaggaaaaatatctatacatgttgggtacgaatgcaaatttgttttcaaatattttcaatggtggttagttgaattcatggatatggaatctactgaccatatatatatcctttttattctctctggagaactctaatatgctaacttagtcaacagagagccaggaagtacttactacgtgccagaacattagctaaacccaaaagaatagagaggatgcagactggtcctccacagtatacaataagcataaaacctctcattcagattcaccttatataatacattaagtcactgtttaaataagtttatgttctacaaagcaaagaccaaatcatcaccagggtcaagcagattctcctctgcctatgtaatattaatctattggctgtgcttaacatttatttatttatttatttatttatttatttatttatttaaattggtttttttaagacacagggcctttctctgttgctccggctggaatgcagtggtgtaatcataacttggtgcagcctcaaactcctgggctcaagagatccttctgtctcagcttcctgaatagctaggcctataggtgtgtgccaccactcctggctttttttttttttttttttttttttttgaagactaggttttgttatgttccccaggctggtctcaaactcctggccttaaagcgatcctcctgccttggcttcccaaagttctgagattacaagcaggagccagcatgtccaaccttacagtttgaaacataattttgttcccaaactacggatatgagtaaaccacatccttggcagtgactgcgttctaggataatttttaatcattgacaaaacaaattattcttcctatcaagaaaaaagtactagttctgaggataaaacactacatgtttgtcaagaaaacaaagtcgaccatccatgaaaagaaagtgcacaaaaatgtacaattcctagggtggaaatttccatcaatcagatatactcttggtgaaaatcaagggtcaccatgtcacttaagttgcaaaattcaaagtattttaagttcctaagttaaataaccccaaatgtttcttatcaagaaaaaaagcctctccacctaaacacatagctacaatttataattaccaaaagaaacctcacaatggccctttgtaaaggatgatcctcatgtagctaaacaatttcccactccctcttctgtggtgccttttaaaattatcattataacatctacagtcagaaggtaaaaattgttttttcctatatgaagttaatatagaatacataattagaacttattttccacttgtggtaattaatatgcttgcaattatagccactattccataccattaatccctaaaagtaaaggcagctagcagagtaaggagacctctgagacacagaagaaagctggctggaccacatgaaagtggaactcttaaatctgccttcaaaagtgcaacagtctagccacaagaactacctagtatagaattaacattctaatccaaatgagaggaaaattctaaggttccatcttgatcaaaatattatgattataaaaacattccaaagttcagcaaaccgtactaaacttacatagtcccatatctacctctaaatatgctataaagatacaataaaaaatagattgtgtagtgaaaaataagagatatagtaggctctaaatagggtacagtccatgaatttggggtaaagccagaaattaccagcctctgaaatttaggttaattatgaacttaaaaaagcaacaccaatgatgggataaactggcaccctgtgctcctgctgagatgcactgagaaggatacagtgtcacctatggaatattcctgtccaaaatgtttaatcttaacctaatcacgaagaaacaattagacaaatctaaactgaaagaaattctgcaaaataactggcctggcctcttcaaaaatgtcaaggactaaaagacaaaaaaaagttgagaaattattccagattaaattcaataaattcatattgaatacctactgtctggataacggcagtgtgtggtggctaagaatgtatcaaattctgcctcaaaatcctatctctaccagatggaaaagacatctaaccatgccatgtcctggtctcctctcagtaaaatgaggatagtaatattacagtaccttcttcaaaagattataccgagttcaatgagttcatctataaaagccttagcacagacactgctcaacacttaataagtgctcggtaaatgtcagtggtgatcatgaccatgatgatggtgaagagccaccagatgctgggggaggggaacagagagactaacatcgtcacgtcctcactgtgcttacagtgagatgtgagttacagaaaaatgaccaggcaattctaagatagtgcaatagatgcactttggctgatgaaaggctctagagttcaaaggaggccgttaggtctttctaagcaaggaatgctggcattggaatccaggtaatgacagagaggtgaggcaactagggtagaagagatcaaacttgaggactgctaggatcgtgaggcaggggagtgctgtagattgagtctagttcctggcttggcagctgaacgggctgtggtgccagtcactgagaaaaaggagcccagggcatgagcaggtttaggggcagcaagagagtcggctgacgctgggtcagactcaaccagaagggccacccaaggggacttgtgctggactcacaaaggcatgtggcagagaagtcctgatcttgagagaaaaggatacattctgcattccccagaataaaacacctaaagcaaacagattttatcttgttcttgcctggactctaatttcaaaacatgataaagaaaaatacagcagtcctatcaatcttatgtatttcacagtgtaactattttactgtaaaaatagaaattaggagggacatttgtggctctcaataggttcattaaacctaaaattgtaaattcccctgccagaaaggtggtatgctagccagatgttctcactctaattgagaacattattttgcttactaaaggtaagaaagaaaacatttaggtcaggctcggcggctcatgcctgtaatcccagcactttgggagactgaggcgggtggatcatgaggtcaggagttcaagaccagcctgaccaacatggtgaaaccccgactctgctaaaaatacaaaaatacaggcatggtggcacacacctgtaatcccagctactcaggaggctgaggcaagagaactgcttgaacccgggaggcaggggttgcagtgagcccagattgcgccactacactccagtctggatgacagagcaagattctgtctcaaaaaaaacctttataaactctcatttcctaggttataaaacacataacccctcacttctacccacagaaataaaactgccaggaacaactctgtgtgcttatgtgcctatgggcaaaaatacataaactatattgatatcataaagaaaacactagattcaatcttggcccatagagtctcaattatcaatccaatcagaagctgaagctggatttgccacacaacacaaaaccagtcttgctgccacactatgtgctcattcagtgtgtgcctgacaatggctacgggcaacactgattctctgcctacacactgtctttgaggtacactgcaccgtctgttggcttaatctcagatcaaactgccttagctcatgtacttgtgaaaaagatgactgattgtccccaatatccattctatatgcccccttaggagtagaacccctagagtcttggaggcttactagagttcacctttccaagcttctttggtagtcaggtatcatcacgtaccttaagttctggcaactgggatgtgagggcaagtgatgtctgtgatttccagatcatgcccccagaaggaaactacttggcctccactttccctttcccacagaataaacaaacatacgggagtggtgaacctcctgcagcctgcacatgagcagaagcactgaggcaatggaagaacaacaagctagaaagagcctgagcgcctgactcatgaagcaaagagctagattccaaagtgactactggcttaaatttaaaattttatattattattattttatttatttttttttttgagacacagtctcactctgtcacccagactggagtgcaggggtgcaatctcggcttactgcaagctctgcctccccggttcacgctattctcctgcctcagcctcccgagtagctgggactacaggcacccgccaccacgcctggctaattttttttttttttttgtatttttgtagagatggggtttcaccatgttagccaggatggtctcgatctcctgacctcgtgatccgcccacctcggcctcccaaagagagacagattcttgctatgttgcccaggctggacttgaactcctgggctcagcctcctgagtagctgagactactggcacacaccatcatgcctggccagcttggatttttatatgagaaacttattctgcttaagctactattattttggtctttataaaaacagccaagccaacaccttaattcatttccactcaaatcattaaaatgtgtgattatgcagaatttatgtaattaaggtgtgtctcactttgttttagagttttgcattcctttataatgactgcagacatctcagcatcccacacagttgacaataaatgcttatgttggaatctccaaggggcataataaacaggtacagttaataccactcttctccaaatggtcatatattaaatctgctctttaatttgttgctagaaccagtatttgcagagtgcaagacttccgatctatctgacaaatttttaaccttggttttatatatgatgacaacattctacacccagcattaggactaggctacactggttttcttttttctctagaagaggacagattgtactaaggcctaagatcgtactaaggtgcttatggtaggcagaataatgtctcccatagagtcaattaccatcacaacccaacacgttcatttcctaatcccaggaaactgtgaatatgttatcttacatggcaaaaggaactttgcagatatgattaaggatcatgagatggggagattcttctggattattcatgtaggcccaacttcatcacaagcgtccttataaagagggagacatgagtgtcagagtcatagaggagatgtgataatggaagcaaaagctagaagtatgccattgccagaaggggccatgagctgaggaatacagatagctgctagaagcacaaaggggcaaaaaatggattcctacccagaacgtccagaaagaacacagctctgccaacaccttgattttaggccagtgaaacccacttcaggcttctgacctccagaattacaagagaatctatgttgttttaagccacaaagtttgtgataatttgttacagcatccataggaaatacagtgtccttacatgtagcactgtatattgtaataacccaattgaattagggtaggatttgtccagacctaaagagctaaatgaaaataagcaattttaataatatataatcttattaataatattgttactaatattatcagtagtaataccaatagtaacatacaattgttttgcctttttactgtaatcacaaaggtagctctccctgcctccctccccccgcaaaaaagaaaaagaagtcacagaaattgaatataagtaggtacaagcaaatcttgtaactagataaaaggatgatttctacccactagcaaatgactcttcatctcaagatgaaattgaatgccatttttactgctattgttttgaaggatgaatgctttctctgctagtaaaacgcgttcaataatttctgcaggccgggcatggtggctcatgcctgtaatcccagcactttgggaggccgaggcgggcggatcacgaggtcaggagattgagaccatcctagctaacatggtgaaaccacgtctctactaaaaatacaaaaaaattagccgggcgtggtggcgggcgcctgtagtcccagctactcgggaggctgaggcaggagaatggcgtgaacccgggaggcagagcttgcagtgagccgagatcgtgccactgcactccaggctgggtgacagagtgagacttcgtctcaaaaaaaaaaagagaaaagaataatttctgcaaaggccaaagaagaatttaaagagtttttaaagctcttcttgataaccaaaatctgtaaccatgcaggacattcccctggtattatttagttcaaatctccatcacttgtttcagttttacgcagctgttgggtacagaaaaccaaacagtcacccctgtggcttccgtatgcttcaaacagtaccattcctggagaagggcaagattcactggccctagcttcattcatctgggccgttcaatgttggccaaaagggtccacaacccacaggaaggtcactagaagctaaaattatcactgctcccttaacctgcttcttgtcagcaccagctaattgcccaccattgtgcttctggctccatgatggtgttattatagttcccaacgcagggaagtctcagcacaacacctttggaaaatgcttaccctgacattcctaagagcattccaaagcaatgcccttgtgtgcctctctggcctggagctcaaccatgcctgatggtagaaggttcacttcaagatcacattcttaagcatggcctgttttcactgccaggatttcataaaatcatagaaccacaattgtactataaactcttggcctaaatttacgtcccctccttcctcctgaacagaaccaaatgaatgttgcttaagatccaaaacagatccatataacaggactccttttgtttcagaaactaaattacttctttgtgatacatccctacattacattagaataacactatctcctgtgctgtactcataggaagtggagttatctccttggaccagatgcttggttttaaagattgttttgtttgtttgtttgttttttatctgcttccctctgtctcaatttgttctgggctttggaagccttcatatctccaccactgataatgtctaagtttttctacctataccttaagtttcctgccacatcttcctgagttaaggccctttaaataagcatcactgcttttcagggtctggagaaaggtctgtctactccaaacctcagtgggaaaggtggacggcatgcactggataccctttgttgtctctgagtaatgatctttattaaaccttttaatggaggcatacatttacctgtatatcacacacttaacctaggaagctttctgtcctatatatgttccaatttggtcttgctcacttcagatatggattcctaatatgtaaaatataaggctttttgctccttaacttctaagtattttaactcactgctatttggcagtaacattaaaagcaccaaaaaaaacaactcagctcaacaatctaacactatttctcatcccaaaagctaacccataatctttttaggtttcctcttctactttttgttttactcataactcagcatttctttgcaacaggagctaataagagtttgtttttgtttttttttttctggtttatgttatctgcaatttacaagaattttttttttctcctccctgtgttaatctgccaaaacaaaataccttagactgggtggcttaaacaacagaaatttattttctcacaggtctagagcctggaagtcccagatcagggtgccggcatggtcagtttctgttgagggatctcttcctggcttaaagatgtccaccttcttatgtcctcacatggcagacagagagagagagaaagcaagcccttcggtgtctcttcttataagagtgctaatcccatcaggagggccccaccctcatgacctcatctaaacctaattatctcccaaaggccccatccccaaacatcatcacattcggagtcagggcttcaacacatgagttttgtgtgggacacaattaagatcatcacactctctccttttagggccgatttttatctgccttggaatgaatccatgaccagcctttcttcattaaataagcagggacagagactgaacacctgttaggtctcaggcccaggctcagtgctaggtattcaaagaggaatacatacaatttctgatatcagcagttccaatattcccaagttctagatggaaataccttattgtgctggcttactgcagcagccatggaaatatgccagtcagagctccctttctggagaagcacaactaactgccggcctcttgctgccacagcttcaggtctaccatggcattcgtgcagaaattgtgtttctactgggctgcgagccagcgcccaagtgtgcagaggtactggaatcactgctgttgttgcccagtgcgaaactccagcaacaggcaactttgcttagggaagccccatccatccagccaagacttctcaggaatacatggcattgtaaaattcttccccatccctccttccttcccactcttccttcacagatgtcagacctacagcatggtctgaaggctctctctaccttttgtggtttcctccctctttccacttcatagacattccccaacttgcattcaaatcccagcttggcaactgcttctcagaggatctgggaaaacagactcaggaattaacttcacttaaaataactaaaaaacatgtttagctttcaagtaacctgttcatctaaccggggacaaatactcatctgagacagctaaagcaaaaggtgatagaagaaataaagaaaatctgctttttcttacattcaaataaaggcaaaacagaaaattattctcactataacttaatataattgggcatacagctatggagcatttgccaagtaccagacgttgtgcaaggtattgtaaaggctataaagacaaacacaagatagactccctgccctcaaggaacttacaagctgcactcctatcttttattcagaatttttacatcattcattttaaacaaattccttaagcattttgtacacacatacatatgttcttctgtacgaagcagatgagtaaacaagattacttcatgtaaatatttttaagtccttacttagaaaataatttggtctttaaaagtaagtatcactatatttccatctagagtctccaaatccccaccctaggcctctaaagggaaaatgtcaagacattttatcacttaatctgattagaaaagtccttcatgctcatctacatagatacatctccaaaatcccaagttaagaaatgagctcaaggcatttgggtcaactgacacaggctggtggaaaaaaaaaaaaaacctcaaacatcttaaaatattcatttttgttgttgttgtattgtgaaatatttacatacaaaaagtatataaagtaaatatgtagtttaaagaataacataaaaaaacactgtgcgctcaccattcaagttaaaacccagaatattactataacttttttttgtttttgagaccgagtttcgctcttgtcacccaagctggagtgcagtggtacgatctcggctcactgcaacctccacttcctgggttcaagcgattctcctgcctcagcctcccaagtagctgggattacaggcgcccgccaccacgcccagctaattcttgtatttttggtagagacagggtttcaccacattggccaggctggtctcaaactcctgacctcaggtgatctgccttaagtgctgggattacaggcgtgagccaccaggcctggcctactataacttttaaagcactttttcttccctccactgctttagaacagtttctcaacctcacgctattgacattttgggcagataattcttaaccagaacattttggatgcttagcaatacccctggcctcaacccataagatgacagtagcatatcaccaccatcaccaccagttgtgacaaccggaaacgtctccaaacacttccatatatcccctggagggcaaagtcaccccttgttgagaactactgccctagaggtaatcacaatatgaatttttgcttttatttatagtatatcaacatatgtaaccctaaaacaatgtattgcttagttctactgtatttgaactccatagaaatgaaattgtactccatgtattttcccgtgacttgtttcttacattcaacattgtttgtgagatacatccacggtgtattattacaagctgtaattcacacaatcattttttcatatatttttgctgctgtattgtaatccgttaaattaaaactccataattgtttaatccaatctattattgatggacattcgtattgcatctaacattttgcttttatgaatatttctactaggaacctttcctacacaggtcttctggtaattacacaacaatttctctgagctatatacctaggagtagaattactcagtcacaagatatgctcatgttcagctttattgctttctaaagtggttgtatatatttatacccccatcagcagtagaggataattgccatcactccacatgatttccaacactagggtcttcacttatttttcacaacatgtggtaccacaaaaatatacattgcttaccgtgtaaatcccaattctacaaacagcaaatgagatctggatgcattcagacattctctataagattaaaataagaataagagaataagaaatgtttgtaccaaagaactgtcttcattccccttgctcttgtttccctctttaaagaaaatctgctgtattccaacatctgttttatgaggaagtggctgaatttcttccgtctgttttctaggctagctcaaagacagggataataaagtctggggcatgtggctttatcttgggactgtaaggcagatactttgtcctctaatacaagagcatcatttaaggagtgtaacttattgtaatggtttaattttacttctttcaaatcttgctctaatatcccattttaataataaatatttggctgctataagtagctttttaagcattctttttcagttcaattcttattagatcataaaagtctataatccttataatggatagaaaaaaatctctataaaagggaaatgctcatagttaaatgctgaaagttatgaatgggctaaattttgacagaagactgagatccttggtctcagaatatcaatggcagtactcaacttagaattcacaacttctaactcccaaatcaaattcagattcctaaaacacatgcccactcacaaaaccatgcataccaaacatgactactggtttcttttcctttctttagctggagaaatatttttagcacattaaattagcatgtagtcaaaataaccctaactttatacagtcgaacactgttattatggtttattgttgacaagttaaagcttctccctaaagtttataatgtcataaatctcagcaatcacggttttatccattgtggcaaggaggcaaagacataggatccctggctttctgtggtagccaaaaggcttccagagatgcagtccttgaggaagaccaagaagtcgcatcagacccattctgccaaaggctcttgcccctttagacaatatccacaagaaactgaattctgtatgattgaaggaatttggtaaataaaagattggaaagccaaaggctatatgcgtggacattaaaaataaaaattacagcaatggaaaatcaaactcttaggacactctgttgagtgaagtacttaaactcaatctaaactttcaaatatcaacggtgctattgttcaaaacaaatggctgataatttcatactggggatcatgatcacatctattattaagttattactatcatgactgtaacattattgggtttattttgaatgaaatacactactgaaaacaaaccaggggccatgccctggcatcctcagagcccaagactaagaacgctcattgccttgtccaagatcattcttcccatctacctttggaaattaccccaagttgtacctttgtaacataatagtgaatgactgaacaactctctgagtaagctggaaaagttatcttccccaactgaaagataactcttattttatgccacctggaataaaagatttaccagcctttcttggggttaagtgttgtcctgtgactaagttctccaaaatgagatgtaactgaaaggtgcttaaagggaactgactctgagaagagcccttttttgctcttctgcctttcctacttcttttccaggctgtaacggagacttaatgtagctccagtgacaatcttgggttgtgacggcacaatgagaacagtggacacatgaagtagaccatacagataagagaacccaaagatgcaaatgacagcagagttgccattccctcctcttccagactttgtacatgaaatagaaatcaacctgtaactttttgttttctgagacagggtctcacttggttgcccaggctggagtacagtggtgcaatctggaattactgtatcctcaatatcctgggctcaagtgatcctcccacctgagcctcccaagtagctgggattacaggagcatgccaccatgcccagcaaatattttaatttctttgtagagacagggttttgccatgtttcccaggctggtctcgaactcctgagctcaagtaatccacctccctcggcctcccaaaatgctgggattataggcatgagccatcacacccagccctctaacttgtttaaaaattgttgtgtgtctctcacagcctaacctaatcctaaccagtacagagcaacgtttgtttttaaaaagtaggtattcccagtgccatatgaaagggctctagcacctatcatgagagaattaactctttttatgagctttatcttttaaggagggagaaatatttactctttagttactaaaaacctactttccactccttttcatattctcaaaatgtacaagtattgttgttgggattgctaaaattattaccctgaaaaccctcaatttattttgtgtaactttttttctgactaaccatattacctcattctctctaatctctaatccttacaaatactgccttatccttgaacatccgacctcaggccaggtggcatgtctattgccccagcttgtaaattcattctaacaataatattctcaacaatggcctcttccctctaattactaggagtcggatacatatatttaaaaacataaccaaacttcctttgatcacagtatatgaactggtaataaattttaaataattatattatttccctatatagatgctatatttgcaagaaactattttaactgtaaacccatgagacataaggcataacttggaatgaaggataagtagttaactatttccaataaaagaatgagtttctatctcagataaactctgacccggtagcctctacagtaatattcataaatctacatctagacttccctgaggaagaactaaagaatattatttcaaagatgaatctcatcttctttgctgcctcatctaataaaacagcaaaaaagatgtcaaaaacaagacagattggttacaatctgtttaagagaggtctatagaaaaagaatgcctaagacagaaaaagaatactaaatttgaaattaatgtgattacttacagtttattgttgttttccctaagaaatttcaaaggtaagcatgaaaataaaggagaaaacaaaacttcaacaagatggcagaaaataaacgttatttactatacagtccaaaaaatggtatcaaggtataatttgagttccatcagagggctaataaacacaatattcttttagagagctattttttatacttaacataattgacagttctaattttgatgtcctgtgcaatccctcatcctgatacaaagcaagatgacagttatattatcttctcctctataattctgcttgatgaaaattaaaaagttaaaacagccaagccagttcttcagagtcctgcaagcagtatgttaaaactggtaaaacaagaaagggcatacgggagcagtaaaaccccttcgaatgaggccctagcttgggtcctctatttccaaataaggttaacaaagatccagcatttcctctcaatagcagacaaatgggctgaaggcaaagatgcaataaatggaggatacagagagtgacgacccgttccaaggtacatgggaacgctaaagtgccgcgtgggtcgaatcctttctgagtaaaggtcgcgtctgtcaattatgctttagtcactcctccagagtggaaataaacacttgggaatgccacctacttcagaactggcatctccttctgttagtattgtcactgaaaacattaacagtgcattatttcacaactcccttagtacacttgaaagtaattttccccaaatgggaaaaaagtaagttttttttttaactaattacaaaataaaattaggatttgtttacaaaatgtagagcattttgctcctcagcatatattttatagcttcttcaaattaggagaaaggatgatgataatctacccaaagagaaacatttgcaatctaaagcaaagctaataaaattggcctctcaacattttctaaaaatgttttcagtggtaacagtgccaacagcacgccaagagcatctatacttccaagcaatctaccaatgtccatggatggaatatgtaagagttcaatcagtattcaaaaaggaatcaaccctctccctattaaaaaataacaatcatcatgattagcacatgatctctgtgaaattcaatcacaaagatttgaaaagccatctagcagaaataacctgagatttgaaaagtcatctagcaaaaataaccaaatgaaagcataaatcatcatatcagaagttacagatttcatccagcaaaatgttagcccatcttctataaaacatcactaaaaatcacacgtaatatccaggcagattttggctgaaatggtgaaggtaagaatagttctcgttctgaaaattctgattaaaaagtatggagggagagaaatccccttctaacttagagtaaaataatgagtaccacttatcttggaggatttattccttcacttttgaccaggcactgggaattttaaaactcagttcaaagaaagaaaacgaaaaaaacatttgcagggctttttttttttttttttaatgagacagggtcttactgtgtcactcaggttggagtgcagtggcgcagtcttggctcactgctgcctggacctcctgtccaggattgcctcaagcaatcctcccacctcagcctcccaaatagctaggactacaggcgcacgccaccatacccagctaattttgtttatttttttgtagagatgagttctcactatgttggccaggttggtctcaaactcctgggctccagtgatcctcccacctcggcctgccaaagtgctgggattgcaggaatgagccactgtacctggcccagagcatccttaatgtggcaagcacttctaggtaagtgttaagtatagaaacataaagaagaccaaaccctagcatcagtgatcttccagttcaggagaaagcggtaattaaacatacctgtgccagacaagtgcaatgtaaatgtgttcagcacaatcaggggtatgcacaatgggctttagggaaacagagtagaggcatcaaagtcattcttataggcatgtcaggaaagacttggaagcatctcctgaattttgagtctcaaaagattgagaggtatccaagttcaaaggagcacagaagaaaacggcattccagataaaagtgaaagcaagaaacatcccataatgcgcaagcatctgagggctgctaatgcatgccctagacaccttcctagtctttgcaaataattgcttctcagtccgatatcaattattgataactattaactgacaatctacatactaattaaaatgcattcatatgaatatacaaaacatcctcattttaagacttatctctaactccctgccaaaggaatttccatttgtcagggacttagcatggtcacatcatagagtctgttttgcctccccacccttttagatgcaaaggcccacaagcaagatgccacagctgattgaactagcaggcagtttagccttagtagctgaccaacaaccatggtgtggcctagcaggaagggccaggctaacctaatcatattctttttctcccaaatttgagttgaaaaatactgaaaagatgaagcagttcatagtgcaaaataaaactgagggaatacaaaaagcaaagctattaaataacttcataaccatgaagaatcacagcaatctaaatttacaaagctactagtatgaataacaagaaactatacaaaaaagaaaagctacacaaagcagaggagaataacaaccctgctaataaccccaggagaagtagacccagagagaaatcagtatgtgaagaatggctgagtgcagttgcagacaagtctgtttcttagttaaaaaactatattcctcagtttcttgcagctaggaatggcagcatgatcaaattctagtaaatgagatataattagtaagtcttacaagtcttccaggagggaagcacactcttcttctgccctttcaccatccagctatctggaatgcagaagtgatggcaggagctctggcactaattttggaccataagcttaaagtctacatatagtgggcagaagcttcttggggccctaatgacttctggacttacttgcctgagcaaaaaatgaaactgtcaaagccactatattccaaccaattccagtcctaattgatacagtggttgagagaatgtgacagaaccacaatttgaactcaagtcttttggacgtgggggccaaactcaatcattatgagcaagtgcaaatgaagtcaaacaaactgagtaaagcaggtttacagtttacatgtattttataattcaacaaatcataaaagtctgactaccaaaggccaataaaaaagaaaaacacgcagatgcagtgtcactcacctactacaaataacactttggacaagcctctttgactctgtagcctacctggacatataaggtttttccctcaatacaagtacctacaataaggcatatgggcaataaaaactgaatataggcaccagcttctcatgcatggcagaaacctatcaaattcagatttgtaaggagtagatgagacttgcaagagcacacgggattctggaaagcctacagcatattttgcaaggaagtaagaggcctgtctcattaacttcaagcaaaagaattttccatacgtcattaacaactagaagaactcagcccaggcattgtaactccctaaaccactgatgccccagggtggcaagtgtagcatagatcggcaattcctttgaaaggctcaaggattttagatgcccaagctgaagcaccaatgaactttgtattaattctcttcattaattaaacaatttcatatttgcattgaccacacattttgtgcccagccatgtcccatgctggggacggaacagtgagagcaaagtccctgctcttatggagcctacactccagtggtagtggcacacaaaacaacaaataaaatcaacttagatggtgacaagtcctatgaagaaaaaaaaaaaaaagagagaatgtgcaggagagggtggatttccggtactgctatttttaagagcagacgtggtcattctaacaatattatagacaataaaagagatgccaaaaaagctttcaacagctttgcttcccaaaccccttgcataggcaaacacagtatttctaccgtaaaaagtcacagcattagacactcaattcaataatccacaaatatttattgagaagcagttctgggagacattaagagcaaatctaacagctttcagtgttaagactttctggaatcaaatcccagccatacaacttactatttgtaggagcttgggcaagttgcttaacctctgtgcatcttaatttgtcatttgtaaaatgaggatcatagtagtacctatttcattgggtactaagaggattcaatgagttataaaaggaaatacagtaagcttcagatttgtattttgttttatatattttgtaattgacatataatgtatattttaattgaatatctgctatgttccaggcacacaacttcctctaagcatttgcataatggggccccacacaccaggaagccccaggggctgcagtctgccatcagcttctacagatgccttgcattcaggccttgtctgtactcttggtgtctccgcctgctgtcacctgcattaccaggactaactcctgtgacttcttactgcaaatactgtaacccagaatggtaactctgagattccccaaaggagtaaacattccaaatccaagtttctctcttaccactctgtctcaacagagccagcaactgatgcaaaacaataaacaacatccattttttagccaggcctcacaatattgtccagattggcaatgcgacatgtttaaactgaagaagttttagtctacattatataagattatatcaactatcactcaacctttttttttttttttttgaggtagagtctcactctgtcatgaggctggagggcagtggcacgatctcggctcgctgcaacctctgcccacctcctgggttcaagcgattctcctgcctcagcctcctgagtagcttgggattacaggtgagtgccaccacgtccagctaattttcctatttttagtagagacggggtttcaccatgttggccaggatggtctcgatctcctgatctcatgatccgccctccttggcctctcaaagtgctgggattacaggcatgagccaccgtgtccagcatcactcaatattttaatattcaataatatttaatatttttaatgctattataatgataggcatctactttgccatgcattgtccattaggcacttggaagcaaaattaattagaatcataaggaaaattatatttattcaattatccagagtatgaattcatcttccattccctacgtcccattcgtttttaatataattaaatgaacacaacttttcagcactgtccttctactaaaaccttagaaatcattgtttaggggttctttccttgaatttatctttttaagccacttctttgggcatgatacctacactgtcaaatctatatttaaagtcctcaaaatattcaaatggccaaccccttttactgaatcagtacttctatattaacttacaaaaattattgtactgccaggaaaaggctgactacaggagaacgtggtctaacaaccacttaaaggttcaaaaaaatttctatttgcctattaattagacaatctcaacttttcttcttgtttttctaactgtggagggaaaagaaaggtaagctttgaggttagacaaacctgggtttgaaccattcaataagttactttagaaaactcatccaccctgaacttcaataagtggtcctcagatgagaaaagagaacagataatccttggtttccatgggggattggctccaggaccctctgcagatactaaaatctgtggatgctcaagttcctatatgaaatgctgtaatatttgcatgtaacctacacatatccacctgtatactttacatcatctctagattacttatacctaatacaatgacaatgttgtgtaattattagactgtattttttattttgtattattttttatattttttgttcaaatatttacaatttgcagttcattgaatctgcagatctagaacccgcagatacagaaggctaactataataatactaaagctactaactctactgaattaaataagcaagcatcaggtgcttagcaaagggaagatattttctcacacctagtgaatccaaagccaagccgcccacatctactactggaatgtggatgagtctcctgaacaggccccactagttcccatctgatccctgtataatccatcttccattcaacagccagagcaagttttcaacatgtaaatctggtgctatcacctcctgcttaaaactatttaatagtttaagagtaatcttaacagaaacccaactcccagccacaactgccagaccctacggaatcttaactgggctcccctggggcttgggttcacagccaatttctttgagccactcttcagcatctgataccccaacctctgagattcctatgagcagctataccactgtctcatacttgctgaagacaaatagccccaatctatatgctcagggaactacttggggttttctgtaagtcccagggatccctgtgcccaactcaggtggtagtatctacctacttttgtccccagggactcaccctatttcccttttctttttcaagggataccactttttcctaagtcttgtagattttctccttaccccatccctaaagcctggctgccaagtggcaggagccctcccctccctcccttgctgttgatgttcttgcttctccaaagatgtgcacactggcccttctttatgaatgggttttagtgctaaggactaaagggaacagatatgtggaggttgatataaaaatctaacaactaaaggcagtatagtcattgcctatgtttctgacatgtcgtgtggataagcaagccactgaaactcctgccctccacctgttatcagcaagcggatctctccaaagtcctcccttcactctcaaaccagaaggcagaatcacaacccatgaaccaggtgagctatagaccctcgtaagcccactcctttcagatgaacagtttgcatttctgagggcagagttcctattcaagcgtttcattaagatagtgaataatgtctagtaactatacctatagaaattgagtagaaccacgcacaattcaatttaaaaggatggccttatcttacaagtcacaagagaaggaaaaaaaggcatttactaaggttctactatgcgctaggtatttttatactgtcgtctcactcagcgctcacaattagagcaacgtgggtatttccaggcctgtttctcatattaaaaaaacaaaaggatactagcccgaggctagcaagtggcagaaggtagactactgcccaggtctaattctaagccagtccttttccaactctgcaacctcacacggtgttgcaaagagacagttggatattcaagaaatacttttaagtagaaattgaattttaattagagactgaaatgagaaacaacatgttcaaatgtactgtatataaaattttaacacacaccacccacacataactcatgctgccagagtaacttggggtggggggaaagatcaagtttcatgataaaacctatgttctgccttctcactgaagatcagctcaacattgcacagtgagctactttccaatctgtaacatttgcaactatgattctgttggaatcctgtttttcctcaatgctacaccaaaaagagaacaaaatgcagaaccaaataaactatttgataagccttcagttctcaaccatgtctaaaggcagtttttgtgttcatcagaacagcttcattgtcctcactgattaatatataataataataaacgtgtaagtaaatatcataaatataggcttgtaaaaagtcaaatatagtaaaatatcacttgtttaatagttctgcataaaattagttggaaaaaactccactgcctaaatgaaaagaaacatgttagttcctcccctataccacaatgttttcttaaataactcatagtaaagtgaagagagattggctgatacattaggatcaacctagaagcaaggaaaaagttgaaaggaactttgcatctattccaacctctcactcagtgcatgaacccctttctgtgatgtccctaacaggcagggacccagcttctgttctgtcatttcctactcaaggaagatgaacaaatcttaagagaattcttctttacctgaaccaatacctggccttcctatgatcatgacctgctcagattcatagaagactttatgcccttcaaacaactaaagccactcatcatatcatcctttttttttttattgttttgagacgaagtctcactctgtcgccaggctggaatgcagtggcacgatctcagctcactgcaacctccgcctcctgggttcaagcaattctgcctcagcctcccaagcagctgggactacaggcacgtgccacccacacccagctaatttttgtattttagtttcaccatgttggccaggctggtcttgaactcctgacctcatgtgatccgcctgcctcggcctcccaaactgtcttgctcttctttaaaggttctccccaagtccaaaagccaaaactccaatgccaacgaaaagtatcatgcaatactgcctctcttctttgaggaggtaggtaaatcctattctactaacccagcggctggcaaattccaatctgtgggaaaatccagtccactgcctggttttgccaataaagttctgttgaaacacaaccacagccatctgcctatctattatctacagctgctttcaaactactaaggtggagttcagtagttgaaagaaagacatatgtatattacgttcagtgttacaggctaccgtctcagtagttacaagggtcatccctgtattatttaggatgcccaaatgcctgccaaacattaagctcacaataagtatttgctgagtaaggaaggtcagaaaaggaaagagggagattagaaagaagggaaggtagggcttttcttctcccaaaactaacctgaaatccagccttatagaatactttaaaacctgacagatccttgtcttgctgcaagatcttttaacacagggctacacagcagaattaaaattgaggacctaaagcgactatgttttatttcaggcacataaacactgattaaaatatcatttaataaaacaaaagtccttgttaattttgaatgcacaggaaaatactactcatagtgttagaagcatatgtatttgttactgttgctactgcttattgtcttaatatcactcactgcagttatataaagcaattgggataaataatctttccctcagatgaactcttaagcactctggatttggggaaatagaaaagaactgctttaagacagatgaggaaaagactgaatcatcaatgagcttactataactcttgattcttcatctccttcatggtttaataatcactcacttttacgatggtttattcaagacaacctttgtagaaagtattaaaatatgcatcacatcttgcacagcttttcaactttttaagcaacttgtttcattatacttgtgttctcttacaaagaatctgatgtgaagaattttagaattagcaatgcaagatctttctcaacatggaatcgaaatttttactgagtccattttatgaaactatttcacgtgaatattaagtacacataattatttatgataaaacaggaagaactcagaagacatgaaatggaaaatagtcacctatgggtattaacaaagatccccagtatagttaggtattctccccaaataatgacataatgaaactaaaacatcactagcacaggaatctcaggatgcacaaaaattgcagcctacatccacagaaataataaataggggctgcactccaggctcaaaaagtgatgctacccacagcccaaggccaggtcagtagggaccctgaaagagtcaggaaatgcaaaggaaacctaggagcaatcgcgtgatcacatctaaatgacccaacctttaaaacacacatagaaatcccaaaaaattataggaaaaagtatgttacactgaaaaaaacattactggtgaacaatataaaatatacatttctatacaaaatgaaacaaagagagaaatccaataatccaaagaggttttctactttagcccagtgacttgaaaagagaaccagcctcattcaggaaacattcgaaatgaccaagaacggcaacattacccaataaatcgtcccaatgctccttcctctaccataccctgcctctcaggaaacattcatacaggaagaagggataaaagagctggccaataaatcacatgctctgcttctcaaaagcagaaacttgactttcaaattgtttgactccaatgaaataggaactgaaggctccaaacaatcacagaattccagagtagcacctcagaaaactcatctactgagtcggctcgtgtggccgaacttaggtaacagctgtaagcataactggcctgaggagagatgtgggccaccctcttccctgccaggacctttcaccctgtgaatcagaaatagctgccacttaaaacaccagcaagcagttgaagtgtctttaacccagttaccctacactatgcgtattaggcagaggcagggagatttttggaaggctggtagggggaaaatgaatcgaaatggagcaaaatctttttggtgacaacagtaccataagtccttgttttatatacacttttgtagtacttacagaattaggctctcttttaaatgctttatacacacattaactcaattctgcgaggtaggtatttaatactatcattacacccactttgcatacaaggaaacaggcacggaggctgcagagcaggtaagtcacagagctagaatgcaaatgcaggcagtctggctctgcccctgaccattattatgtgcagcatctcagtccaatcaaatatttactcagcacctgtcaggtgtacttgtgccaggttctgggcatattaagaggcctgcaacccagccctgcactgtgccacaatgtgctctgtcctataacacagacaggaacaaaggcccgaggctgggttatggctagcacattaggcacctctgtgccagttcacaatggggatctgggcaagccaagcaggggctggatttcagccccacttgcccccttggccaggcacttctgtgcagtgtctaacaggcctcactgtctgaggcagccctgcagtggccctggaaggaccctcaattctgttttggtagtgaaaggttgggagaagagaagccctctttcctaacgagttctgcagagttaatgcaccaccaccactgtggcagagggttgtatggaaaggctggagagggcaggtactagtgtgagatgggcttattggaaaggaggcacagagcagtgtacagtaaggatgaccttaatatgaaagatgctatttcatctagcatttccctggtttaggtagttgggagaagattaggcccaggtttattgtgctacagagggtcctcattcagattactaaactcacagctcaattactggattcgtaagactctcggcctatttttttctactaagaggggttgcactaccaggggagttctagttcctgatgaatgggcagactggacccccctcaagggactcagttgctgtctggatctatcactaggctggatttctttggaggggtccctgggattgagtcctgccagcttcaggttcctggggcagagaattggtagtttgaagtgctgagtccagaagctaatgaagatggcccaggccaaggcctttccaacaggactgaaatctggttgcaggcagttgttggagcctggagtttgttttgttgtgggcagcctgcttagggctgttttgttagggcagtttgtgaggttagccctcttatgttatgtctggaacaattgtatagtaatctggatgcattgtcagtaaagctaaaatgggctctgtgatcatgacttctatctaattaaaattataaggagcatagtattgtggaaataatttttagttttccctccccttggagagtctacctctgacctctgcagtcttcaattcacacccctattgtctgaccacattgaactttctttccctccagttttctgacttgttactccatacaacatttatggttcagcctcatcaagaccaccaggcccttccatcttctactttctttttttttgagacggagtctcgctctgtcgcccaggctggagtgcagtggcacaatctcagctcactgcaagctccacctcccaggttcacgccatcctcctgcctcagcctccccagcagctgggactacaggtgcacgctgccacgcccggctaatttttgtatttttagtagagacggggtttcaccgtgttagccaggatggtctcgatctcctgacctcgtgatccgcccgcctcggcctcccaaagtgctgggattacaggcgtgagaaagtagaagaaagtagaaatcttctactttctatgtgcccttccttcctttcctataactcagatctcagtctataatttcaaatattttcttaccagtgtactaagttcccgcaccccattgtctacctatggattcaccttagattaggaaaaaccctaacccttaccaatctaacggcccaccttcttaaaactacatctagatggctacaaaggctacacaaggaaagaaaaaagaaatcacacaaccatctaaatgtgtgccaagacggtctgcaacttcagcacgacacaactaccaaccctctgtgtctctggtcatcctcggccctccgtcctcactgcagcttcttctatcctcctcagttaaaaccgctacctgaccacatttcagtcacacttggcaaaatgacctcacgttctactgcaccagcactgcgccatctctagtcccatttaaggaaagccaccccccaaccttcctgcccctccagttccagccctttctcttctctttcctggtgaatgtctcataaaacattcattggagcagcatcatttcctcattccccactcctccactaatcggcaccgcaacaaggcccatgacagccctctggccaaggtcaccactgacacgaattcagtggtcattttccagtcattatcttccatgatctctggtcaacatttaacaaaattggccactttttcctggaaagtctctatcctcacctgcttgacatcacactctccaggtttccttccaacctctcagttctctttctcccagactcctctttctggttgctgttggttttttggtttttttttcctttgcattttttgttttgagatgaggtcttgttctgtcacccaggctggagtgcagtggcacaatcacggctcattgcagactcaacatcccaggctcaggtgatcctcctgcctcagcctcccaggtaattggggccaccggtgcatgccaccatgcttggctatcttatttttttgtagagacaggggtctcactatgttgcccagtctagtctcaaacacctggccccaagtgatcctcccgccttggcctccaaaagtgctgagattacaggcacaagccaccatgactggctgccaagttcctctttggttcctttacttttggtgatcccataaaagctgcatgtatactacacgccagcagtggctgaggccgtaggcatcctcaagtattttcctttcccacacaactgaaccctcatgcatggctatggcttcagctaccatctaagtggttgcaaatgtgagctcaaacattagccagacctaggttcaaattctggctccaccatgtcttaggcacaacatttaatttctctaagcttcagttttctaatctctaaaacgataatagtaaatgtatagcatataaaaaatactgagcactgtgcctcctgcaaaatattaataatatagtatagtatacagtatgtaacaataaatgttagctattagcttttttttttttttttttttttttgagatggagtctcgctctgtcgccaggctggaatgcagtggcgcaatctcggctcactgcaatctccacctcctgggttcaagtgattctcctgcctcagcttcccaagtagctgggactataggtgtgcaccactacgcctggctaattttttgtattttagtagagatggggtttcatcatgttggccagatggtctggatctcctgatctcgggatacatacacctcggcctctcaaagtgctgggattataggcgtgagccaccgcacctggccctaggtattagttttaactacatctccaaacctcacctctgagtttccatttacctatgtgaaatctcaagttgaattactgcacaagcagttcaaactcagtcactctaaagtcaaacttctccctttcccaccaaacctgctatttcttcagggttacagatcatagtgcatgaccccattacccacctcaatacctacagtggttttaaaacatgcccaaaaattcttcaaccttcctcccaccaagagatatctcccttctgcccttgaacctagcaatgccttttttactgccttgatgaaaagaacacagtaaaagtgacactgaatcactgttgaggattgggtagaaaagaccaggcagtttctgccagtttctcttggtacgtttgctctgtaagccttcggcctcaatatgagaagtccagctatcttgaggccatcacatagaaagaccacatgaagagagatgccccagggggccacccttgtccagcacccagctgttgcaatgtacccagctcagatgccaggcatgtgtatgaagccttgaggtgaccccaccctccatctgattacaacttcatgagggatcctgaacaataactgcctagttgaacccagtcaaaccccgattcacgagtaaaatacattgttattgtgttaaactattgttttaaggtggttcattactcagataaccaaaacaatgctcaaaccaaaaacctaagaattatccctgagatctattctgttgtcatcttccacatccaattacaaaattctggcaattcttaaatgttgttaaatccatctacatttatgcatccctcctgccccttcctggttgtgaacaccatcatctcatttctggatcaggacatcttcctaactagtcttgctccagtcttccctccctttccaatccttctctgcactgcagacagatctgaccatgtcattgcaggcaaactttcagagtttccatgaccctagctgggctctgcagcttcatttctagcactgctccaaaccctgctccaaaaacacagaacccctgaagtcccttgaagtcatggggttactcacccccaaatttccgcacagctattccttttgcctggccctggccctgcctgtcactgggccaactttactcagctttaatgttgcagatgttaaaagactcctctgggaagttctctttggccctgaaatctaggttaggttgcctttcatgtgctactctagccgtctttatttccctccagatagactatgctactccaaaatgtaattgtttatttttcatcgtacaggagcataagtaccttgagggcagactaatgtcttattcactcaacatttttttttagggaaaaaagcaaatttagaaagatagagcattatgttacaattttggtaaaattcttaaagcacacacaatgatactatatatggtttacacccacatgcatatatgataaaaagccaaaaacatgcatgagactgttactcactaacctcgggatagtggtcaccactgagaagggtggaggaggaagcgtgcagggaacaggagtctttagtttcatttaaagatcaccagaattttgaagtcaaaatggcaaaatgttcaatcaggaaggcaggtacacagaagtctgttatattattttctgtacttttctgaatgcttaaaataattcataattagaaataaaactctgaaagaattatatttctgtttagctcctgactccatgtctatactgattaggaacgggtatagacctccaatgcctcaatcagtggtcctggagtgcctccagattgtcattcccttccccaagagaaagagagagagaggccagagcagcagctctcctgttgaaaaaagaacccaagggaatccctcttggagagacatggacataattagtgggataagtcctcaactctgaaagcagcagtccagaggttaaaacagttcccagcaaatctaggtacagaggaacttgataaatgagattggcttgcaaatgcaacttttcagatggtgagctactatcaaaatcatgtaggagtgcttggctctatgagccaaagggcagaacacctacctttatgcacactgaaggagagagtgggtaatcaatgaaagcaaaatcagtgagcagactcccgcctcaaacacaaacccacacaactttcccagtgggagctgcactgtcactgagttcccagagggcctctcacaggcaaccaggtgacagaaacaatcaagtgacccctcaatttccagaattgttatctatggttcacacagtctctctcactcatcctctcaacaattattaattataatagttaagcagcaccgaagaatgctcatggccatgggcttagaatcagacaagctcatacactgatcctgaccctgaccctccactggttatgcaattctgggcaacactcaacctttcagagtctcaagtttcctcttttctaagttgctatgtctttgtggttaacagcactgttgggaggattaaattaggtgatccaaggaaaacactcagcactgtaaatggtacacagtcctgtatttaccagacactagactagattccagtgataaaatggtgattaagacggtcagggaaccagcaatgatgcaggttacagactcagatgccagccatgtatttagcgctagaaatctgaactggccttataaattgtgcggcccagtgcaaaatgaaaacgcaaagcacctgttctaaaattaagatttttttttttttttttttttttttttttccaggatggggaccaaagagcagtaaaccaggcatggggctcttctgaacccagcggttgcatggctgggaagccagccctgctaaaagtagatgtgacttggtactttacagacactcggaaaatgagggtcaaccagaactgggcttcttagactcatccaaacacctgggacattgggacatttggggagatgacaggggagagccacaacataacacagggggctgcaggatccaaaacaaaagcccctcaataatttaatttgtgggaagtatcagaggaaattcccacttcttgtcacctacaatagttatgagaccttccctaacaagctttccttctctttagtctaccttagaaataaatccttttataaagttaataccatcaggagattttgcccagctgaagtccataagcaacaggctgcttatggcctagtatctattgggaacagctgacttcccaggcagtgcgtggcaaaagaacatagcacagtctcagtacctcttcaaaagaaatggggctgggcacagtggctcacgcctgtgatcctagcactttgggaagctgaggtaggtggatcatttgaggtcaggagattgagaccagcctgggcaacatggtgaaaccccgtctctaccaaaaaatacaaaaactaaccatacgcctgtagtcccagctactcaggaggcttaggtgggataattgcttgaacccgggaggcagaggttgcagtgagctgagatcaagccactgcactccagcttggatgacagagtgagaccctgtcaagcaagcaaccaagaaaagcaagaaacaaacaaacaaactgggacttggggcaggtaggaatgtgcccctgaaagtgacactaggggactgagtaaggagatcgcaccactgcactccagcctggatgacagagtgagaccctgtcaaaaaaaaaaaaaaaagaagaagaagaggagaggaaaaaaagaagaaagaggaggagaggaaaaaaagaagaaaaaggagaggggaggggaggggaaaggaggggaagggagggaagaaaaacgaaacaaaacaaaactggggcttggggcaggtaggaatgtgcccccaaaagtgacactagggggctgagtaaggaggttgcctgaaaatctatatgtggtcacctggtggaacactagatgctgaagatcacctcagtggctatgaccagggtatggagactgtaaggcaggagttcccagcacacaacatagttctcttcctagccagccttctctgtaacaatcacctgccagagtccttggggacaagggcgcatcagcctgcctgctcatggccactgctttctttaacatagtagtggtcaaggaccacttttctgtacctgtttacttaagaagcaatatactaaaaattttgagtgcatcccaactgccttaacaccaagctgcctgagcctctgcctagcacaagggaactacttgtaggtggaaggcaatgaagagggagggccctggggccacaagcgcagttcaactacttgctagctgtgtgaacttgaggaaattacacaacctccctgagcctcagtttaatgctattacacatgcaaagcacttagaacactggcacagagtaagtgttcaataaatgttaactgattttgccctcctgattataactcatatacttatctcctctcacccccgacctgagcactgcccacatgccaacaagcatgtggctttggcatctttcagaatgcaagcccctggagggcatgaatcaaggtccctatgtgtcctctcctagggctcatactgttagactggagccacagaagtttgggaaccagacttaacacctttgtagaaaagttcctacctaatggtacggatttgctcaaaacatttttgctatatgaactccatatatggtagatctgtttattgtgctcagataatttttatcttataaattattaagaaaggaatatttaatatgactgcctaatccactcgacatttagactaaaaagtgacctacattatcactttaaagttagtcacaataaatacaacttacaatgttcatagatattcagggttaaaaacaacgaaacaatgtacttttttttttatcaataaagaagttcagttcacagataactgaacataatatgaaatcacaaatgtaccttcactcctcttttcaagtaggatcctttacaatttcatagtgcctgtgggctctaccctttgtagcacatcatgggtttctattgttggttagttagctggtttttatcctgcaaatggtgacagatttgtgatgatcaacccaattctctcaccacatcttccccactgagacatacatttttatgatggcagatacagcctataaccaagaaactaaataggtcaagtccaccagtctatacaaagaaatcttattaaactaacctatcaaatctaatcttattaaatcccaaacactggcagggcacggtggctcactcctgtaatcccagcactttgggaggtcgaggcaggtggatcacctgaggtcaggagtttgagaccagcctggccaacatggtgaaaccccgtctctactaaacatacaaaaattagctgggcatggtggtgggcacctgtaatcccagctacttaggaggctgagacaggagaatcaccccattgcactccagcctgcatgacaagagcaaaactctgtcacaaaaaaaaaataaataaataaaaaatccccaacacggtacagtagtttcccctcatccatgggggatatattccaagtcccagtggatacctaaaaccacagatagtactgagctatcatagaactaactaacatagcacagagcacactatattttttcctatacacacacacctatgataaagtttaatgtgtaaattaggcatagtaagtgattaataataactaataataaaagtgaacaatgataacaatatacagtaataaaagttatatgaatgtggtctctctctctcttaaaatatcttattgtactttactcacttattttgagacctcggtggaccatggttaactgaaaccttgaaaagtaaaaccgtggatgggagggtggaggctactataaacaaatgcaatgaatattaattgacaattagcatccaagactaatcaaccatttttacttgtcacattttcaagtctaagtttatattttagttcacaataaaacacacaaaatgagagaaatgtactagaaagcaaagaagcacatcagaagctaccccctcccctatgtgccttacttaacctgtcctgccacaggttcctctagagccacacgactgccagtcctgcagtcaaggaggatattacagctgagggttcatcccgcatgactttcagggccatgcagaaagtaagggctccataaatatttgttgaatagataaattattcaaatgggttttattttcgtagcttttaaaagattcttaaaagagtcttgtgacttcctgcttgttgattacaactcccagtatttccataaattgagactagtttaaaaggtatttcaataccactaagcagtaacagtcattctacaggaggtataaaagtaacatcagcaacataatcacaatacgttaactttttttttttttttttgtcttgagacggagtctcactctgtcgcccaggctggagtgcagttgtgcgatctcactgcaacctctgcctcctgggttcaagcgattctcctgcctcagcctcccaagtagctgagattacaggcatgcgccacgacacccagctaatttttctattttaagtggagatggggtttctccatgtcagccaggctggtctcaaactcctgacctcaagtgatccgcctgtcttgccctcccaaagtcctgggattacgggcgtgagccacctcgcccagccacacaatacgttaacattttatatttgaaaagcaacgtactgtttacaaatggctttccctccactatctcatttaatcatcataggtattacacagagtacaaccaattctaccactgttgttttgatggcgcagagggaaaaaaggttaattccagatcaatcatcacatgagtcaagacagaaaattttgaactgaaaggaatctagaagttgatcttgtccaacctcccaggaaaactcgagaaatgtgtttttctctttcattttaacctgactattttctcctaccttatccaaaaagctctgcacattgtgttactagttctacctatgagaagaaagagtaagatgctggtactgcctgttgggacagcagctaaatgtttacccagagacttggcagatgtaaacatggcctttaaaccccatcatggaaaggggaaaagttgtgtgcccttctaggaagattcactcatcaactggaaaacagagatttttatgtttaaattgccaccctggctaaaaggattatatcttgatcatcttcaagttaagagtaaaggatacattctgcattcccctgaacaaaacacctaatccaaacagattttatcttgtctcagtttaaaaactggtgaaaaaaagcagaattttcctttccatttcatattcatctgattcaacaaataaaatatcgggccctaactattaatacatgccagaaaccaagtcaggcaccgcaccaggtgatacatctaattgattaggattagcaaatttctattctttctctcgactgaaatcaataaaaccctgtcttaaatattaaagtactatccctgtccctcaccttgactgtcacttctgagaacatttgttttaagaaatcaacagcgacccgaagatcagtagagcttcttcatctgttttaatatctcaatcttattaaaaggattaatcctgttaagacaaaatagcacctccacctttctctcccttcttcctttccactctcctccaaataaaaaggttaagtgacgacatccagcccaaagaacaatgaacaatagatacatacacacacacagctctctcttccagtttccaacaggaacaacacaagaaagtcaaatactgattaaaaagaaatgacacacaccatcattcttgtcagtgcatggaaagggaacttactctaatccattcagcaaaatctggagtcaaacttggaatgaaaggagcattttttttccctgcaaggtaagtaaaagaactcaggaattttttaaaaataaaataagataccagatgcaaataaattgatttctattcctcagaaatagggcttttaataaacgccacacagagtatgcataagcaagcaagtcaatccgaaagacaggaagagaaaaataatgtgtggcacatcattttctctgaaagtcgacaagcaaaaggtgaacacaaaaaggctacctcgggagggctagttttttgttttgagatggtttttctgtttgtttccatccagtttaatgctaaagaattttctgaaatcttttcacaggggacacttggcacactcacaaaaactaaactgtttcctttaagatttcttttctcacctccaaagagtagccactggcttttatggggttggtcactgcacttgtgaattttagatggataaagtggcaaaataatgattttttttaaatataaaagtaaaactaagatgtatggcaagtaaagctttttaaaaagccaagtcaaatttgaggcctgctgattttgacacaaagctgttagtaaattggcaaagaaattaatctgcttttagggtaaacttgagcccaggtaaaacaaaaaggccaagtcaaatttgtgacctgttgattttgacacaaagctgttagtaaattggcaaataaattaatctgcttttaaggtaaccttgggcccacaaacattcatccactcacctttagactatgcctatctagaggttagcctgagtaattaaccagagttatcaattttgttttcactaagcattttgataggtttggcacctcaaagacagctttgtgatgcaatttataaatttaaaacacatccggtaaataaagaaaataataaaatgtcagaaccacctgattttcttttttaagaactatttaagtattcaaaattagcttttagtagtacaggcaatgtcaccctttcctacttggtaattatcccaacaaactttcgctttaatttaggcagactgcaagacaaaaaccatgtattgtattttataagataaattacaaattaaatcagttatttaacttagaaaataatcttctggcagctctcttaacttacagggcaccttgtattgtgaagaatgttcataatcagataatccccgtaaccagctacagtactgggtgaataatatccctttatcacaaagataaaggaagttactgccatcaacaaatgaacaacaaaacagaacttgaattcagaattttagatccagctccattcacaaggctatgcattaactgcagtcaccatcctttcccacaagaccatcaagctctgaagcattaggagaaacattttctttatgtacactaaaataagcccaaatacacagataacagcacaaagccggtccggcgtttcttggccatcaaagcatgcacagactttctcagtacagccttaagtgtaattcctagaaggcactggcaaatctctgccaggccaatctgcagtcgaaaaccgagtgcatgtgtccaacaagatgacaggagggtcaatgtttctaaccgtctacttcaactctgcatggcaatagcggttctgcccaacatggtaaacacaataatcgtataggatcgaacacaagtctctgtaaatgaggatccccttaaacgcaaacaagcaactctggggaaatataatttctggaacaaaacatggtgctcgcataattccacaaagacacatagaagtccatttttaaaatgatgttcggtcccagcactgtgctgacacttttcccacctaaacttctcagcacaagcctggcctaaacagccgggttccaatccgtgcacagtggaaccgcggcacgcacccaagaccggaatggtggggctatacctgtccctactcagtcctgttcgtgccagcctgcgaggtagtttagacccgtctgctttatggtaatgtgcttttaaaaccccgccacgaccgaggtcatagctttagagatttaataacaatcaaatgaccagggctgctgggcacttagtgagccattctggttatggctctttaatagcacctggagttctgctccagggagagaggaaaactcctgctcccccggaaagaaagtcctctgcggagagcgcagagggaagccaggaagccgatcgcgggcaggggacgcgccgccgcggccgccccatctctcaagcagccccagcgcgaccctcgccctgcagccgtgctggcccaggccgcacctttacctgtcagctccaccacccacccgccctggaggctgcccctccgagtccagggaaaggcttaccagccggctgcgggagaaagaaccccagaggcatcctatcccaaagaaagaaagcaaaaaggctgctcctcaaggcagggggccatcgggcacgccgagatccgagaggcgacatgccacccctgccctgcacctaccagataatccatgtacagaaacgcctcagttattcggagatcagacatccggcagcctaaagcatccggaacggctccgaacccggaaaaaaaaagcagcgtctctggctgcgagcgagcagctcctgaaaaagccagcaacagcgaaaatagccgaaagcagccgactagccggagattacacaaggggcgcggcgattggccaggcgggcgggcagaaggaaagaagcgtgctcattggctgcggcgcctataaaaggcaggccccagctggtggcaggagagaaacgcgggagtggtgggggatgtgggttcctgtgtgctgagcggaggagccggggtgggggcggtgcaagcggaagaaagagccaagagagcggaaaatcggctggtgctgtcgccgcccgagttttgtgtttccacagctttccagttgggtacaacggagccgaactccgtgttcccgggctggagagccttggtgtccccgccaacccccagtaggaagcgagcgctgtaacatgggaggcgtggtcgccactgatcttgtctccccccagagccttcctaaaggctctgccgccacgagactgcaccaccgggaaagaagtgtgtgaaagtgtactccgtaaacaggcaatcctgtacgcgacttaggggcagaaagaccctccgcacttttatcatttgaaagtaaggtggacgattccagcctggtgtccctgagggtacacacaggccccccgcgcagccagaggtgactcaggaaccccccttccaacccctgcgtagaacgccgaacagtcttcggagaattcgctttcctccacgtgaaaaggaaaagaaaaacatttgaggagtcgcagtagtcacttgtactccccaaacacacgggaagaagttgatcagtttgcatgcttggagtcaaattacgctcagcacaaatccaacgcccctgaattaaatgagcagtagaagctctctgcaaaaaacacaacagtatttgtgacccggtattatttcaggaggtaaaaacatctataagcagatgcatttgggacgtatgcatttcctggtaatgtcaatatcgcattaagctagtgggtttgggcagggaaagcctgaatcggacaagaagctggctttttttttttttaggctataaataaccagaccatgccagacacatgttcttaggctatgttcttaggctcaggtgattggagtgcccccccccccatccccaccctcagggcttagggagaatggaagataaggtggatgctgtcacctgtattaatagttagggcttgcatacatacagtaaagtttcaagagtgaaacttcatcgactgaactctttatgaagtgactgcctgactctacacgcgatgttttaggagttgaatttttactttccccctgacacctttcttttttgtatcctcaagaaacaaatttccgtaccgtaagtttacctgggactaccaaaacagttctgttagatgaccgtggaattcaccccaaatgtgcacataaccaataagggcgaggcagccccctagagggagctgtaggttgatgagccaagtgattttaggtatgcagtctaatttccaaacctgtttcctcagctgcaaaacgagaattcctacagccagaaagttgtgagggtttgggcggggggcggggttggggaagttgtttttgtttttttgagacagggattctctctgtcgcccaggctggagtgcagtggcgcgatctcggctcgctgcaacctccgcctcgccggctcaagcatcctcccacctcagcctgcagagtcgctgggaccacaggtgtgcacgactacgctcgtctaattttttgtattttaagggtaaagacaaggtctcactatgttgcccaggcctgtttctaactcctggactcaagcaatccgcccacctcggcctcccaaagtgctattagatccaattttgattttccttggcattctgttaattcaaacacatgtaggtttagaagagattttcacctagattttggaggagatggacgtccataaacgtacactctttagcacaatttgtttgaaactaatttggaaaacaaaatctctcaatgagcagaaatagtcatggaacattttttgtttgttttgcttttcttcgtgaataagcatatttaaaataagataaagggcttgagttagcaaagagacaccttatggaccattgtcttagtgataaatgatgtgtgggctactgcccagtcaggctttcgagaggcctatcagtctctatgcagaggaggatagccactcagaagcaggtggcttctgcctttcctttaaaagttaagcttagggaaagatagtcctgaacatgtcattagggtcagtatggttcttgctgcctctaagaattagtatatggggccaaagcagggagatgaaagaatatgttcaaggaaaagttccaaagactgcaccataatattcactttattccacacaatttgcacattcattgtgactggcatcaatgaaaaccttgtagtcagtgtaatgtattaaaaaatcacatattgcattttaggaaagagtccttataaaacaacaacaacaacctgtagattttgaactccatatggagcacattttttcaattagatgttttctgagatgtcagtgagtccgcccctacagaggaaagaggctaacttgactgaattggtatgaacagataatacactacccactacatgaagctgcagtcatagctgatagggttggtagcacctattgaggtaatcacctcaatacatgctttttaaaagagtgtagagaagttagaatgcatttaatcaacctaccatactgtatgccaagtaacagactgcaatccagaacaagacatgatctcattaacctagttctgcccttgctgtcagtgaaaagaatgaccctcttccagatgcggaagaaacatgtaaactcatgaggcaattgcattagtgcataggttttgaggaaagaggctgatacggtttggctgtgaccccacccagatctcatcttgaattcccacgtgttgtgggagggacccggtgggaggaagttgagtcaagggggcgagtctttcccatgctgtcctcatgatagtggtaagtctcatgagatctgatggttttattaggaggaatttccctgcacaagctctcattctctcttgcctgccgccatgtaagacatgtctttgctcctgcttcaccttctgccatgatcatgaggcatccccagccatgtggaactgtaagtccattaaacctctttcttttctaaattgcccaggttcaggtatgtctttatcaacagcgtgaaaacagactaatacagaggccatcactgttgcttgtcaaaagcaaagagaaattattttgacagtccatactctaaaattccataaaggctgctggctagccaaatttggaggaaaattttttgttaaactgtcacttgcaaggaatgaaaacagaaatgcatttttgcaacttggtctcccaactttccagaaaaatcaacatattagtggttatttccagctattcttttgttgtttccaaggagaatactgccttcactagttttgtatcatgcatacactatctcactgaaacttttcataaatctttaatggatacataaaactattgtaaaaatgtactactgtgttaacaaatcctttattagttactactattataaatattacagtgaatgtttgcttataaaactatccacatcttattatcctaagaataatttctagtaatagaattactggtacaaagagtatgagcacttcttttctttttttttttttttttttgagatggagtctcgctctgttgccaggctggagtgcagtggcacaatcttggctcactgcaacttccgcctcccgggttcaagtgattctcctccctcagcctcctgagtagctgggactacaggcacacgtgaccacacccagctaattttgtatctttttttagtagagacggggtttcaccatgttggccaggatggtcttgatctcctgacctcgtgatccgcctgcctcagcctcccaaagtgctgggattacaggcgtgagctatcacgcccagctgagcacttttaatactcagttttgacctagcttatgtagtcttcttccttctaccccccagctccaaagtagggaatgattatcttgtctcatctttgccttaatattattccttaatagctgaaagatggtatctttcattataatgactcttaaatcatggacacttctttttcagaaaaagtggtcagctctgcagaggtcatcaggcactttttctcacttaccacatccaataactcctgtgactttaaaattctcttctgagtcctttttccctttctctccagtggataccttgacacccacctctgatttaccccagtcctcttctctgcttcctaaacctaaatgaagtatcactgtgtcccagaagatgaacttcatcagaacagggtgtccccacatgaagccgctaacagagcttgattcataaatggaatcaagccaatgattattgaatgaggtcagaggttggaattagagtagggttttctgctcttagcatggtgacctacttgcaactcaaactagaggaacccctcactgaaatagctaagtctgaagtttttaatctaaaatatctccatgtcagtttaaacctgttttctctcctgcaggtagatcttaaggccttgtatgtctatttttcaaagatcagtcctggcagtcaagatgaagatttgtaactacttaactagatgagcttggacaggtcacctgttccttccaggctcctgtttactcagccaggggatagagttcaactaatccctaccatgattaagggtcactcaccttttccaaaaagggctttgctgggtcttggggttttaaagcaagataagacatccactgaaaatggtaaatatacgagggaaagataactagatctcacaagcaaccaccattcaagcaccaaatatcaagaagctgtgtaaatccctctcaataccaaccccagcaagttcatttaatctcttagatacatttctacattgctgattgtattaatttcctattctgcaagccagttatgagccttatggaactaaaataaaggtgttggaagagctaaaagagttaatagatagatggaggccattagtgaatcacactcattgcaattgggcagcaagtcctttcttgaattgtgaatctccttttctgccacacacgtgtgtctgaatctccctcaacagcctggcttgacaccttgcatgtagccctggcaccactaaagattgattggttgcttagagcatagacctcactatttacagccagcctcattgtgtcaatatgtcactgcctgagcatacttgttagtacttcctgacacagtcagctccaagtgaaggagaaaaatcaacaaatccattaggcctcatgatcaccatgctgaaatctcacagcaaaaatcacagataaaatacccttcccaagatcacacattaagtaacagagctaaggactttccttccataaccctggaatatctatttcttccctatactactatggaagtgacaagatcttgggatcagtgtgacaagaaaataaagcaggcctagagtctaccacggagaaacttccgcttattagaaataacaggacaaagaaaggcgaatagacaaagcccttcccgatacaaatgtgcacacagtcaacctggtgccagaggagttactaaagtgtttaagggatgagaactcagtgagggtttgccaaagtttctggagttctaatagaactctccaagaaagaaaaaatttatcttggaggatttgtgaggggaactttccagatgggaaaacagcatataaagaatcaatagcaacaaattggggatgaggcattacatacttaaaagaagatgagtgtttgagcccaaggtataggaggtatagacagtttagtttggggaagtctaactggtgcaaatcagggttcagctaggagcttctctgcagattattgcttcccaactccccatgtggtgttggtggaagttgatttgcagctccatccagtgtaattgctccctcattctggtccctaagactggcataaagatgtgccaactacagagggaagcaaatcccaaaaaagtgtttgggcacttgctttcttgcctgcttcttatgagatcatcacctattgggataatatagaaactattcaaattgctttcttgtaggtattccactgaaagttggaaacatcttgaatgcccgtgatttataattttgatctcttctttcaaggcttacatataaggaagccttaatccaagctggcaattgattcaaggcagcttgcaaggaaacgagaaactcagaaacaagaaactataaaataaagccaatgaaaaaagtggctatcatataccatctagataataatgcttcctatctcatccagacttgagattctgactctatgctgtttaaattgagaaagacaggcatgtaggtactctgggcaggctaatatggattcatgcattctacatacctatttaacacctactatatattagggatgctagagaaatattatccctgctcacataaagcttagtctctagtgattggagacaggaaagatatcaactagtgataagtgctatacagaattaaagagatgtgctggcgagtaacagggaagcatactctagacaggtagtcgtggatggcatctctgggttgtgctaagtgatacagtccaataaaactttctgtaatgatggaaatggcctatacttgtactgcccagtatggtagccattagctacacatggctattgagaactagaaatgcaggtagtggatactgtattgaacaatgaaggtatgcagtaaaaatatgaatggaggtcttccacttaaacatgacatattaaatatacttgcttatctcccccaccctcacccccacaggccagtaaaggaataaaaaagatccaccaagacagagaattaaaggagagactccagcatataagaggtcaaccatttaggaaaacagaaagtggatacagaagtggcaactgacgtagcggaacagagaaagctgaaggctaagttcaagaggcgggggaagccagcaagaaacaagctgattcctgttgcagaactctcatcagctcagcaataagcaccacctggttctctgaggtgggaaattaaataaacagctatttaaaagccatcatgtggaagcaccgtgccagacaagtttaccaagttctaccaaacattccctaaacaaaatgtcccaacttgaaactattccagggtagagaaggagggagtgcttgccaggtcatctcaaacaactataataatcttgatacctgatcaaggacatcaataattatatatcagtctcactcacaaacacagatggaaaaatattgcaaaacatccaagaaaagtagaaaaaaaaaaaaaaccacattgtgactaagccaggcttatcctaggaatgccagatgttcttaacattggaaaatcagttaactctccacattatcagattaaggaagaaaaatcaggatcacctcaacatatacaaaaaagaaaccattagaaattaaatatctattggtatttgttttttagagctgccgtaacaaaataccatccactgggtggtttaaacaacagaaatttattttctcacagttctggaggctagaagtccgagatcaaggtttcatcaggtttggtttctcctgaagcctctctccttggcttgcagatgggcgcctcctcgctctgtcttttctctgtagttgtgtacccctggtgtctctctgtatgtccaaattgcctcttcttaggaccctaggattattggattagggcctactctaacagcctcattttaactacctctttaaaggatctgtctccaaatttggtcacattctaaggtactggatgttaaggcttcaacatataaatttgggggagacattattcagtccataacaccattcatggttggcaatctaagagtaaaagggaatttattccgattgatgaagggtatctacaaaaaacttaaagcaaacatattcatttgtgaaactttaagtgtgctttaaggtcagaaacaagacaacggtgtcacctatcacagcttctattctacattatactagagaacccggacagcataaccagagaaaaaatataaagaatggagagaaagaaacaattcatcggcagattgtggttgtgtatgtaaaacacaaatctgcctatcaattattaaagttaaaattaaatctgttactccttaaaaatcaatataaaatgaattgtatttctagttacttagcaacaaagttaggaaatgtgtttttgaatatgtttttttaaatgacctttaaagtagaaactttaaaagcacctaagaataattgttataactttaagattttgagagaagttaaaaacctagaaaaatacagagatatgatgttcatggatggaaagactgtagagatgtgaattctccccaacttaacttatagatttaaaacaaacaataacgtttgaaatcacagagcacactgtatagaaacatttcttaactgttcttaatttgaggggagtgccctcctttttgtgagtgaagtgccagtcttctgcatatttctgttggcatttaccatactgttttgtgtatagtggttaagagcacagatgccagtctgcctgggcttgaatcttggctttccctctttctagttctgtgaccttaggcatgctacttaacatctcagtaacttatttaccccattttataggtaggaaacaaatagctacatcatcaaccttctggattattgagattaatagttaatgtcgtacattagaacagtgctgggcacatagtaagcattatgtaagtgttggctgctgctgctgctgctgttttcattctctctcccactagtcggagttccttgaaggaaggaaactgtctcattggattgtgcacctttggagcctacttcagtgtctgttaaataacacaaaatacattgtcagtgggggctggggatgagccactgtcctgaagtgtcatatttaaagaagcctgattcagtggcataaagtatttgaaaagggagtccattttctacttattttgaatactaaatgtccaaagcatgatccataacacttgtaaaagtacccatataattatttatccttcacttcttcgctgtttagaagccttttttcaccaaatgcctgagattctcccaacttattatcatggtactcaaggtacaagggttgaatggacctgattcctcagttcacggtaccctgtattatcatcattggtccacaacagcgttcctctctctatttaattatttcttttaatccctcttaactaattcctgttccttcctctaacaggaaatcatcccaatatgcctgatgtgcttttcctactttgctacctgtcaacgttgtccatgatgtccctggttgaacaaaaatccttggatttgatgtaatctcttccaccaactttaaacctaagggctggtgctgctgaagttaaaaaagtcctttcctaccacaaaatcaagaagccacagcttcagtaaactttatagcattccctttcatgtttgggtcttttacccattgttagtctatcttttgtatgtggggttaaattgagattatgtccatctgtttaaccaggtttccaaaaacatctgctaaacaattcattcttttctccagtgaggtggagccaacccttaacctacataaaatgccttctatacatgactctgcctctgagctctcctctgttttattgatctgtttattctgtgacaatacggaacacatcagtctgtttttttcttttctctctaacctgaccacaattccttttatgtatattggcttcattgtcaatactgcaagaaataatttttggaagcaaaaggcaaagcattgagtttctaagttcagggttctctttggcaggagactggaggagtctgtgcgcacccacaccagtaactgtgttccttcctgaatgcattaatcgtggcatactactgttctccttttctgctcattccttcaaatgtgcctttccattcagtactagtctgcaaagcctataatgaaacaaaggaggaaatccttgtgatttaattttgctttcaaaataaattattttaaagtttaatactccagaagcagtttaattaattaattaattaatttcatttttttattttttgacacagggtctcacttcacccaggctggaatgcagtggtgtgatcacagctcactatagtctcgatctcctgggcctcccacatcagccttgtaagtagctgggaccacataatgtttaaattttttgttaatacaggatctcactatgttgcctaggctagtctcaaactcctggcctcaagcgatcttcctgcctctgcttcccaaagtgctgggattataggcatgagccaccgtgcctggcccagagacagtttacttttaaatcaattgcttaaacctgacgttactcttcttagaaagaaaagagggcatttaagaaaaaaaaaattgcataagaattaactattatcttaataattaattaactaatgggttcatgaaagacactaacacattcatgagagccaagcttttccaatgctttccctgtctccttgccatgaccttgaagtctttgcctgcatcttgtgtttaatgccatgccatgtagactgattcattgtaatgctttgtccttgagaagcttttcttcaaataggaatctctaacataattgtggttttttatgtacctgagtagtgttgaattctctgggcaaatgagagctagagaagacagtactgtatgcttgctgccaaagtacatcagtgaatggacgtgttctggacgtgcttattccaccaaggcctctctttattccctttgtgtgtgtgtatgttctggtacacgttatggctgactgatggtgtgcctgtggtactattagacctgctggaagacatcaaggaagaacagcatgctagatattataccatatcttcctacttctcaggctgcctccaaggtaatagttcagagaacagaagcaatttggaattggtagaaatcattttggcattacaaagggcatcataatgttacagactaagaggtttggctagttttcttaataggaaatgaaagaagcaatggaccaaggcatgtgacttcatgagatttcaaatggtctaaagagtaatggctaacttaccacaccataatcacatgcggtggcacagctatttcatataattctgatccagttagctcaagggttaagatcaagctttgtcagaagacagagctaaatttcaatcccaggtgctttattagctgtgtgaccttaagaaggatacttaacctctgaaactcagttatctcatctttaaaatggaaattaaaaacaatataggtaatttcttcaaggttgttgtaaggattaaaaacaaatatggcctggtgaggtggctcatgcctgtaatcccaacactctgggaggccgaggtgggtggatcacttgaggtcaggagttcaagaccagcctggccaacatggtgaaactccatctgtactaaaaatgcaaaattagctgggcatggtggctcacttgtaatcccagttacttggaaagctgaggcaggagaatcgcttgaacctgggaggcagaggttgcagtgaaccaagattgcaccactgcactccagcctgggtgacagagcgagactccatcttaaaaaaaataaataaataaaatactttttaaaaaataataaaacaaaaacaaatatactgaacactgaagtgctggctatcctatgtactgaaagccttgttggaggaattgtgtttttatagacagtgcctttgacttagtctggagaagtagaagaatcctgcttccaccattgacttttaaggatctcaggaaaattattccactttggagttacagtatcatctttaaaatgttgatgaaataaagcaaagtaagcaaaagggaaaattaaagggcagcagagagatgatggctttgttgattcttctctgcagcataactcagaatcagaagaaatggtaagatgggcaatccaggaatagtaagctggctttgtgtgccactaagctctatattttgtattacctatatggaagccataagatgcatccgtaggagaccctctgctgcaactaaagtgagtgatcaatcattaaatttctcaaacgtttcaacaggctgcttggttcatttgcccacttccattgatataaaccatgcctgccctccaggatggttgtatggtagcattgtaatgtacaagctttagttgtatgttacgtagtggacacaacactatgtctccatgtgacagatggcagtgcacataaatggagaatctctgcacttctctttggtagcagaaatatctatagagatcgtacaactaggtagagctctcagttcctataagtaaaataacagataaattattatataaaatagctgtgttggaagaaatactttgaatctcaaactcctaatcacttatattcataaatgttctccattcaacatattactttgataatgtctagactactaaactaaaagttccagaccacatacaaagtacaaagtatccagatgaaagtgatgctttgactgaattaccaaggaaaaatatcagcttttgtcttatgccagtaatcctcactggtcctcaacttttaggatatatttagaaggagaaaaataaaaataaaaaatgttgcctggtccatactagtacagaatgttatttactaatattaagtgggaattcagtttacaccctttaaaaagtattatatctcagatgccaaactcttcagtaagaaggccggaagctcagataactcagccatgtcatagcaagattaacaattttgttttgtcagagaataaacaatcagtttttaccacaaagggacacttcaatgagttatttatggtaagaaaaggaaattatagcaatattaagaccatgtgcagctcctattcaaaattaagaaactcactattgcattgtttatctcagcctcaacattcttatgagaagtaattaacagtcgttagaggtgtggttattatgcctggttagggaagcagtggggctctatttgctcaaacctctcaggaaaaggctacaattactgtgtggatacaggaatatcacagttatgagtggtattgttcatagggcatttcacaagacaaagcaataataaaatacttagttcttaggatatcaaaggttattttgtgaaaatgatttgacataccacaatcctaaaacttgacaaactactctcaaaatgttttaagaattatgtgaacccagaaacaaatgtgaaaactgttttcacacaggaaagcctccactgaggattatgaatcttatgaaagacaaatgccctattttgagtacatggtgatatagttggtcaccttcaggtatgcttatttatgttttgcaggattgcagtaatggttaaatagtagaccaaattagcatgtctgggtctcctcaagtcttatgtttccttcagtggtcccatatgagttactaaaatttccagttttatgtagaatgcagcataggttgaccataaacacaactttgtatcattgtccaaagttgtaaaacagagattgtcactgcagggtcatgcaacagaaagggaggaaatgctgttttgtaccatatcaaaaatgataagctacattttccgaaggactaaaatatccctcttattgagaacagaaagaagggcaagaatgacttgtttaaaacctgcaagttgataaggagcgatgtcccagcctttacaacatcatggatgtaaaccttgagaaaggaacaggaagcttgtttacaaatgaacaaattcctgcttttgtaagagaaaattcaagctgtggcacattttttaaattaatagatgtttttaataaattggtacctaggagggattcatcatgttcactgtgcttgacaagtacaaaattaagcgagttaaatcagctccaaagaaaaaaaggctgtgtaggcaacccatcaaatgactgaaagctggggtagtcccttcagtgggcgaactgcttatgctacctgaatagactttgctcagaaaagacttctattgaaagaaccacaggtgtgaagttaatatgcgtttgtaacagttttcaatcaaatgcctcatcaaatagggtagtttaacacttgacgcataaatttgcatcagaatcatagcatcaactaactgggagaaaatggcagttaactgtgaagctgtcctgtgtaataggtgctctgcaatgcaataggctcacaaaaatcctgcccccgttcctagtgggatgcaggattacatggcaattaacaatgtgaattctggagatgaattccacgcaagttccaactcacatcccaccttttatttgggaaagttatttaaattttcgatgcctgaatttccttacctggaaagtgctgataatagaaaccaactccacacaaattgtttggattaaactatttaatacatgcaaagctataaaccacttagaatggcacctggcatatagtaagccctcaaaatattttttttcttacccatgattgtcaaggattacctggatcctagcagaagggaaattaagggctagattgtgcaagaaaagtactactggggcctataattcaaaccctggaaaagaggtaggacatagaaggacatgagataaagaacgtggtttatttaggggaggggatggtaaattctaagggactgaaaaaggcagaattaagcatgatcttttattaaacagcctgactggagtggcaaaatcaggttgtgagatgtgtccggttgatggagggcttgaatgttatggttgaggagatcaggctctgacaggaagccactatagtctctccaggtaatgttctaaaaatagtactaattcctagaaaacaagatagaatgtaggggaagagcctagaagcagatatttcagttaaaaggcattgaggcttatctaagaatgcacagggtgaggttctggaccagggtgataagcatgactggaggaggaaagcaactgccaaagaaaaaataggaagccttgaaataattagatacggggatcaaaagagagaggaggcaaagatgtctctaggatcttgaggttgcctctactggctaacattttacttaaatgagataaggcagtagttgttagacagtagaaaatgaagggactttaggagctggcctcaccctttgtatttgaaggtttccaaaccatcatttgtgaaagcgagagtgagaaagaaggggtcaagactcctgagtattacaagggcatttcctgggtagcagagctccacctagtacagctgtttgtgattagaaccacctgaaggattaacagctcaaaaggactgacactaaagcagaacaagagctgcaaataagccttctggggtcagaatataaaacgttgaagtcgtttaacagctctttcattagtgtggattttgttgcctattttaccttaatgattggattgagtatcatgttatataatatttcacaagcagtaattcaatgttcaagtactttgaagtatttagaagtactgcctattctcctcaatactggaaagatcctcatagattaggaaaagcccgaactaagcaacctaaattctcttcccactaacctgcttaactgttctaggttccaatttatttaaagaagtgagagttggatgttttaccaatgtgggattttcagcaccttgtcttccttggctgaggggagcctctgaagggatacttgttattggtcctgcaaatgaactgctccagctaggtacaggctaaaaaaatgatttactctcctatgttctccctctgattcccatggcacagtaggaattgctctaggtcccttgttcctgatgagccctaaatgccttttgtcccacatgttgctgacattctcagtttgttctcttccacactccgtttctccattctctgacccaccctactaaccgcattccccaggctcccttgccaatgggaaacatcagctggagacgagaaggtgggagttgaagaggggctggagtattcacgcctggcacacctgtcctgctatggcatagtgtggcaatagccgcatccctctacatccacagcccttgctggcggcccctttcatggctctagctctcagtagactgtggtaacattggttctgtccttcgtgtcttcatgcatggaggtgataagggctccctctggggctagttcttggtgcttcaccatcccttgttgattcccagacccctgttcacaccaatgtaaatagtccctttattaaattctcttccaaaaccccagctaatggtcttctctttcctaccaaaacccattctttgaggagtgtacagtgatgaaggcaagctggtataatcagatgtcccacatgaacatataacatcatggagctttattttacatgggtacattttttttcctaagggtttaggtatgtaactttatgcctgaaacttttattaagaaggaatatttttaaatggtatgagacatcataaaacaacttagtttttgaagggaagctataagtcaaattcatttttattttaagaatttgcaaattatagacttgaataagcgtatcaaacattcctaaacaggctaaacactgttacaactatatagaaaaagggatttattatagggctaagaccttacacagttttaccaatggaagggactatgcaaggctgctgtctctgcattaggtgttgagccagaagttgttctaagtcagccagaccaagtgggaagaaaagtaaagatgaacttaaaactcctgagaatgagctggaactgtgaggatgaactggaatccacatcagtctcagactgtctctacctttgatgctgcaggtcacttgcagaagaagttggcaccttttgccatagaatagcccatgcttttggcctaggattaggtgaagctgaaggaattctggtaccagaagtgtgggcccaagtgctgccttatgtagacaacgtgagcagcttgtcaccacagtgtgtacaggatgcctggcatcctacattgactttctttttctttttcttttttgagacagagtctcactctgttgcccaggctggagtgcaatggcacaatcttggctcactgcaacctccacctcccgggttcaagcgattctcctgcctcagcctcccgagtaaatgggattacaggcacccgccatcatgcccggctaatttttgtatttttgtagagatggggtttcaccatgttggccaggctggtctggaacacctgacctcggatgatccactcacctcggcctcccaaagtgctggattacaggcatgagccaccgcgtctggcctcctacattgactttcacagtataaaacaatagggctgcaaccccccttctaatttataaaccttctacatatttctcctatggtcactgctaactcagaagcataaagatatgggaattctggaaaacatttttctaggacagcaaatttgttcattcttcttttagctgagtcgtactccccattgatatcctgtaacttatactgagatataaaagtaatgactattatatcagaagtaggggaatgggagaagggaagaaacatttactacatatatagatacactcataccaaaattaggtagaaaaatactcataactattattgtccttgtttctgcagccattatgtggtttggttttttgactatatctattttatattctcttttccctcgacaatgtttaatcttgtcctagatctttgcttattggggtgacccaatcccttcacattcctgaaggatctgagccacttgctgccctacctaaattgggttttggaatttcctatgaatattaatctcaggatatatctattactttccttgcggtgctatacaaattaccacaaactgggtggcttaacacaacagaaacttattctctcaccgtttaggaggatatatgtttgaaataaaaatgtcaatagggttggttctttcttgggggctcagagggaaaaaaaatctgttctccctctctcctggtgtctagcggatgccgataatcctcggcattccttggcttgtggtagcataaatccactctgcctctgctgtcacatggacatcttccatcttccttctgtgtctcttcgtctcctcttttcttttttcttattttcttattttgagacagagtctcactctgtcacccaggctggagtgcagtggaacaatctcagctcactgcaacctccatctcctgagttcaagcgattctcatgcctcagcctctcaagtagctgggaccataggtgtacgccaccatatctggctgatttttgtatttataatatagatggggtttcatcatgttggccaggctggtctcaaactcctggcctcaagtgatccacctgcctcagcctcccaatgtgctgggattacaagcttgagccaccgcgcctggcctcttctcttcttataaagatatcagtcatattggattaggtcccaccctaattgcatatgacctcatcttgattatatcagcaaagaccctatttccatataaggttatattcacaggtaccaggggttaggacttcaacatatctctttggaaaaaaatagttcaatccataacaatatggaatacaaaaatatgctacaggaaatctgcatttctgacatactcttccttctctccattctgtagttgtgaatgacctaattccactggatagacaggatcaatcatcctagtcagtagaataaccccctcttttgcctgatgattaacttgcatgaggaatacaaagtcaccaagctgtagtcgcaacttctaatttaatggaacattttctgtgttcttggtagaaacatccctcccttgggaattaagaaccctagattagcacagtataaagttatgaagtcaggaagcaaatttttgccagtgaatcaccaaagataagatgagccattcctatttccaacccttgattccccaagttctggctaagggagaaatagcacaatctggcttagactatatactgcatcctggaggatattcctccagccctacaaggtgctgccatgcagctattgtcataaccgagtcttcagtggccattcaatcattctttcaggccacttgcttcagggtgatgggaaacatgataagaccaatgaattccaagaccatgagcacattagcatatgttatgtgctataaaacaaatttcttggtcagaagcaatgctgtgctgaataccatgaaggtgagtaaggcatttcgtaagtctacagatggcagttttgataaaagcactgtaggcagggaaggcaaatccctatccagggtgagtatctattccactgggaacaaagagctgccacttctataatggaagtggtccagcataatcaatctgccaccaggtggctagctggttttctccatcttcacacctggcctgggaatggtgccatatcaggggttcactgttggactttgctgttgggagattgagcattcaacagcagctatagctggatcagccttggtagaagaaaatccatattgtgagcccatacagaaacttcattcctatcatggttcagcactcactaggcaaggcaaagaatggctgttggaaaaggctgactgacacccacagaacaggtcagcttgtccacctgattattacaatactctttttctgagcttgcttttcagggagcattgacatgagacagaaatatcttcacactctgtgtgaacgccatttagtcacatactagattcccagacctctttggtcagaaattttctgatcatgtttcttttcagtccctgactatgcacctaaaccattagctattgctcatgatgaatgtggacctctagccatccctttttctggatgaaatgggcaaacagacgtactgctcaaagttctgcccactgggaggaagattttctttaaatactatccttcagagccaccctgggatagggctgtagtgctgcagtcatctacttttgggtgttggtggcaaatcatgccgaattttctaattttttttcgtctttggtcaactagccacagacaatcctcatgaagctttagatgcaggttaagaggaacgaggctatgctgcagccatagacatctgggctacttgttcatgcaacttccttgtgtcttcagcaccaccggtgactaaggagtcttgtcttgagctagggaatggggacatctggggaatgtcaggagtttttaaggctgagtttctaaggttaccaattctagctacttgcctcctagaaggggcaaggaatgtgttagccactgccctaccctactcctaaagccctgctattatgtagaactgccccccccccaccccccgcccaccaccaacaccaacacaccaacaacataactctgccactttgcgctcctccccatccatgcttcagtcattgggagtagacgtctactggagcaactagcggaagaacttctcagccaccctttgtcagagtaaaggtattgtcggtgaggcgttccagtggtctcattgtgtaactgtatagattctgacatgctctgctccctttctccctcctaagggaagttggggccatatcatggtgaaatctcttagtgttagtttgtccttcagatgtagtaacaccgtcatttgccctttccagcatatgtcatttggaatcatgatttcttctatctgctgcaaattctgtctcagttttacatgcatcaggcctgtaggagacccttgggtctggccagtggctggagctgttggctgaatggacagtgaatgaccactgaatggaaagtcagtgctgtttttctttggcatcttagaagcttatactgagtttggtaggactcactgccaaagtattgcctggtctggagaaggtagagacaagggagagttgggatttctactatttcctactagcatcatttgtctgccataagatgccaaaatgcagggccccagatttgcaaggtatggaattagagcacaaggctattgaggcaggtctgcatgtgagatggccccaccattgggtcactatcaggacctgctctaaagagtctatggattgtaggagagtcactatcatacagttcatggaccctgaaaccttcctgcccaatctccattctccttagatctgctaagttagtctccatctgtattgcacagttttctgtgaaaaacctttaaaagggactggtacttccagccgacaacataaacatgatggttatatttgggtgtgatccttaatttaaaaaaattttaagcttgttagcatcctccaaattgtctgcaattaaaacatactacttttgtaagttctccaggaagatagagtttaagtaacaatcagcttcttggcatcaaacactggtggcccatttttcatgaggagactaggaaatggtactccatattcattgcttccacccactctaagttctgatttctcccctaagcccttgattggtgtatagcaaacctagtttgttttatcataggatggttgtttccatattaaattctagtttctgttatcctgtatgttttagaaccaaggtgactttaaaagcagagcaagctaagcctaagtaatacaatcctaggaaaaatagggatggcttacttcctaattccattcactttgattaaacatcttgaccatatctctacctccagcattattagcagaaaaaaaaaagacttgagacgtaatgagagggactaactaaaaatcttatagactgaagttgtcacaacagttttttttaaagagaactagcttaaaggtatatttcttctatttttaaagcttatggaaaaattcttgttgcatatgtgttatggcaaaacaaaatgcaggcatggaaaaacaactgactttaaaaatagcaaaatacttgacagcccagcttgaagtcattaaaagtagtacagccggggtcagtttataggtttctgtttttaatatgcataaatagtctagcacttggatggaacagacatgcagctgcctcatcagactgattaacttttcaatggcctcccagatacccaaaagttgctggcactgtcagggcagtgctaggagtcatgataagcctgaaaagtgagatgtcttctaccttcctatatgaaggaaaacccagaacttccgataatgtcttttttctacttagagctgaaagtcttttgagttctgctaatgaaaaagaaacgcccactcccacctcaagaacatcattagtatgataacacttccactgcccagactgacggggccagagggccacactgctaacccctgaaattaaaaaaaaaaaaacaaggtaggccccctatcttaaatcacatagaatggtagcagtgtttcatgtcctttctaggtgatggagtcacggtctcataatacagcaccaaccattaattccataaacatacagcatgtcatgaagtccagggtctgatgttgtggacaagtgcaagatttctagagaaaatatacattgtcttgcttatgaaataagattatgcatttaaaatttcaaaaatattcgatctcaaagaataaaagagttaagagaaagcctatgattaaaagccaagtgactgatagggaatttcaggagaaaaaaaaacagaataaatcagagtagtcagggatggcataatagaattgggacttaacacaaaacacttatttaacactttctatgaaatatgccttctgagaactcactggtgaaatcaaacccagatcctggcctcttgatacttgtatgctttttgggtgtacagttgctcaatggacatataaagtacagagtgatgagtgtcacagtaacagacacaggacttacctaacccaccacagccgtacccacaagcaccactgggagccagaggacagacctgctttacctgtaacctccaccaatggtgcccacacacattgtccagtggcctcaggactgacctatcctacttgcacccatgcaccctttgcaccactggcacgcatgcactccgtctggaggcctggggattgatccaccctggccacagcagccagcacccatgcacaactttagggggggcctgatgacaggcatgccctgctcgctgccactacttccagtgcctgcacacattgtcttggggcttggggattgatccatactgcctgctcccactgttgcccacactcaccatccaggggcctaaggacatttcttctgcacccaccaccaccattgccagtgtccaaacatgttatcgagaggcctggggatcaacctgtccccacttaccagcaccaatgtgcagtgtccaggggcctgggtataggcctgccctgcccactgctaccaacacagacatgaacaatctaggggcataagaaagaaccaccacctgccactgatgcccacacatgtctcccagcatccctggactcggctactcagcctgccactgctgctgccagcacctaccttcctaaaccacttgggggcctggagattggcccatgtagtccactgttaccactgctggtgcccatgtgcacagttcatgggcccaaaggttggcctgccactgctattgacaccactgataccacatatgccacccagggggctgaagacctacctgtctggatagcccatctgacatccccattctcagcaaagcctcaccacagcctccactaacaaccaccggataagccattgaggaactctcagataccacactgatgctgattacagctgaagaaatcatgtggagaatacactactgcatctattcagaatcaaatccaaagcaccctacccaagtaacactgtagatacatctacaggaaaaagtcattccctacaaaagccaatccataaaatcaaaagaagtgactgttataccaaagttgcagatattaatgtaaagacacaagagacattaaaaagcaaggaaacatggcaccttcaaaggaacacaattattctccagtaacagataacagcaaaaagaaaatctatgacatacctggaaaagaattcaaatcataatattaaagaaattaaatgagataaaagaaaacacagataaacgacacaacaaaatcagaaaagtaattcatgatttgaatgagaaattcaacaaaaagatagatattaaagagaataaaaaagaatttctgaaactgaagaattcaatgaataacataaaaaatacagttgagaactccaacaatagactagctcaggcagaagaaatttctgaacttgaaggcaggtcttttgaaatagcatagtcagccaaagaaaaaaaaaaaaaggaaaagaaagaaaaagaatgaagaaagcttttggcataccataaagcatttaaatatttgaattttggtggttctagaaggagaagagatgggcaaaggcatagaaaatctatttgatgaaacaattcctgaaaacatcccaagtcttgcaagagatatagacattcagatactggaagctcaaaaatctccaaatgggttaaatcccaaaaggtcttccccaaggcaaattatagtcaaatagtcaaaagtcaaagacaaaaagagaactttaaaaaattaataaaaaaacatcaagtcaaagatatgggtatctgcatcagagtgactgtggattgctcagtagaagccttataggctagaggagaatgagataatataatcagagtgctaaaagaaaaattactgtcaagcaaaaatactattcccaacaaagccatctttcaaaactaaggtgaaatattatttcccaggcaagcaaagactgagggaattcattgccactagaccagacttacaagaaatgcttaagggagtcctacatctggaggtgaacgaatgacatctaccatcatagaaacacaccaaagtataaaaatcactggtagtgcagatacacaaatgagaaagagaaaagagtcaaatactctcataacaaaaaactaccaaatcataaaggaaaacaataaaataagaagaagagaatggaggatatacaaaacaatcagaaaacaattaacaaaatgacaggagtaagtcctcacctatccatagcaaccttgaatgtaaacagtttaagtttcctagttaaaagagacagactggctgatttttttttttaaaccaactatatgctgcctacaggaaattcacttcatctgtaaagatacacatagactgaaagtgaaggaatggaaaaaagtataccacacaaacaaaatgcatgcaggagtagctatatttatatcagacaaactagactttaagttaaaaaacaaaaagtgacaaaatgatcattatataatgacaaagagatcaattcagcaagaggatatacaattgtaaatctatatgctaataaatattattatagctaaagaaagacagaccccaatagaataaaagctggggacttcaacacccccctttcagcagtggacagatcatctagacaggaaatctacaaagacacatcagacttactctgcactacagacctaacagacatttacataacatttcatccaacagctgcggaatacacattcttctcatcagcacgtggaacattctccagtatagaccatatgttaggacaaaaaacaagtcctaacaaatttttaaaaatcaaaatcatatcaaatatctttttagactataatggattagaactagaaaataataacaagaagaactttggaaactgtacaaatacatggaaattgagtaacatgcttctgaacatctattgggttaataagaaaattaagaagaaacttaaaaaaatttttaaagaaatgaaaatggaaatacagcatacaaaaacctacagaatacagcaaaaacagccttggagagaagtttatagcaataaatgcctatatcaataaagtagaaagatttaaaataaacaacctaatgctataccccgagaactagaaaagcaacaacaagccaaattctaaattactagaaggaaataagaaagatcagagcagaactaaatgaaacagagactaaaaaatcattacagagaatctataaaatgaaaagttgttttttaaaaaaatgaacaaaatcaataaaccactagctaaactaaccaagaagaaagaagataaaaaaagtaatcagaaatgataaagaagacattataattgataccacagaaatacaaatgatcattagagactgttatgaacaactattctctacaaagtgtaaaaccaggacatagataaatttctggacatatgcaacctaccaagattgaaccagaagaagtagaaaacataaataaatcaataatgagtaacaagattaaattagcaataaaaaatctcccaacaaagaaaagcccagaatgagatgaattcactgaagaattctatcaaacttataaaaaagaactaacatgaattctcctcaaactacttcaaaaaattgaagaggaaaaattattttaactcattgtatgaggctagcattatcctaataccaaaactatacaaagacacaacaataaaaagaaaattgcaggccaatattcctgatgaacatagatgcaaaaatccttaacaaattttagcaaactgaatccagcaacgtatcaaaaagatattatacaatgattaagagggatttattacagggatgcaaggatggttcaacatacgcaaatctataaatgtgatacattacatcaacagaatgaaggacaaaaaccgtatgatcacatcaacacatgcagaaaaatcacttgataaaattcaacatcctttcattataaaaactgtcaacaaattaggcatagatggaatataaatcagtataataagggccgtatatgacaaacctacagctaagcatcatactcaatgggaaaaagctgaaaatctttcctctaagaactagtataagacaaggatgactatttttaccactcatattcaacatgatactggaagtcctagccacagcaatcaggtaagataaagaaataaaaggcatccacattgcaaaagaggaaggaatgaaaactataaaacattgataaaagaaatggaggaggacacaaacaaatggaaagacatcccatactcatagattggagtattaatactgttaaaatgatcatattacctaaaggaatttacaaattcaacgcaatccctaccaaaatactaacaacctttttcacagaaatagaaaaaataatcctaaaattagtatggagccaaaaaggatcataaatagccaaagcaatactgagcaaaaagaacaaagctggaggcatcacagtacctgaattcaaaatatgctacctagctaaagtaaccaaaacatcacagtattgatatgaaaatagatacacacatcaataaagcagagtagagaaccaagaaataagtccatgtatttgcactccactgatttcaacaaagacaccaagaacataaaatggataaaggacagcttctttaataaatggcactgggaaaactggataattatatacagaagaatgaaactagagctcgatctttcactatacacaaaaaatcaaatgaacgtgggttaaagacttaaatctaagacctgaaactatgaaactttaagaagaaaatatttgagaaattctccagaacagtgttctggttaaagattttttgtgttaagaccccaaaaacacaagcaaccaaagcaaaaatagacacatggggctatattaaactaaaggtcttcttcacagcaaagtaaacaacagagtgaaataaagctaaagcagactaaaatttggtttccattttgaaggctgggcaaagtaaaaaaagtatttcgtaggctgggacagactatcaggctcagtgggcagtgcatgtaacatagaacaaagaagcctggggaccatggttctaaaatgcctgcaaattaaaacatggcgatggccataacatcagtgctgtgagagaagtgtttaccagtatctcactgccacacagagtagtcattgtcaaaagaatattgtctaatatgaaggcaaaagatatacccgcgttgcattttttaacaattttaaatattattattattattattattattattattgagacatagtcttgctctgttacccaggctggagtgcagtggcatgatctcagctcaaggcagccaccacccactgggctccagtgattctcctgtcatagtctcccaagtagctgggattataggcgcacaccaccacgtctgactaatttttgtaattttagtagagaaggggttttgccatgttggccaggctggtctcgaactcctggcctcaagtgatccacctgcctcagcctcccaaagtgctgggattacaggcgtgagccaccgcacctggcccctgcattgcattttttaatactcctgggagatacggtcaacccagcttcttagaaaaacatacaataaaaacacatattttgatagtaaaaggactgagaaagttaaaaaaaaaaaaagaatgaatcattgatttttgagtcattgactttttgttactataatcatttttaagtgtataagtcagtggcattaagtatattcagtgttgtacaaccattaccactatccatttccagaagaatcattgatttttaaagagtaaaattaggacacaggagctcaagtctgatatctctttttggatggattgatgcagcagagaacttttgatagactatgcatggggagagagcctaatgctggggctttgtttttcctaagactcaattgctccagctggtgcagaataactcctcacctgctgcacatgctgatttttgtattgaatgggaaggctaggacaccagatactcaccacatccagccattctccagtgctgctggtggacacagtatcacttgatttaataggctgttgtcaatggaggacagcctgcaacaggtcaatgccaaaggaactactgtgcattgcagaggttctagcattttcagagctacaactgtcttggttttggtttaatcctccaaaactacccttttgctgcatgaccccacccccaaatttgtaaaattttgtagctagaagggaccctagaaattatctattcaaactctatgtccagttacagaatcaagaagcctgttcaaggcgatgcagcagaggaagctgggtctgccacagtccaggtcttccaaggtcctatccttcccacagctgctgcacacattctaaaattaaagtgagtaaagtcttaaaacatttttcttttgctttattttgagtaaccagatgcttctgggagtaacaaaagcaggggtagaagtctctaatctggtggggtttctttttttttctttcccctttaatttaccacatgttgaccctgacattttaataaggacacaggacacagtgacttaacaatacaaaacagtctaacccagatgttgatggcagactcatttctgaaagcacaagcctgagagcttttttcaaaagtggggaaaatgttgggatcctagaatagcagtcatagcccccagctaaaatgtccttgtcaaacttgcaaccaaggccattgctgacacacagaaattatttatatttaatcatttttgcccattctcattgtcatcccttcttttctcttccttttatggctcaccttgctacatttccattatttcccaccctctaggttgcctgcatcgtcttgcttgtccttgggttttcatatctccccattagaataatctggcttggtctgtgtttctgaaaaaagcatctcatcccatatggctatttccttacatttctttctactatcaaaatatctttatacctttctccctccaaagtgtcctttattgacttactaagacaataattttataatataatcaaaatgtttgttagcagagctatattataactttaggagtccatagacacccttgggggccccttcctcggcacaaaaatattaaaaattacattttacaattgcattgggatgaaaataaatataagccaaatctgactcattaatatactttcattattatttttccctccaattttaagataaattaaaatgaaaattatttgcatgggcttgtatgcccctggcactgtgccccatgggcaggctttaggccatccaggtgccgactcttaggaaactttcattctacaaatacagacataaagatagatcatgtaatagcctttgctttttaccttcgtggtagctgtagccctctgtgtctacctaattgttagaggtcatttccataatgaatggtagctgaaaatgccagatgcaattgaccctctgtatccatggattctgtatctgtgggttccacatttaaggattctaccaactctaataaaaaatattcagaaaaaagtcatctgggccaggtgcagtggctcacgcctgcagtcccagcactttgggaggccaaggcaggtggatcatgaggtcaggagttcaagaccagcctggccaacatggtgaaaccccgtctctactaaagacacaaaaaattagccaggcgtggtggtgtgtgcctgtaatcccagctactcaggaggctgaggcaggagaattgcttgaatctgggaggtggaggttgcagtaatccgagatcgccccattgcactccagcctgagcaacagggtgagactgtctcgaaaaaaaaaaaaaagtcatctgtattgaagatgcacagacttttttcttgtcatcacttcctaaacaataaaggataacaactattcacatagcatttacattgtattaggtattataagtaatccagagatgacttaaagtgtacaggaagatttgcataggttatatgcaaatactgtatcatttactatctgggacttgagcatctgtgggtttgaggatccacagaaagtcctggaaccaatcccccacagatacagagggacaactgtacaagctttctcagcccctcttgtatctaaggtttggatacacaatcaaattctggctgttgaaatttcagtgaaagtatgatgatggcttcttggaaagttttcttcttgcttaaatgtacaagttcccacgctttctattcactttgggacacgcataagcttctgcagctgtcttgacatcatgagagaccacacagataacaatttgaagatggtagagcaaaaagacctaattctaggttcttctttttctttttaaattattattattattattattattattattattatttgacacagggtcctattctgtcacccaggctggagtgcagtagtgtgatcacagctcactgcagccttgacctcccaggcttaagtgatcctcctacctcagcctccagagtagctgggactacaggtgcacaccaccatgcctggataattgtttttctatttttgtagagacagggtatcactttgttctccaggctgatctcaaactcccaaagtgctgggattataggcatgagccactgctcctgacctaattccaagttcttgatgacattgttgaactacttaaccggctgtgaaactacctacttctgaacactttcattaagtgaaataataaattcaaatttatgcaactttgagctgggtattctattacttgaaatttgttacagataacaagaaaacaaaggtatacaccagaaaatttcagataaaatctcacaaaaataacaagtcaataactcttctaaattttagcaataaacatttaaaaataatatttccaataatacaaatcataacgaaatccaagaataaatttaaggtatatgaagcatatgcaaactgcaactttactgagaaccataaaaatacttgaataaatggagagataacatgtgcttttaagacattattctaggccaggcttgttggctcatgcctgtaatctcagtgctttaggaggccaggatgggagaattgcttgaggccaggagtttgagaccaacctgggcaacatagtgagaccctgtctctgcaaataaacaaaaaaattagccaggtgtggtggtgctacctgtaatcccagatacttcaaaggctaaggtgagagaattgcttgagcccaggagttaaggctacagtgagccatgattgtaccactgtactccagcctggatgacagagctagaccctgtctctaaaaataaaatgaagaaattattctgtattgtaagatgacaattctcactaaattgttttataagccactgtttaaaaatgaaacagtgaaattccaaataaattgtctacggtactttttgtaaaatatttattgaagtataatatacatacaaaaagtacatatatcttaagtgtgcagctcttaagtttatctgaaataaaaatggagagaaatataccataaaatttcaatagaaaggaattttacaatgttttaactagcactgtactatagaaatcagcaaaaaagaataataaccctaaaatcaagctccagagtgcataaataagtatatgtgataaatgcagcattccaaattggtgagttaatggatttttaaatcaagctccagagtgcatatataagtatacgtgataaatgcagcatttcaaattggtgagttaacgaatttttgaaatggtgttagaatgactgatataagtatcccactgaacatatgaattttaaaaataaatgtaaataaatgaaaccagaaaagaactagaataacatatagtttaaaactcaggatgaataggtatgacatgaaaaatagaaatcacaatggaaaagatcaataaatttatctacatacatttaatacttctttatgacaaatatcataaaggtaaaaggcaaatgataaactaggagaaagtgtttgctatcttgatgatgtttgagctggtgtctttgataggaatagggtatattctattgcttgcatgtgtagattctagagtcagatggtttaaatatgaattcccacttccagctgtcttaggttgggtttcctaggagcattggctgagagaaagattcttatacaagtgatttattgagaaattcctctctagtaaaacctagagaagtgagggaagcaggacaggacaggacaggagaataagctagcaaaggtaaaggttcagctacctacaaaaaaaaaaaaaaaaccaccaccaccaccatcacaacaataacaaaacacttcaagtcctatagaagttaaaggtgaggaaaaagtaaaaccgaactttagacaagttaaatttaagggccaggcgcagtggcttatgcctgtaatgccagcactctgtgaggcaaagcagtaggattgtttgagcccaggagttataagccagcctgggcaatgtggcaaaacctcatctatacaaaaacacaaaaattagtcagtcgtggtagcgcatgcctacagtaccagctactctggaggctgaggtgggaggattgcttgaacccaggagtttgaggctgcagtgagccataatcccaccactgcactccagcctgagcaacagagagagaccctgtctcaaaaaaataaataaacaaataaaaaaatttagccaggtttatttgagcaaaaaagtacttcatgaattgggtagcactcagaatcagaactgcaagagagcttcacccagcaactgtggacaggtagtatttatagacagagaaagatagtgatgatatacagaaacagcttgattgattacagccagctgtgtgtttgccttatttgagcatggtgtgataaggccttatatgtacatggtttgatcagttgccagcctataattggctgaagctcagctctggtgactggctgagacacagctatttgttacaagaatatactcttaagttaggttacagtttgtaagttagattgcagtttgccatttagggactctcaagatataaaggcaactttaagccaaatttaatttattttcacaagctgaagtctagccttagcccatcgtaatgaaagattagaggcaaacatggtaccactttaagggtgtcaaagcaaatgaaatatggcctgagaaggactccatacttctatatttgagtccttgtggatgaactgtaacctagcttaatagtcagacaagatcgaaaaccgaacttagaagtatgcgcctgtaacaataactgagtcttggcttatcccagcagccatacttcaaccactcatagaccgctaattgttctgtgttcaaacaaggcaaacaccaacctgtaatcaatccagctgtttctgtacctcactgctgatttctgtacatcatttccctttttttcctgtaaatcttcttccactacgtggttgtgttggagtctctgtgaatctgctgtgattctgggggctgctggtttcatgaatcgttcattgctcaattaaactcctttaaatttaattcagctgaagtttttcttttatcatggtggcatcagaagtgggatctaaagtagggcttctagcgacccccaggagcactgagtgaacatgcaaggtacctgcaggacccacttatgtccactgatctctcagagagactggggatcatgggtaaggttcctctcatattttggagctccatggatttgttttttgagctctcggagtttctttgagcaaatttctgatccaaactgggtttggaagtcatgacagaaacaggactgggtccaggaacagatctgatcttttgtgttgtggcttggcccccagggctatggtatggtgagctgggtcactagggctgctcagggtaagggaatccagaagcctggcataccagcaaaagggtaaaaatttcttaccattcagatttctggcttccctctctctgtgcaaaccagttgaatgaatggtaaaaactactgtttattctcctctgtaaagttttgattaatgcaaaaaagaattctgaagctagccttaagctgtagcgaatcttgtgtattttgtgctatgaattcatttttctgtgttgaggggtacctcaggataaaacatgggcttaggaccccataagctcactgttcaagatggtccagcaagctggtcagtaacaaactttgcagtaggtccctgaaacaaacaaaaaactggatggggccttcatcttgttttatgtccttgggagcttgaccttgtaaccacatggcagtactttctcttggtctctgttttccagggaataggaattttagggttcatgtcatagttagctctaaaaattatcttgagtagttaaaagcctttgcaagctcaaaattgactactccagacttcttctgggaggggatatggagactgccctgtgctatagcccagtagctaaggttttgccctttcgcagtgcctgtctgggtttgattcctggcttaagaaatgagtcatttctgatttgatatttgcatgaacttgttgattctattctcttctatggactgtcttaaatttttctttctcgaagcacctgggaggttacgtttgctaaagttcaaaagccagaaatattgtccatttagcttggctaaagtcaagtattaagaaattttaaaaggactttattaaagagtgctatggttaaaagccagcgtaattaaaagtggtattcaagctctaatggcctggacttcttgggaaaaacaggagacactagagaccctttcctggccctgttcttccaaggactccaccataaagccaataaccaattaagaaacttaaaaattggcaaatgaaaaatcttacaactactgtactaatcttctgtctgtgtagttatatatgtgtcgtgtgtgtaatgtttatataaagagctctaattaattggcttaaacaaaaataagtgcttaaatcaaatattttgaaagaaaaataaaaactgtaatgccttttagtttacataactgtactaatctttaggaaataagaacagctttaaaaattattggcaaaatttaaacatttggtctaaattatgcaggtcagatattaagtttactaaatgctttcaggtcataatcagcttctttgacttttgaaagttgttcaatttacttaccttggatatgttagattctagatgaggcctgaggacatgtggaattagccatgcaccctagctatgcaaagaaggttgtaaagaagagagattttatataagaaagtatattgtatggtaaattcttgtccgaaagtaaaatgactggttgtttaaaaagagggatatttaggatgagtcagaaagtccaagcatgtcatagattgtctgcataagttgtgaaataatttatgaaacgcatttatccaagaaacgtacaacttaaaggtgattagggctcctaaatgcttcataaaatgccactatgactcttaactgtacagcatgcctgcttaacagctatgtaaagcctgtgacacgtggagttagatgctggaaagagtcagaccttacctgaatttttgtctgggtcctaggttccacactggtacgtaattagaatcacttactaaccaggcttttcagcagaggtaaaaatcactaagggttaacagtataacatgtatatgagactactgaacaaaacagtttacatgcaaggtgtgtaaggaaagtagaatatacttttggtaaaagattattagaagtcatgggaatttgaactttttgcctagattaaacagttaaaggattgttttaaattaaataaagctaaaggtttaaacaagttgtggaaggtttataaaaattaaccttgccggtggctcacgcctgtaatcccagcactttgggaggccgaggcaggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggtggagcttgcagtgagccgagatcccaccactgcactccagcctgggcgacagagtgagactccgtctcaaaaaaaaaaaaaaaaaaaaattaaccttgcaaaaaattctatgagtgaaaatactgactaaatttaaaggggtattatttggtttttccataaattgaacatcaaaataaaagcacaacaggtttttcttagagcactaatctgccctttaacaaaaattgtaaaggattataaaaggtttataaagttcttattttatgatcaaactaattaagattgaatacatttgtctgtaaggttttattaagaattgggtttgacatcaataatgcactaatgcaacagtgacatttggcttatttggtataaaaatcatgggaagcattaaaataatgttgaatcttcaggttatattttagtgatgatattaatatattttccaaaattatatatatatatatatatagggatttctaaaaccctaatatgtctgagtatatgatatcaatcataattaaggttataatgttaagttattgtagaccagagagataacgaaatttccttgtcaattgtgtttttaactatcactatttaaactcatttctacaattaattgcttaatgctcttgcagtttctaaaaactccataagcacacaaaaatcccagaatatgatgtcttttaagaggtcatgaaaggatagaaagaaccctgaaaagcactcttgaataaagttttctaacaactttaaaattatatcatgggtaagaattccccatgaattccccaagaattggtctggataagaactcctgaaaccttaataaaaagactgactgatttataaaacttccaacttaagtataagaaaaattaattaaataccaagaaaatactttgcccaattatcatgtgaaatcagccaatactagatatacaatttgaatgaactccacagtgtaagtcaaattacctatgataacccattagttatcagtgctatgctcctaaattggttaaacaactggtattcattcaatgttaagtatggactcatgaagaatcaggatggctgccttgtccttcctgagtccttaaagcttttgttattaaaggttctgcattccatgacttgtcatggaaaagataaaatgatccaaattgaatatattgatgtggtgatttataaatcgcagaaatagttgaaagccaatgtttggttccatattcctgggaagacaataaaaatttcaggtacatttggctacctgataggccatttaaacatttataaaggaattttattcaattgtcattttcagtgcatgttttctggttatataaaagctttcccatgtaagagggctaatgttataacagtagattattatgccacagtatattttcactaggtaaagaaagctctttatggttcactgaggacaaccccttcacagtctagaacccaaagattggacatcagatgcccaaagatttggacacccaaagagaacatcagaaaaagaccatccttgccattcacactacagcaaaactttgggaccttacactttgggttcataatctcacaactgagaagggtccctccacactcttggaactgtacacctattgtaacccttaaggtaaagctaaccaggacagtttctccccagaataagatggcatccttaatgtgaacagttttcccagaatcacagatcaaaacttctctactatcatgaaactcttatctttgaatttttttttcatttcttatgcctctgtgaacaacagaagtgaaagggtggtctattatgtacacttataggctgtacctttatttgtgaaggattttgcggccagccttatacgtgaataacctttaatagataaaagatgaaggccaaatataggtgagaaaggttaatgatacatatgttgcctcataatcagtcaaaactcctattaacctacatcatggattaaagagaatattgccaggaggccttcactcttctagaaggacatcatttgttaggtcctttttccatgatttagaataaaaggcaataatttaaaatgtctccctcataataggctctacagcaatttctactttaaaggctatcattacacaacagactttaaactcttgtgaaagttgtgctaaataatagaattagctaaacagaaaagtatctgtgcagctgctgacacttgtggcctatggagaaatacatcaaatgtagattataaaacttcaattgtaggggattaatgaaaagaccacttagtcaagcgagtagactcttcatctagctcattctttaatctatttaattttaggtggtttggtttatggggaccctgggtaaggagcatactgcaaactcttgatattatcctcctcatagtcataataatagtctccccagtgcgctgtattctctcaaatgttttaaatgtttgcatgcagcaatctctagaaagtcaaatgctctctcttcaactggaatgacaaaagctgaaagaaatgtgtgaccatgaggacaatgtaacctgtgaatgacatgccaagcccggaaacccaaaatggtgataactgagagtggtgctaaggccctaagttttggtcacactgttgtctgagtaagaacctggccaaaacggggaatttaaaaaaaaaaaaattgtggaaagccattatttttgactgagctcatttattaggccccaaccgacaaaattaaatggagtcactcatgctacatgtgacataatccaagactttaaggaaacacgtaaatcctagaacagaccagactttgttattctcctgtatacaggccgttccaacataaggaggcaccctctactcaggccttgttccctccttgcaaaacccattgttctactgttcaccaaagggtttcaagaccatataagtacatttgcaaaatgatagtaacatcaatgactaaagttttggtcaatctcttaaaatagagaaaatgaccaaaaagggggaattgctaatgcaaactaaatatggcctaagaaggactctatacttctatatttgagtccctatggatgaactgtaacctagcttaatagtcagacaagattgaaaacctaacttaggagtacacacctgtaacaataactgagtgttggccaatcccagtggccatacttcaaccactcatagatggctaagtgttcaaactatgttcaaataaggcaaatgtcaacctgtaaccaatcaagctgtttctgtacctcactgctgatttctgtacatcatttcctttttttttttttttttttgtctgcaaatcttcttccaccacatggctgcactggagtctctgtgaatctgctgtgattctgggggctgcccaatttgggaatcattcattgttcaattaaattcctttaaatttaattcagctgaagtttttactttaccaggtgtaggatgtcccttttcacaagtcagtcattgattattggccatcttggcatttgactccctttggggataattttccagagaaggatggaaaattgagttgttagccacaaacaatcttagcccctggaggatgggagtgctagatggattaggtgatttagggatagtactagtagcatcttctacagtaactaagtcatcttgattaatttaattaattctttaaagcttttgttttctcatttatgagaaaaattgtatggatgctatagaggtgtaagggaaatcacaaaaaatggtttctgtcagaaacatagcctaacaaaagcactcaaatgtttgcatttagagagtattatgagcataaatattcactattagcaaagtgggaaaatgacgaagactggtactatacaagggaaaacatacaattgtccaaaatatagaactgtttattctttcactgcaaacttaaaatgcattaccatttatttcctgttaaagatacaaaatccaagataatgctcagtgttggcaaggtgtccatgtggaaatagagggcaatctcctacattcctatgaaagatataaattaatcagttgttttctggagggcatattggaaatctatctgaagcttttaaaacatgcaaacccttctaacctggacattctcacctccaagaatttacctgtggaaaatttgaccagatacttaaagctacaaagaagcttatagtattatatgagtgttgaaaaattggcattgaacaaaagagctaacaaaatagaaaggaataatgatgacaaggaagttactataaacaataattgctattgggaataatgctgtaatgaacatacacatgcatgtctttataatagaatgatttatattcctctgggtatatacccaataatgagattgctgggtcaaatggtatttctgtgtttaggtctttgaggaatcaccacactgtcttccacaatagctgaactaacttacactcccaccaacagtacataagtattccttttctccacaaccctgtcagtatctgctattttatgactttttaataatagtcattctgactgatgtgagatcatttctcattgtggttttgatttgcgtttctctagtgatcagtgatattgtgctttttttatgattgttggccacatgtatgtcttcttttgagaattgtctgttcatgtcctttgcccactttttaatggggttgtcattttttcttgtaaagttaaattccttatagatgctggatattagatctttgtcagatgtatagtttgcaaaaattttctcccattctgtaggttttctgtttactctgttgataatttcttttgctttgcagaagctctttagtttaattagtcccatttgtcaatttttccttttattgcaattgcttttggtgtctttgtcatgaaatcattgcctgttcctatgtcttgaatggtattgcctaggttatcttctggagtttttgtagctttgggttttacatttaagtcttcatatggtttggctgtgtccccacccaaatctcatctttagttgtagctcccataatttccaaatgtctggaaaagactcagtggatggtaactgaatcacgggaattcagcattgaatcccatgctgttctcatgatactgaatgagtctcatgagatctgatggttttataaaggggagttcccctgcaaatgttctctttgtctgctgccatgtaagctgtgactttgctcctccttcgccttctgccatgattgtgttgccttcccagccatgtggaactatgagtccattaaacctctgtttcttagtaaattacccagtctcatgctgtctttgttagcagcatgagaacagactagtacagtaaattggttctgggtagaggggtgctgcagtaaagatacccaaaaatgtggaagcaactttggaactgggtaacaggcaaaggttggaactgtttggagggctcaaagacaggaagatgtgagaaagcttggaacttcctagaaacttgttgaatggctttgaccaaaatgctgatagtgatatggacaataaaatccaggctgaggtggtctcagatggagatgaggaacttgttgagaactggagtacatgccactcttgctatgcaaagagactggcagcattttgcccctgccctagagttctgtagaactttgaacttgagagagatgatttagggtatctggcagaagaaatttctaagcagcaaagcactcaaaaggaagcagagcagaaaaatttggaaaattgccacctgacaatgcagtagaaaagaaaaccctagtttttggtgagaaattcaagccagctgcagaaatttgcataagtaaccagaagccaaatgttaatcaccaagacaataaaaatgtctccaaggcatgtcagagacctttatggcagcccctcccatcacaggcctggaggcctagaaggaaaaaatggttttgcaggctgggcccagggtcctcttgctctatgcagccttgggacatggtgccctgcatcccaggtgcttcaactccagccatggctaaaaggggccaacacacaggtcaggccattgcttcagaaactacaagccccaagccttggtggcttacatgaggtgttgggcctgtggatgcacagaagtcaagaattgaggtttgggaacctccacctggatttcagaggatgtatggaaacacctggatgtccagacagaagtttgctgcagcagtggagccctcatgaaaaactttgctagggcagtgcagaagggaaatgtggggtcacagtccccacacagagtctccactggggcactgcctagtgaaggactgagaagagggccactgtcctccatatcccacaatggtagatccactgacagcttgcaccatgcttctggaatagctgcagacactcaatgccagcccatgaaagcagccaggaggtaggctatacccttgcaaagccacaggggtggagttgcttaaggctgtgggagcctacctcttgctctcacacatcagtgtggcctggatgtgaggcgtagagtcaaaggaaaccattttggaactttacagtttaataactgctctattcgatttcagagttgcatgggacctgtagccccctttgttttggccaatttctcccatttggcacaggcatatttacccaattcctgtatccccattgtatctgggaagtaactaacttgcttttgattttataggctcctagacagaagggacttgccttatctcagatgaaactttggactgtggacttttgagttaatgctgaaatgagttaagactttggaagactgttggaaaggcataattggttttgaaatgtgaagacatgagatttgggaggggtcaggggtggtatgatatggtttgcctgtgtccccactcgaatcttatcttgaattgtagctcccataattcccacatgtctgggaggtactcagtgggaggtaactgaatcatggagggggtctttcccatgccattctcatgatagtgaataagtctcacaagatctgatggtttttataaaggggagttcccctacaaattccctttgcctgccaccatgtaagtcatgactttgcttctccttctccttctgccatgattgtgaggcctctccagccatgtggaactgtgagtccattaaacttctatttctttttaaattacccagtgtcaggtatgtctttattagcagtgtgagaacagactaatataagtctttaatccatcttgagttgatttggtatatggtgtaagccaagggttcagtttcagctttctgcatattggctagccagttatcccagcaccatttattgaatagaaaatcctttccgtattgcttgtttttgtcaggttggtcaaagatcagatagttgtgggtgtgtagtcttatttccaggttctctatattctgttccattggtctatgtgtctgttcttgtacaagtaccatgctgttttggttactgtacccctgtagtgtagtttgaagtcaagtagtgtgatgcctccagctttgttctttttgcttagtgttgccttggcttttggtctcttttttggttttgtatgaattttaaaatagttttctctagttctgtgaagaatgtcaatggtagtttaaagggagtagcattgatctataaattgctttgggaagtatggccattttaatgatatcaattctccctattcatgagcatggaatgtttttccatttgtttgtgtcatctctgattcctttgaacagtggtttgttgttctctttttagagatctttcccctcccttgctaactgtatccccaggtattttattcttttgtggcaattgtgaatgtagcaaaagttcattcattatttggctctcagcttgattgttgttggtgtataggaatgctagtgatttttacatattgattttgtattctgagactttctattataaagacacatgcacacatatgtttattgcagcactattcacaatagctgagacatggaatcaactcaaatgctcaccaattatagactggataaagaaaatgtgttacatatacaccatggaatactattcagccataaaagagaatgagatcatgtcctttgcaggaacatgggtggagctggaggccattacccttagcaaactaacacaggcacagaaaaccaaatacctcaagtctcacttataagttggagctaaatgatgagaacacatggacacatagaggggaacaacacacactggggcctactggagggtggagggtgggaggatggagaggtcaggaaaaccaactaatgggtgctaggcttaatacctgggtgatgaaataatctgtacaatgaacccctctgacacacgtttacctatgtaacaaacctgcacatgtacccctgaacttaagttaaaaaaattgcataaaaatgtatttatttatatggaaataagttcaaactttagtcaaacattaacaaattaagattgtattcaaacaataatatttgatttctaaaaatttagaattggatgcactagcagtgattatctttgtgtgacgagttatttgtactttctttgtgcttatttgtaactttctgatctttttacaagaaacaaataatacagcaataactctttcaagtctcaggcttcttggtaggagctcaagcctgtatatacaatcctctttgaagctgatctttaactataattcctagttattttatttgttgctaattttgccaaacacaaatttgtaagtaaatgtttaacatgtatttaaagtaaaaatgaagaccaatcaggttcaagaagcagatttccagctgggcatggtggtttgtgctggtaatcccagcaatctgggagaccaaagcaggtggatcacttgaggtcaggagtttgagaccagtctgaccaacatggtgaaacccccttcgctactaaaaatacaaaaattagccaggcatggtggcaggtgcctgtaatcccagctacttgggagactgaggtgggagaatctcttgaacccaggaggcggaggttgcagtgagccaagatcgtgccactgcactccagcgtgggtgacagagtgagactccatctcaaaaaaaaaagaaaaaaagaaacagatttccttaaacacataaacacaaatcactgtgagcaataactgcacatttttacagaagtaagataaagaggatattttgtatgataagagtggttggtgagggaactatcttagaaattgctttgaaaattgatttatagtcattcaaggaattatttcttgaatgtactcatcttattctgtctttaggctcattttatatttggcaaacatactgtatcagtcagaatcctaacaggaaacagatggcacagtcaacagtataattgaagagcgtttgataaagggaccgtttacaaagatgagggcagagctccggaaaagccaaatgccttggctggcaacatcagagagtgaccaccctgcctgggttgaaagagcaagagggaagacctattatcagaactctgaaagggccacctgagagaagcagggatttcatagaacaaaagttattatcctggtcacgtagggcagctgtactacatgttttggctcagcctttcaggcagcttcaatctcaggacagctccatatcaacacaagctttcacaatcatcatggcaggagaagagcctggataagcacatgccagctcttaaatgctgctaattagaagtggtgcatcacttctgctcacattccattggccaaagcaaattatttggctttgcccacccaacttcaagggagtagggaagacagtcttcctatctactcaaaaacaaaggagagggccgagcactgtggctcatgcctgtaatcccagcactttgggaggccgagttggacagatcacctgaggtcaggagttcgagaccaggctggtcaacatggtgaaaccccgtctctactacaaatacaaaaattagctgggcatgagtgcctgtaatcccagctactcaggctgaggcagcagaattgcttgaacctgggaggtggaagttgcaatgagctgagattgcaccattgcactccagcctgggtgacagagcaagactcagtctcaaaaaaaaagcaaaggagaactggaaacactggtgaaaacctgaaaaacacagacagagagtaacccgtgttcttttacattatgctgcattcttttgtatgagaaagaaactttcattggacaataatacatgctctacagctatgctgtccaatacactagccatcagccacatgtggctactgagcactagaaatgtgtcaagtctcaatcgagatgtgtggtaagtgtaaaacaaacctcagatttcaaagacttagcatgaaaaagaacataaaatagttcattactgattttaaaatattgagtacatgttaaaatgataatgtttgatatcttgggttaagcacaaatctattattaaaagtaattttacccagttttgctttttaaaatgttgtttctagaacatttttaattacacatgtggcttgcatttgtagtttgcattgcattgctgttgaacagccctgctctaaagagtcctatggtttctaacagggttcttactagaaagaggtgaagaattaccaaactctgctggaattctctagaataaatttttactttaattgatcttggaaaaaatggattttttttcttttattttagtgtctgatttaaatttctttatacaaattcagtatcatttttttctctcttccataaaggcgcagcacagatggttcagagaaaccattattctacataaagtcttttttataaaatgtggttacatgaaattcagtttgattaaaacaaagggagccattcctcaaacacgttgtttttcagtttcttagtttttcacagatattcaacttgaagtcttcaacttttttttttttttttaactgggagggagagtacagagaaggccactcaccttgccttttcatatatatgtagagctgaaattgtaagatgttctgaagttttcttggaattttggtctagcaaaaactattgagtggtctgtgccacagatgtccttcctcctctccacccaccctagacccctcttcttcccctgtacccatctgtctgccctggatgctgacttgggtggtctgcaccagaagtctctcatctttgacttttggttctgttcagctaatggagagttctggccagacaatcaaggagggaggggagcagggtcagagtgtctactcacctggttccctcctgcaaggtcgcctggtgctgaacatccagaggtgtcaggaaaagagcatcactgcaaataacccaggaagaaaggatttaatatagaaagaagagcttaggcaaaaggtggagggcactgggatgagaaagtctggatgacagattcagagggtcagagagataatcatagtcactctagccagtgcattggcatcagggcttcccagtatgatagagatcatagacagtctacgaagcaatgcatgtttggttattgagtgggacccagaaaagggaggttgtcaaggagtctgtggaagctgccgctaagtagggtgggcttgaggctgatttggtgagcagtgacagcccttagagaaacatgctatattcagagcaggaagagagagggccagtgtggggaggcctgccagaaacatcacatctctctgtcactgtctgaccaagatgacctcccaaaagtaatggtttttccctcaagttcaccttccaaatttcacttgaattcctctccttggcaaaccctaacttggaactatactgggaagggcattcaggaaactgacttcccagcctcagacaggagcagaggtatcaagctgacaacagtctggcataggccagctgtgtctcgtgactgagggccgtgttactttaaggaagccttcttttcaccactgcaagttccagagtttgcctcggctcatgctttcaggcctgagatatcccttttcatatgttgggagtggtaacagcttccttgggtgaatgccctatcccttgtgattcccgaacactctgccctccctcccccatgaataatcttgatctgagggtgctgtctgcattccactgtgactcagactgacaggtcccctggcatcttgtgggaggctgtattaaaacaagaggtcttagtgtctccgccaataactaaaggacacaggagagcaacattttaaaaagagatttgctgaagtctaggaaaataaggcagtttttcctgcctttctgcctgagttttttaaaggctttacaataccttttaggaaaaataaactcattataataatactaagttaaaaaaggaagttatcaggatgcattttatatgttatagtttattctttagcaaagaaatatcaagattccaaccacacattaagcttaacactcatagcttcttggtcttccaaagtgtaccttgtacttcttttggatgggaggttgaaaaacttcctttgtttcttcacccccaattatttctctaatgagaggcttagactagatgatctcaagtatcccttgtatactcataagggatacgaaacattccctgtttcagtcaagtttgtggcgtatattgattggtgaggaaaatgtttagagatctttttgaagcactaggtgagtatattgtgaaacaaaatttaccttcccatttcactaagagaatgagagacattttcactaatacctttgaaagcattatgcaaaagagtgcatggttctaatagaaccccagcctagttcaggagttggcaaacaatggcctgtgagtcaaatccagcctgctgcttgtttttgtaaattaacttttactgaaacagagccatgcttatctgtttacatattgtctatggctgctttctcactaccactacagagctgagtagttgcaacaaagtttatctggcccacaaagcttaaaatatttactacctggcccttaacagaaaaagtttgccaacccctagtttaagtaataaaatttgtaagcagctctcttcaagtaaaattccctctctagatttttcagaaaagatataacctgagatcctaacaatgggtaacttagagtacaaataaatgtctattttggatgcatgaaaattatagtacctcatataatacgtcagaggcagcctgatagccctgggatctaatctcaattttgttatttaccagcttaatgaccttgtgcaagttacctaatctattctcagttgtaaaatcgcatgaaagagtatgtgaagcaccctaaatttctatccaaaataatccaaaagtgaaggattattgaatattaatttttacactgaagaaagatgaaagatctgaatctatggggttagaaggttggaaatgcatcatatgggtatagaacttagaatgcaatgtactctaaattattaaacaacattttcttcccattgctcccgtaaagccactccttcaacagaaaaacttgactctcttaggcaacatattggaaactgtgcataggagtgagaaacacaacagcagaatttagaatgaatgtagcctggcaactgtgtgtaccgggaccctggccagcaatgccttaggataggagagctctcaagctatgaagaacactgcagtgggctctgcaactggactgtgcaatggaagcttccagctgtggaggcacaaggagattgatctctaaatgaggaacagacaacctgccgaggaacacctgtgttcctcaaatgtcaaacctagatctagaagggtttagagacacaacccagaggaaagcctggggaacatacaaaggtttaaaaagaccatccttttgtatttactttcagaacgaaaggaggaataaatctaattcttctcttctggctctgcaaagttcgaagtccaccaacacacttcagcttgagctgaaattcaacagataagaaaagattcttaatgattaatcagccccaacacagttctggagaaagaaagagactttattttcattttatagatggggaaactgaggctgtgagcggtcagaacccctttggggtcatacaatttttttgtgcagattgagaaagaatctctgggtctctgactcctgctctactcttcttctctagaacccagaacttgtgtagaatacactggacctcctctgatttatgacatgaccttggcatgttggggaatctctgtactttcgttcccttctctgtaaaatggtcagaattcctgtctatctttccacataaatatattgaagttcaaatgtgttcacagacaggaaatcgtgattcagtggatttggcagatgcttattttcctacataaaattcatcctcttctttctaattgcttgcagcaatctgcccagcttcagggaataaatcatgattaaaccactacagttatggtagtcccatgcccttttgccagaggttggactagatattttcatgtgacccagactcctcaataaaatctggaggagagcctgaaatgggttttagaaaactctaaggatagtcctgttatacctcttgaaagtcacaggtggtaatgtgcagaaaagtttaagtgtctgcaaaggatactctcatgtgcggtatgaggtaagatggaagacagcaggggtggagcaaagcacaagtcagttacaaactcacacactgattcaacaaatatttatggtgtgcccaccatgtgttaggcactggaaacacatcagagaacaaaacagaccaaattcctgggccccatggaaattacattctagcaaggtgaaacaaacaagagaagtaagtacaacatgcagcatattggtaataagtgcaaaagaaaccaatgaagcagaaatagggaagtgaatgaattagggtgttgagattttaggtagggtaatgaaggatgtcctcctggagaaggcagcttttgcataaagcctgaaggaagtgaggaagtgagccatggtggaatctggagtcagaacagccctctcagaggagacagtgaggaggctggtgtggctggaatggagtgagccatgggggaggagtagaaattgtgatcagtggtattgagagccacatcagttgtgtgaaccctcaaaagcactgtggttcttaccctgagtcacacaggaatccagggaaaggttttgagcagagagatgtggacaaatctttatcttagcaggatcattctagcagctttgtacaagtaggctgaagaggcacaaggacagaaatgaaccacatagtaggatatttaatataggtgagagtcattggcagcttcagccagagtggtagcttggaaaggtaagaagttgttcagaatctagatataattgaagacagagttggcaggttctattaaatataagagtggggtttgaggaagttgaggatgactccaaggtttttgatttgagcacctagattgatggagtctggaagattgtaggaacatcaggatttggaggcaaggccagaatcttgcttttcatcttgtttgagatgcctattagtcatctaagtggacatgtcaagcaggccattggataacaagtctaacaaattgggcatttaattgcatggaagaaacaccagaaatgagtcacagggaagcatctgactctctgtgtgaaaagcaggataatttcttcaaacctcaatttcctcatcattgaaatgggagtaacaaccagtgttgtgaaggtttaataagatgataaaaggacctagcacagtttttttgagcaataaacagtaaatattattaataattacttactatttttacattttcctgcctgagtagaatctacagaaaattaagtcacttgacctaccatttagtttccttgtcctaagaataaaggaatctctgagtatttttaatgggcttggtgacttacaatttcttatagctgtcatataggtctagggtaaagatgcaatttttttcctgttttatagatgaggaaacagacttagaagtaaaataactttcccaaagttacacaactagtgtcatcttcgaagatcagtttttcaattatttttaatttaacacattgcatctttaagaaccttctcaaatatatctactttttactgacaccgattttaaaaaatgaacactttccctccatgttaataaataatttttaggaagaggttctcaaaatttagttttcagagaacaaaagtctagatagagtagggaattcttacccacaataagaattaatgcaaatatggatgtttcataatgaatgatgataaccttctgggtttacacttaatggatatgtccacttgacaaatggcatagcgattatccaacacttccccatgtaggttgatccacagtaacaaatggccatactgcccaaagtaatttatagattcaatgccatccgcatcaagataccattgactttcttcacagaattagaaaaaactactttaaatttcatatggaaccaaaaaagagcccatatagtcaagacaatcctaagcaaaaagaccaaagctggaggcatcgtgctacctgacttcaaactatactaccaggctgcagtaaccgaaacagcatagtactggtacaaaaacagatatatagaccaatggaacagaacagaggcctcagaaataacgccacacatctacaaccatctgatctttgacaaacctgacaaaaacaagcaatggggaaaggattccctatttaataaatggtgttgggaaaattggctagccatatgcagaaaactgaaactggaccccttgcttataccttatacaaaaattaactcaagatggattaaagacttaaatgtaagatctaaaaccataaaaaccctagaagaaaacctaggcaataccattcaggacataggcatgggcaaagacttcatgactaaaacaccaagagcaatggcaacaaaagccaaaattgacaaatgggatctaattaaactaaagagcttctgcacagcaaaagaaactatcatcagagtgaataggcaacctacagaatgggagaaaatgtttgcaatctatccatctaacaaagggctaatatccagaatctacaaagaacttaaacaaaattataagaaaaaacaaacaaccctaccaaaaagtgggtgaaggatatgaacagatacttctcaaaagaagacatttatgcagccaaaaagcatttgaaaaaaagttcatcatcactggtcattagagaaatgcaaatcaacaccacaatgagataccatctcacacaagttagaatggtgatcattaaaaagtcaggaaacaacagatgctggaaaggatctggagaaataggaatgcttttacactgttggcaagagtgtaaattagttcaaccattgtggaagacagtgcagtgattcctcaaggatctagaaccagaaataccatttgacccagcaatcccattactgggtatacacccaaaggattataaatctttctactataaagacatatgcacacgtatgtttattgcagcaatgttcacaatagcaaagacttggaactaacccacatgcccatcaatgatagactggataaagaaaatgtggcacataaacaatgtggaatactgtgcagccataaaaaaggatgagttcatgtcctttgcagggtcatggatgaagctggaaacctttattctcagcaaactaacacaggaacagaaaaccaaacaccacatgttctcactgataagtgggagttgaacaatgagaacacatggactcagggaggggaacatcacacaccggggcctgtcggggggtgggcgctaggggagcgataacattaggagaaatacctaatgtagatgatgagttgatgggtgcagcaaaccaccatggcatgcgtatacctatgtaacaaacctgcacattctgcacatgtatcccagaacttaaagtataacagaaataaaaaaaataaattaaataaaaataaataaataaataagagctagccaaattgtaaaagctaagtacccatcagtaaatgtttaagttatgtttagccctatcatgctctatatcatcatggagtgcttaagaaaaacataataagccaggcacggtggcttatgcctgtaatcctaacacttagggaggccatggcgggcagatcacctgaggtcaggtgtttgagaccagcctgaccaatatggcaaaaccccgtctctactaaaaatacaaaaattagccggctgtggtggcacatgcctgtaatcccagctactcaggaggctgaggcaggagaatcacttgaacccaggaggcagaggttgcagtgagctgagatcacgccactgcacaccagcctgggtgacagagtaagactctgtctcagaaaaaaaaaaaaaagaaaagaaagaaaagaaaagcataataatacagcaattatggtaaatagaataaaggcaagctaggactaatacaaaatgctctggcctacatgaaatatgcatgcattagaaaaaataccttgtattgtatttccttttattgtatttcctttcatgttcacagtggctgatctttccctattcttataacagtcaacagtttgtgtatttacatgtgccagaccctgcatttagtgttttatagatatccttatttaaacattaaccataggatgagattatatctttttttaaaccattaccatgaatacttttatttttttagcacagactattataagtggatgaccagttttcatcctttttatttaaacagctttattgtggcatattttacatatcacagaattcatctatttcaatacaattcagtgatttctagtaaccttaccaagaaatgcagtcatcaccatagtccagttttataattttttatttccctactaagctccttcgtgtctatttacatttaatcctcatttctactcccagccccagacaatcactaatttaatttctgtctctatattgccttttctggacattttatataaatggaattatacattatgtggtcccttggtcttttgtacctggcttctttcacttagtgtaatggttttgagttttgtctatttcatagcacatgtcagcagtttattcctttttattgctgagaaaatctcccagtatagtgaatataccagcttttgtctatccatttgccagatgatggacatttaagttgtttatggtttggggatattataaatatataccatttcttagatgaagaaactgtggcctccaagaaggtcagtaactctccccagattgcacagctactcaatgtcagagccagggtttggatccaagcttacccaactccaaaacccaatcacgctgtttattgctagaattaggggatgaattttgtcctttatatttttgtttctatacatcttatgatatatattttataatttaaaattttgttagaagtgtttaaatatctttaaattgtgaccaataaagctatgatgtgttacctcttccagggatagtcagattttgtggataaagtgttagctttattcattccttcagtaaagctgtcacatttcagccctcaacaaaagataaaccaaagacagggaccatggtagcaggctaccccagagatgccttgcagatttacctctgctgaagcctctggactttgtgctagcactgccatagaattgctcagggtcctcctggaaccataagacatcccgggcttctgtttgaagctgaaggttaaagatgaggccagaacaacctgagtgataggagtaaagtgttcctcaatgaaaacatttcctgatcaatctgtcttttatgaagtcagacaaaagttgagtaaatcctggtatttttactggtttgtttttcaatgcttggaaatgttttactgagtgtaggcatttttctgtgggtcttaacagcagttacacttcataatcatcttaaaacacacctaacataaaatttaccatcttggccatttttaactgtacaattcagtggtatgaaacatattcataatgtttaataatcatcaccatccagctccataactgattttcatcttgtaaagctgaaactctacacatatcgaaaagtaactccttatgtctcccactccccagcccctggcaaccagtctatatgtttctatgattttgacaactctaaatacctcataaaaatgagatcaggcagtatttctttttgtgactggcttatttcacttagcatcatatgctcatagttcatccatgttgtagcatatgtcagaatttccttcctttctcagcctgaatagtattttattgtatgtatatgccacaatttgcttatccattcatctgttgaatggacacttgggctgctccgtgttttagcaaatgtgagtagtgctgctctgaacatgggtgataaatttccctaaaattttgtgttcaattatttggacatataccaagacgtgaaattgctggattgtatggttatctgtttttaattttttcaggaacttccatactgttttccaagtagctataccattttacattcccacttgcagtgctcaagggttccaattttccactttctccacatcctcaccaacacttattttctgttttttgatagtaacctttctagcaagtgtaaagtggtatcttattataattctgatttgtatttctctaatgattagtgatgctgagcatcttttcatgtgcttattggccatttgattattctctttggagaaatgtctattcaagtcctttgcccacttttgaattagttttttgttgttgttgctgttgagttttaagagttctctatatattctggacattaatctcttatcagatatatgatttgcaaatattttcttctatttgtggtttgcctttttactctgttgatactgtcttttgatttacaaaattttaaaattttcataaaatccaatttgtctatttttctcttgtcgcctgtgcctttggtatcatattcaagaaatcattgccaaaccagtgtttcaaaacttttgccctatgttttcttctaagaattttatagtttagttcttacatttaggtccttggtccattttgagttaatttttgcatatgatatttggtaagggtccaactccattcttttgcatgtggatattcagttttctcaacatcatttgttgaaatgattgttctttcctcattgagtggtcttagcagccttgtcaaaaatcatttgatgatacatataagggtttatttctgtgttctgtattctattccattggtctatttgtctgtctttatgccaataacatagtagtaacttttgaaatcaggaagtgtgagtcctccgggtttgtaatttttcaagaatgtttggctatttggggtcccttgagattctatatgaattttagaatgggttcttctatttctgtaaaaaaaagtcattggtatactgatagagattgcattgaatctatagattgctctgggttatattgacatcttaacagttttatccaaacatgggatgtgtttcaatttatttaggtctttaatttctttcagtaatattttatagttttcattgtacaagtctttcacctccttggttatttcctaagtattttattatttttgatattaccataaatggaattgcttttgtaatttgctttgcagattgttcattgtcagtatgtagacatccaactgatttttgtatgttgactttgtatcctactactgtgaataattcctctattagctctaaaagctttttgtgaaatctttaggattttctgcatatcatattatctttgaacagaaatgattttattcttcctttttagtttggatgatttttattttttttcttgactaatgtttcaggctagaacttccagtactatgttaagtagaaacggtgaaggtaggcatccttgccttattcctgatcttagaggaaaggtttttgtcttctaccattgagtatgatgcttattttaaattttttcatatatggcttttattatgttggggtaatatgtaataggaatgtcctcctattcctagttcattggaatgtttttattatgaaaatggttgatttttgtcaaatgctttttctgcatttgttgagataattgtggtattttttctttattattttaacatggtatattacattgattattacatgctgaaacatccttgcattccagaattaatcccacttgatacacaatctttttaatatgctgctaaatttggtttgctagtattttgttgagaatttttgcatcaatattcttaaggaatattagtctgtagttttctttttttgttgtgtctttggctttggtatcagagtaatgctggcctcactgaattagttagaaagtgttccctacttttcaattttttgggaaaatttgagaaatactggtattagttcttctttaattgtttgataaaattccccagtgaagccaccaggtccagggcttttctttgcttaggaattttttttaatactgactcaatctccttactagttataggtctattcaggttttctatttctttatgatttagacctggtagtttttgagtttctgagaatttcctcatttcatttagattatccagtttgttggtgtacaattgttcatagtactctctaataatcttttttatttcttaaaaagaataatactgaatcagtagtaagttccccttttatttttaattttagtaatttgagacttttctgttcttttttttgtctatcaagctaaaagtatttcaattttttttctcttttcaaagaatcaacttttggtttcactgattttctttattgttttctagtttctatttatctctgctctagtattattttttcttccttctactagctttgggtttagttgtaaagttaggtttttgatttgagatctttcttgtttttaatgtaagtatttatagctataagtttccttcttagcattgctttcccttcatcccttaagtttttggaatggtgtcttttttaaaatttatatctaagtattttcaaatgttcctgtgatttcctctttgttccattggttgtttaataatgcattttttggttcccacaaatttttaattttccagttttacttctttatcaatttctaatgtcatctcctagtgtcagagaaaatactttttctttttttcagactgagtctcactctgttgcccaggctgaagtgcagtggcacaatcttggctcactgcaacctctgcctagtgggttcaagcgattctcctgcctcagcctcccaagtagctgggactacaggcacgtgccaccatgcccggctatttttttgtatttttagtacagatggagtttcaccatgttagccaggatggttttgatctcctgaccctgtggtctgcctgcctcggcctcccaaagtgctgggattacaagtgtgagccaccatgcccggccagaaaatactttttatgatagttatccttttaaatctattgagacttaatttgtggcctaacatatagtctattttggaaaatgccccatgtgcacttgagaaaaatgtgcatgctgttgttgttaggtagagtgttctgcatatgtctgctagatctaattcatttattgtgatgtttgtcttctatttccctacttttcttttctctggtgacctattcattattgagagtgggctattgaagtgtccaactattattgtagaactatcttatttctcccttgaattctgtttatgcttcatatatatatatatatatatatttttttttgtttgttttttttgagatggagtcttgctctgtcgcccaggccggactgcggactgcagtggcgcaatctcggctcactgcaagctccgcttcccgggttcacgccattctcctgcctcagcctgccgagtagctgggactacaggtgcccgccaccgcgcccggctaattttttgtatttttagtagagacggggtttcaccttgttagccagggtggtctcgatctcctgacctcatgatccacccgcctcggcctcccaaagtgctgggattacaggcgtgagccaccgcgcccggccgcttcatatattttaatagtctgtcattaggtgcatacatgtttataatgattatgtcttcttgatgtattaaaccttttattaatatataatgtcctttaactcttgtaagtttaaaaaattaaagtctatattgtctgatgttaatataaccacctctgctctctttcagctactattttcatggaatatctttttccattctttcactttcaatctatttgtgtctttggatctaaaatgagtctcttgtagacagcaaatagttagatcatgtgtttttaatcccttctgctaatctctgtcttttcactggaaagtttaagccatttgtatttaaagtagttgctgatgaggaaggacttacttctgtcataatgttatttattatctcccttatagctttttgatctttattttctgcattactctcttattttatgtttagcttatttttatattgaaatgtttacattcctttctcatttccttttgcgtatattctatagctattttctttgtggttaccatggggattacatttaacatcctaaagttatagcactctaatgtgattttataaaagtttaacttcaataacatacacaaagtctgctcctttacagctttgcttttatctccttagtgatgtcacaaaattacatccttatacattgcataccccaaaacataaactaataattcttctaaatgcaccaatctcttaaattatgtggaaaacagtgtgaagttacaaatcaacattacaataattctaatttttagactaataattgttttttaatatgtattaatctcttaaatcatgtagaaaacaaaaagtagaattacaaagcattgttacaatatattagcttttatcattgctcatgttatttacctttactgatatctttattccattatacagctttgagttactatctgctgtgctgtaatttcaccctatagaattccttgagcatttctcacagggcaggtctactagtaacagactccttcagcttttgtgtatttgagaacaccctaatttctccctcacttttgaaggatagttttgccagatatgggattcttggttcacagatgttgttttttccttttagcacattgagtatattagcccctgccttcttacctccaaagtttctgatttggaatttgctgataatctaattgagggtccactgtatttgaagagttctttgtctcttgctgctctcaagattctctttgtcttttgaaagtttgattataatgtgtcttggtgtggttccttttgagttcatcttacttgtagtttgttaatcttcttgaatgtttatattcatggttttcaacaaatttggaaagttttcagccattattttttcacatattctctctgcctctttctctctctcttctgtttcttggactcccacaatatgtatgttggtccacttggtggtatcccacaggtcctttggactctgcttttttttttcaatcttttttctttctgttcctcagacttgatattttctatcatcttatcttcaagttcactgattctttcttttgcttgcttaaatctaactgtgaatccctctaataaatgtttaattttagttatatattttggctccagaatttctttttggtttccttttaggtttttaatatccttttgatactttcattttgttcatatgttgctttcttctgctttcttgactttcttttttttggttggttggttggttggttggagacagggactgctcactttgtcgctcaggctggagtgcagtggcatgacctcagatcactgcaacttctgcctcccaggctcaagtgatcctcctgtctcagacccccaagtagctggagctataggtgtggccactgcactcagcactttttttttttttttttgtagaaacagggttttgccatgttgcccaggcttatctcaaactcctaagctcaagtgatccacctgccttggcctcccaaagtgctgagattacaggtgtgagccactgcacccagccatgccttctagactttctccacatcctattagtcctttgagcatccttaagacagttgttttaaagtcttcatttagtaaatctgccatcaggtcttttttaggggggatgtttctgttgatttattttttttcctttgaaatggtcacactttcctgtttctttgtatgaccttgtaatatttttaactggacattcgaaactaataatgtaatacctctgacaatcagattctcctctttccctgtggtttgctattgtttcatttgttatttatggggtttggtttttttaatttttgtaggttctctctgccaaggatcagcctgaggtgtaaacttaaggtctttctaaggtcttttctgatcctgcacctttccctgggcatgtgtggtctctttctaattttccttgtatatgcagttgcttttgaatgttctagtctttaatgtctagcccctgaaagtggggaaaaaaacatgaaaggaaggggaagaaaggacaattgccttttaaattccctggaagtcacttcagccagagatggaggggttggcaacaatggtggcggggggcgggaagtagaacagcagtggccagtcttctttttgtctgcacctctgtgatcaggagcagcaatcagtgattagaatggaaatctctgatgtttggatgacagagccctttatgttcatcctagctcctgcaagctttttgcaagctactccaaggacatgtgtgcaatattacaggcatggctacctgccatggggctgaaggtgagagacgggtagctgctactgtgctaagagttaaaattgatcagaattaaatgctcttcactgtctaagccttcctctggagttttaatccttcaatagactccagagcttcaaaatagctacatccgatatattctgccagtgaaattgttgtctaggtggggtgacagattcctggtgcttcctactttgtcacttcctcagaatcctccctttttatatgtgtcgtgtcactaaagatatgcattttagttaaatttgaaaatatagatcaatgtggtatggtagccagactccaagatggccccacctccagatattcatactcttagacagtctcttactacattatacctgagttgtcttgtatgtacaatgaatatgcgaaagtaatgtgttaatgctgacaactagtttataaaagatacagcaggctgggaatggtggctcatggttataattccagcactttaggaggccaaggtgagtgatccacttgaggccaggagtttgagaccagcataggcaacatagctagaccctgtctctacaaaaaaaaaaagtagaaattagcttggcatggtggcatgtacctgtactcctagctgctcaggaagctgaggtgggaggattatttgagcccaggagttcaaggctgcaatgagccatgattgtaccactgcactccagcctgggtgacagggcaagaccctgactccaaaaacaaacaaacaaacaaacaaacaaaaagaagaagaagagaggcattgcagcttttgtcttggtctctccttctctcaatctgtctctcttggatcactggctctggaggaaatcatgtcatcagcagccttatggagaggtttctgtggtgaggaactaaagcctcttgccagcagccataagactgaactttgaagaggatcctctagccccagctgccaccttaactacaaccttactagagatcctgaatcagagccaaccaacttaattgcttctcagaaactctatgagataataaatgtttgtagctttaagctactacatttgggggcaatatgttatatatcaatagacagctaatacttagggggaaattaacccataatttcacagtccaaaaattactgttaacattttgtgtgtaaaacattttgtatgtgctttacaaatagttaaaaaatatgaatatagaagctgtggtgaaaaacagtatgacagttcctcagaaattaaacagaattactatatgcaccaataattccagttctaggtatataccctaaagaattaaaagcagaaactcaaatatgtatttgtatacccatgtttgagcagcattattcacaatagccaaaaggtagaaacaacccaagtgtccatctatggatgaatggataaacaaaatgtggaatacacagataatggaatagtatttaaccttaaagaggaatggaattctgatacatgctacaggttgagcatcacaaatctgaaaatttaaaatttgaaatgctccaaaattcaaaacttttcgagtgctaatgtaacatgcaaaggaaatgttcattggagcattttagggtttgggatgctcaactgggtaattatataatgcaaatattccaaaatctataacacttctggtcccaggcattttcgataaggcatattcaacctgtggaacatggatgaaccttcaagacatgatgctaaatgaaataatctagacacaaaacaacaaatactgtatgattcttcttacaggctatacctagaatagtcaaattcatagagacagaaagtagaagattggttatgggaatgagggaaaaaattaaaggggacttattttttaacttttaagttcaggggcacaaatgaaggtttgttatataggtaaacttgtgtcatgggggcttgttgtacagattatttcatcacccaggtattaagcataatacttattagttgtttttcctgatctccctcctcccaccctccaccctctgaaaggccccagtgtgtgttgctctcctttatgtgttcatatgttctcatcatttagctcccacttacaagtgagaacatgtggtatttgtttttctgtccctgtgttagtttgctgagaataatgacttccagcttcatccatgttcctgcaaaggacatgaacttattcctttttatggctgcatagtattccatggtgtatacgtaccacattttctttatccagtctgtcactgatggacatttatgttgattccatgtctttgctattgtgaatagtgctgtaataaacatacatgtgcacatgtctttacaatagaattatttatattcctttgggtatatacccagtaataggattgctgggccaaatggcatttctgtctttaggtctttgaggaatcaccacattgtcttccacagtggctgaactaatttacactgccaccaacagtgtataagcattcctttgttggggagttattttttaatgggtacagaatttcagtttaggatggtgaaaaagttttggaaatggatagtggtgatttttgcacaataatgtgaatgcacttaatgtcactgagttgtacacttaaaatggtaaattttatgtatattttaccacaataagaatacattaatatagaatgatattaatttgtaactcttctctttactcaatgtcataaatgtctttccatgtcaagtagaatgtacatcattcttaatatctggatagtaatgatagaggcaggaagcagagaaattctaggcagacaggggcaggttcccagtgaaacaccacctttcagctgaaaagcctgaagcctgcagtccaaagtgagaacttctatccctgtttgcccactttctcccaattggttctttctggataatgtctttttaccaattgaatgttgctttttccaaaactacacatggcctgccttgccccgccccctccacatcgtgtgcctataaagaccccaggctcagttgatatagaagggagaggggcaacttggcttcagagggaaggctggactttggagtagagatggcttggcttcagagaggcagtttgacttcagggaagagccagccgaagatgaccagactctggggaaagattacctgcccatcctgccccctctctagcttccctctcgctgagagccacttccaccactaaataaaattctctgcctccaccatctttcaagtgtctgtgcaacctcattcttctttgatgccagacgagagcacaggacccactgaatacaggtacccagaaaaggctttcatactggctctttgcccttgctggcagagggcagctgccccatgcaatgaggcaaggggcccaatgagctgataacacactgctgtccatggatggtggatctaagagagcactgtaacatgccctctggagcttcggggtcacaggcgcccccacctgggtgctgctgcggggtccccatggagcttgctcctgccagtggccaaaccagccagctggatcccgcactcatttgctcacacctggtttggctgcagggcccacatggagcttgctcctgctagcggccaaatggccggctggatcctccactcacttgctcacatgcttcctcctgcaaggggttgagcaccatgggctgagtaaatggggcacccccgtcgcaaatccaacaaagcggtcgagaaaaatcctgcatcagtaatgcatttgatggacatcctctgatttgggtccaaggaagtcatagaactcggagttacagacccactgacttctccaactacatctctgttggacatctcttctctctttgtctctctgtgtctctgtttctttgtctcactctttccctttgtctctttcatgatttttaattgtagaatttaagagcctttctctttgcaaaaatcaagctttaaaaaaatgtgagtggagtggggtacaggaaaaatttaccttatttgatttgtttttcccccttctctagcagattgagaagctttcatgctttctctccagttagcttgggattttattaccaataaagtgtcactctgtgctcttcagagccttacaccatttgtaggctcactatgggcacatttgtattgctgatgtgcaatctgtgggttagaagtaaaaaatgctaacagagccttgagaagcctccttgcagtgataagggttatcctggaggacagaggcatctcagcaggctggctccctgggaacacagatggagctcgagaggagtaggttcaggactgtttctgtgaatggagaagaggtttcaaagagatttttctgaaatttcattctctggtttgtttgtgtgctgtacaagtaagatggatcacatgttagaggctgagtctccaagggaggatgtgttctggcagagtcaccagggggcagggtaatatttctttccatcacactttattttgcaggtttagaaacttgattttatcagaggtgcataacatggtttgtttatttaccaaacttgatagagcctgatttgtataaagggtccaccttagaatttccaccgaacagcacctatcaggtaggccatgttaacacatttcgttattgataggtagtgggttgggattttttcctcttaggattttgggttttggagtcaaacatgcaaaggtacgatagcttctaatcttagagaagctacttgaacttcaatttcctccccagtaaactagaaaaaaaatacattgtaagattatgaaaaatacatgtaatacagtacataaagtatctagcacagttagtaacactcatagtaagctcttcatccttttcctcctcctagatgagattaaggggtttgtaatcaagtcacaaatacccagggcagccactcacacaggcaagtacttaataagccagccagggtgctcaagtccagctaggcctggcatgctgttccctggacagggttggtattcagtccagcaaacgtatgaggcatgtatggtgtcaaatactgtggaggacacgacaatgtccaagtcatagttcctgccctctgaaaacacatgtgcatccacagaagcctacaggatttgcattcaagtgattaaaatctcacccaagacttgtgcttctcaaagtgtgaatcctgggcctctggcagcctgacagaaagtgactgtcacattcacagaccttgcagacaacgtaggtagatggaaaaatctcacaaaccctaatttatccatatctaaatataagcatattgcatatagtttaaggaataaggaataaaactcaaataattttcttaacttgtacttttgatcttaaagaaaattttgctccctctccctctctctctccctctccccatggtctccctctccccacggtctccctctccctctctttccacggtctccctctgatgccgagccgaagctggactgtactgctgccatctcggctcgctgcaacctccctgcctgattctcctgcctcagcctgccgagtgcctgcgattgccggtgcgcgccgccacgcctgactggttttcgtatttttttggtggagacggggtttcgctgtgttggctgggctggtctccagctcctaaccgcgaatgatccgccagcctcggcctcccgaggtgcggggattgcagacggagtctcgttcactcagtgctcaatgttgcccaggctggagtgcagtggcgtgatctctgttcgctacaacctccacctcccagccgcctgccttggcctcccaaagtgccgagattgcagcctctgcccggccgccaccccgtctgggatgtgaggagcgtctctgcctagctgcccagtctgggaagtgaggagcgcctcttcccggccgccatcccatctaggaaatgaggagcgtctctgcccggccgcccattgtctgagatgtggggagcgcctctgccccgccgccccgtctgggatgtgaggagcgcctctgcccggctgcgaccccgtctgggaggtgaggagcgtctctgcccggccgccccgtctgagaggtgaggagcccctccgcccggcagccgccccatctgggaggtgaggagcccctctgcccggcagccgccccaactgagaagtgaggagcccctccgcccggcagccgccccgtctgggaggtggggagcatctccgcccggcagccaccctgtccgggagggagatggggggtcagcccccacccggccagccgccccgtccgggaggtggggggcgcctctgcccggcggccccttctgggaagtgaggagcccctctgccaggccaccaccccatctgggaggtgtacccaacagctcattgagaatgggccatgatgacaatggcggttttgtggaatagaaaagggggaaaggtggggaaaagattgagaaatcggatggttgctgtgtctgtgtggaaagaagtagacatgggagacttttcattttgttctgtactaagaaaaattcttctgccttgggatcctgttgatctatgaccttacccccaaccctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggagaaccagagacctttgttcacttgtttgtctgctgaccttccctccactattgtcctgtggccctgccgaatccccctctgggagaaacacccaagaatgatcaatttaaaaaaaaaaagaaaaccaaaaaaaaaaaaaaatcaaaaaaaaaaaagtttcacttgcctattgagctcctatgctctgccatcagaagagcatgcctcagaaagcaatggctccagaatatgctcaattagaaatgggttcttgagactcgctcccagattaaagaagcattcagaaaaggcttgaactcaacctactgtgggaagccaagtccaacggaactcatcagaaccacagctgacacacagatctgaggacaagaagatcgtatttgttgttgtaagccactgagatttaaggggtgattgttacacaacaaacactgactaatgtacataactaataagcttataaatcagggttttggaggctgatctaatacagcaacacagatcatggaaaaaaaaaaggaaaattttaaaagttatcacggagaaggatctgaagtttatgataaaaaatgatgggctaaatctctcctcctacttgatttgggaacattggtcatcaccctgtgatacacctggtgtgctatgattttcaagaataaggaatgttagatttcacagttgcttgctgtatggaatctgaaagtcgctgaggtccttagtctgctagttgcctcccagcctcagcataggttgtgttggtgcctgaatggttttccctattcagacatgttcttgttaactttgatgtggtatctcttttattttgagacagagtgttactctgtcactcaggctggagtgcagtggtgcaatctcaactcattgcatctttcgcctcctgggtttgattctcccacctcagcctcctaagtagctgggattacaggcgtgcaccgttatgcctgggctaattttgtatttttagtagagacaaggtttcaccatgttggccaggatggtcttgaactcctgacctcaaattattcacccacctcagcctcccaaagtgctgggattacaggtgtgagtcactgtgcccagcccagatatggcatctcttgatgccccatctgtatcctagaagtcagggtccccttatcttctgagcctgtacccctatatgaatggagaaggaagcaagctgtatggtctgcagaagtatttgactgactagtttggtattctgaaatttaaactcattgcccttaaacaatgtgctaatgttctccacatgttatgcaacagcaccactttgttttctgctgtgtttcctgagacatttgagttcttcatcttggctttttggtaatcaaagctttcccagtccagctgaatcctttctttctaggcctgtcagtacgtaaagtccttccctattccctgaggaataacccaaggtctctgtgcctttgctaggtctgtttcttttgggtagaatgcctctcctgctcctttgtccaacctaaccattttgtactcctccctgtaatctcaatttgcacatcacctctgtgaagcttttctcactgagtctgtcctttctactccctagaattagtcaaacctccctcccaatagttccttgccggtactccaaccatggtgtgtatgtgttgagaaataaacaagccagaaacaaacttagaagttccttaaaggtgtcaaccttaaataatgagattcaaaaaatatattaagtatagagtttattcgagtgcaaagtttgaggatagccacccagagacattgactccaaatgaatgcaacaagcattccaaagtagagaagttaaatttcagcagcatggcaacattttccatacacgaccagtgcacacacacatcacagtgatttgattggttacgaactgctacattctaaggaagattgctttattactccaagaggaagagtagtgagctgagggagtcttatctctggggaactttgttcttaattatttacagaaaataaaaaaggcagaagttgcagctgcatgccatgtgacttaagctgcatagccacattcctctcaaggctcaggataacttcaatttcaaacagctttaagtttgaattattttaagtttgaattatttaatttcacaaaggctacagccatgttttctctgctctttcctcaatgtgggatccttcatgtcattgaattctttattggacatctattatgtataaagccccaaaagataactgatgaggagttttttttatctcagagtaggatggaggtgtgaggccagggagcagagcctgctctagatgttaccacttttctcagggtgcttaacctgcttcagtgcggccgttgctaccgcccgctggtgcacttctgaggttattctccaccgtgccagaacctcccgccatcctctgctaggggaaagatgaaagagcatactatttactttttttagtctttatactttgcctcccttgataccaaaggatgggcaggagcatgtctgacctcctgatgtggatgttgcaattgggttgaggctgctggatttacttagtaccaaatgctctcttttgcctgacttcctgccaagcctaggtgcatataaccacttgggcggtggccacccccagtgatttgaacttataggacggtagaagtatgtgaatcatgttgcttcaagaaattcagttattctccaagttctaaaataaaatctggtggatgtttgttagaagctaggtacttaactcttcagaaaaaggaaaatctgaaagaaaaatatatttaaaagtggtctaagatggctgcagattggacatagacaatagaaactaggcctatgaattaaagctgaaccctcaccagcaaggctgcagtctgtcaaatatttcactgatatgtacgaattataatacaaccctatctatcagatatagcataaaggcaggataaaatcaatcatccctctccagaccctaagatgcccacatacttgctaaccttttaccctatataacttaaccagactgttgctttatcttatgtacaatgtctctgagcaccaatcagaattgtgagaatgtcacctttactttattacccctttctctcattttctatgtaatggaacacatgaataccgtgcctcatgtaacccactctgagactcattatcggtttgtgctaagtcagtgttttcaggggctatttgtcctcaaacttggctaaggtgaaattaactttacatttttaacattataatgccttttgtttcagctttcagtcaacacgtcaagggaaggaagaaagattaaatattatttatatacctgtgtctcagacaggcagaaatgtaggctttgggataagcgatggtctggagaacctggagggagagacaaagaaattgcaactctttgggcttaaacggaagcttcaattagagaagagagttgaaatggagagaatttctattgtctaattcaaggctgatgggcttcctaagtgttttaggctagaatgagctcacatttggagaatattctgagctcttcaataatacttaagatatattaggcatgatcaaatatgtagtcatttaaagatgtttcactttttttccctttcaaaattctattagagttctcaaatgcaagagctgggatagagagtttcttcatttctgcaaaatgaagaccattgaattatttctctctgtgatgaattaaaaaaaatgctgggtctaaaatcaaatcgtctgcaagtttaagactttgactagctcagattctggctatattagaatatttgagcctgctatcaagtataagaacatgtgcaggcctcctttttacctccttctatgagtattttaccttctatttcaaaatcaagaacaggaaatccaaccctgagggttccattcctggcatatttatgccccaggcagattgagagaataaaatagactttttacaaatgaagagatatcacgctttttagcctgggacaggaaactttagctgttgctaaggcaactgcagagttctggctcttaagctggctgtgcgaggagtatctcagagccccagatgcctctgctgtcactcactgtcagaccaagtgcaaaggacttggtagtgaactcacagaaacaatgagaccatttttgaattctgaaaagcaagtgaggactctcaagacaaagtatacatatggtacctgctatggtttgaatgtttttgttcccttcaaaatacacatgttagaaacttaatccccaacgcaacagtgttaaatggtggggccttgagggaggtgtttaggtcatgaggacagagtcttcatgaatgaattaaagccactataaaaagggcttgagggagtgtgttctctgttctgctcttctgccatgtgagaacacagagttctttctctccagaggatgcagcaacaagctgccatattggaaccagagacttaacctgccagcaccctgctcttgaacttcccaggctccaaaaccatgacaagtaaatttctgttctttataaattacccaatctatggtattctgttacagcagcacaaaaccgatgaacacaataccctttaaaaataaacaatggaatgatactatagtggtcgatacatgtcattattatttgtcaaaatccataagaatctaccttaccaagagtgaaccctagtgtaaactacagactttgagtgataatgatgtgtcaatgtaggttcatcacctataagaaatataccattctggtatgagatattcatagttggggaggctgtgtatgtgttgtttgttggggggcatatatgagaactctctgtaccttctgctcacgcttgctgtgaactgaaaaccactaaaaaaaaaaagtctgtttttaaaaaattgacatccttggggctgggagaaaaggggacaagtccaaagggctcaaagccaggctgcatgggaaagttgtattagtctgtagaacaataaacgaagaaaccgtgggtatgaaagacccaaagaacactctgatgctgataagaatgtcaggctgctgtctggttgagaaaataatttggcttgctcaggctggaaaaccagtaacattgggacagactgtctttcttgtggatgaaatttgtggatgaaatgtggaaacatgctgagatttgtaaaggttatgaacgagagaatatggccttaagaaaggtgatgttttatataatgatctaattaatgcagatatctatccatctcagccccctgccttgagccaggaaaccttactcctccatgtctatccagggcccagacactagggaatattgtgtaaccacttgagcagcgcctgcaggtactgctgttttgttttgctctcctgctgtttcctagtctctggtaaccatttttgttgcaactactactgtggcccttgcaaaacgaggggtgtgtgttgtgccagagagtaggtgatataaaagtcaaagcgagaatgaggcatctccccaataaagcaatcttgggaaacctgtggttagggctgcatatacccacgtccacaccttgctgccacatggggtcccttttactgctcaaatagaccagtctattccagtgtctcttatcttgaccttaataagtcaaggatgacctttttatgaagtatgtgcatgtggaaaacacagcggagcaattaaaatgctattttctgcagttagactgccagggttggcagttcaattctaccacttactagctgtgtgaccttaagcaaattactcagctgtgggtctcttgggttctttatctgtaaaatgagaataataatagcactgacctcattgtgagttgttgtgagaattaaatgatgtaatccatgtaaaatgcttagaacagtgcctagtacactgtaatcactgaaattggcttattgttgcactattggctttctggcttgcttttgtttaaattaaggcataactatcacatggcttgatataatgcacttgggaatggaaatattgagctacatgacaaggaacaatgtattctggtacagttatatcaagtttcaatttcataacacaactgaaaaaacaaagtttaaaaatgttgacatatttctaggtggttgcagtgacaaaaatataaccaacacaacagatttgaatccctctagcactaacacctgctttatgaaatatgttctatggcatgttttctttaagaggtcgagaagctttagatgataaattctgtcctataattttaaaaaagacagcagtggtgatacatcctgttatactgagaatggaaaaatcgacttcaacttggttcttgtactgtgtcttgtttttccataaggaggaggagactgtcctctaccaatttcatttatgcttttcttgagccaagactgtgcttggccatgcttgtgggttggctcttaaagtgacgaactggtcactgggaaattgtagctcctcctcgccttcccccggtgtgctttccttaccaatcaagtaggggaaatggccttctggattatgatctattggtttggaggtaggggtggagtgtgggtgaatttgagtcacatctacacttccctaggaagctgttgcttttattatggtattaggaactttacagatgtacatgctaatattaagctattcttgcttaaaaatattttattatattaatcattgtggaataatggtttaaaatgtttctgaagttactaaatgcctggatagaaatcaaacccaaaagaattttaaaaacacatgtaaaattacttgtctaagagaaatttctgtgatgatgaaaatgtctcttctgtgctgtgtaatatggtaaccagtagccatatgtgggtgttgagcacttgaaagtgagtagcatgactgaggaactcaatttgtaattttatttaattgtaatacatttgaatttaaatagccagatgtggctaatggttaccatatcggatagtgtaagtttaaaacataatgaaaagtcacctaacctaagcctcattttcttagtatgcaaaaggtgtgaattaggccaatggttctctcgatcttggcagtacaatgaagtcactcaaagaatgttaaaagagtactgatacttgggtctcctgctgtattagatcattttcatgctgctgataaagacatacccaagactgggtaatttataaagaaaaagaggtttaatggactcagagttccacatggctggggaggcctcacaatcatggtggaaagcaaaaggcatgtcttacatggtgggagaaaagagaggatgagagccaagtgaaagggaaagccccttataaaatcatcagatctcatgagacttattcactaccactagaacagtatgggggaaaccgcccccatgactcaattatctcccactgggtcactcccactacatgtgggaattgtgggagctacaattcaagatgagatttgggtggggacacagccaaaccatatcacctgcccaatattatttagttagtctaagtctagtcattgagattcttctaaagcctctcaggtaatcctaaagtacagctaaggttgggaaccatcactgaactagattacctttaggttctttttcagttctataatataattctatatatttagcagcaaattgtactaaatttagaattctataaggcaaataggacacttattacttaagccagttgcaatagaaaagtacatatagatgttggctttttacaaaggctgtttgtcctaaaacgtttctgaaacttaatgatataaaaccaataaaccaggttattgtgatctactcctctttggagtttttcctggctgtgtcagaccatggcttaggctatagacaaggaagagtctatgtgtatgtacttgtttgggatctgactgcagcctgtgtcaaggtttggccatctgcccataaacctgcatggggtgacatcactgagtaatccaagctgccagtttatggagatctcagtaggaggtctttgggctaatcatttagagcaccacacagcaactgctgagtttgtatcttccctgggattagaaaaataaagtttttggccaagtcattctctctcaaagctactatacaaatggttccagaaggtattcaggacagtgctcccaggatttttaaggcctgaaacaaatgtacatttcttctagctaataaattcctcaaataatgagtgaaataggtacaagtactcagttttctctaaaaacaaaacaaaacaaaaacaaaaaactatttggttttaagagttatactcataacaagactttgttttgttttgttttgtttgtctgtgggccttgactaattgatatagtgtttctgtatgagagaacaaaggactacatataggtcaaatattggagattaacaaggtgttgggggaatcacttttgtttgcctgtgtgcccaccctaatcttatcttgaattgtaactcccacaattcctatatgtcatgggaggaacccagtgggaggtgattgaatatgggtgggtgggtgtttcctgtgctattcttgtgattgacagtgaatgagtctcacaagatctgacggtttttaaaaacgggagtttccctgcacaaatttgcttgctggcaaccatgtgagatgggactttctcctccttgactttcgccatgattgtgaggccttcccagccatgtggaactgtaagtccattaaacctttttcttcccagtgtcgggtatgtctttatcagcagcatgaaaacacactaacacgctttaataaactgctttatttaccatcactttaaaataaaagagcagacaatggaccagtgtaacagaacagaatctggaaccagactccatatgggtttacacatctgaatgacaaatgtgctattataaatcagtgggggaaaggaatcctgggtaaatctcactgagaaaatgcttatctttacagaaaaagtaaaataaaataaaattagattcctacctcacaccaatacataaatcaattccaggaagattaagaatataaatgtgaaaaagcaaaacctttaggcaaattgtggatgtaaattattctccaactctcaggtcatacagataagacaaaaatatcagtgaaaaagactgaaatttgactacatgcaacttaaaacttctatacagtaagatagcaaaaacaaaacaaaaacacacacacacacacacagactgggaaaatatgcttgcaacacatagttgataaaaattgaaggctcttacaaagaaaaataataaggccaaaagaaaaatggcgaactgattcacacagagggtattatatttgccagtaaacataaataagatgtactacctctttagtaaccaggtaaattcaatttttaaataatatataatttcaaacttacaagattggcaaaaagaataaaaactgacaatatcaagacttggtaaggatgtggaacaatgggaactctcaaacactgctatttggagtgaaattggcacagccactttagaaagcaatttaacaatatcaggaaaagttgaaggtatgtaatagctataatccagcaatatttttgtagcatgtatcctggagaaaattttgcacacatgtgcaaggtgacatttatggaactactcattaaattattccttataaaagtaaatattgcaagtgaaattgccatcatttggaaaaatgctaagcaagatgtggtataatcccacaaattagtgaattacaactgtgtgtatcaatatggatatgtctcaacataatgttgagtgaaaactaattataggacaaacaaaatggtatttatataaaccttaaaacaagcaaaattatactatttattgtttacagggcttagatagatatgtagtataaaaacatttatggttgcattcactttgtggggaaggggatgagattgggggaaaacacagagggtttcaaatatctctaaaatgttttgtgtgtgtgtgtttttttttaatcaagtggagtggtaagttcacaggtcttcactatatatagcttaaatgttaaagtgcttcaccaaaaaataaacagcaggccgggcgcagtggctcacgcctgtaatcccaacactttgggaggccgaggcaggtggatcaactgaagtcaggagttcaagaccagcatggccaacatggcaaaaccccatctctaccacagatagaaaaattaaccgggcatgatggcaggtgaccagctactcaggaggctgagacataagaattgcttgaacccaggaggcagaggttgcagtgagccgagatcacgccactgaactccagcatgggggacagagcaagactctgtctccaaaaaaataaaaataaaaataaaaataaaaaaataaacagccataggtagactatctcccaaagaataatcaatgataagattttgttgattaaggaaagaaaaccacaaactcacagcttaagaaagcgtacaatattagacaatacaacacagttattgagctcatatgtgtagcagatgtgaacctctgcccaaaattaaggtatgcaggaaataattcttttttagaaaaatattttaagttttatttaaggttcaggtgtacatgtgcaggttcgttacacaggtaaacttgtgacttgggggtttggtgtacagattattttgttatgcaggtgctaagcatagtacccaacagttttttttcttgaacctctccctcttcccagcctcctccctcaagaaggccacagtgtttgttgttcccctgcttctatccatgtgttctcattatttagctcccacttataagtgagaacatgcagtgttttgttttctgttcctccattagtttgctaaggataaaggcctccagctccacccatgttcctgcaaaggacatgatctcattctttttcatgactgcatagtattccatggtgtatatgtaccacatttcatttatctggtctacctttgatgggcatttaggttgattccttgtctttgctattgtgaatagtgctgcaatgaacatacacatgcatgtatcttaatggtagaatgatttatatacctttgggtatataaccagtagtgggaatgctgggtcgaatggtagttctgtttttagttctttgaggaatcgccacactgctttctacaatggttgaactaatttgcactcccatcagcagtgtataggcattcccttttctctgcaacctcaccagcatctgttattttttgactttttaacaatagcctttctgactagtgtgagatggtatctcactctcgttttgatttgcatttctctagtgattactgatattgagtattttttcatatgtttgttggctgcatgtatgttttcctttggaaagtatctgtttatgtcctttgcccactttttaataggattgttttttgctagatatttaagatccttatagattctggatattagacctttgtcagatgcattgtttacaaatattttctcccattctgtagcttgtctgcttactctgttgatagttccttttgctgtgcagaagcgccttagtttaattgggtcccatttgttaatttttgcttttgttgcaattatttttggcatttttgtagtgaaatctttaccagctcctatgtccaaaatggtatctcttaggttatcttccagggtttttatagttataggttttacagttaagtctttaattcatcttgagttgatctttgtatctcgtgtaaggaaggggttcagtgtcagtcttctgcgtatggctagccagttatcccagcaccctttattaaatagggagtcctttccccattgcttatttttatcagcttgtcaaaggtcagatggctataggtgtgtagctttatttctgggctctgtatcgatttcattggtctatgtgtctgtttttgtaccaacatgctgttttggttactgtagccttgaagtacagtttgaagtcaggcaatataattcctccatctttgttctttttgcttagggttcccttggttatttaagatctcttttcgttccatatgaattttagaatagtttttttctagttctgtgaagaatgtcattgtttgataggaatagcattgaatctttaaattgctttgggtagtatggccattttaacaatattgattcttcctatccatgagcatggaacgtttttccatttgtttgtgtcacgtctgatttctttgagcagtgttttgtaattcttattgcagagatcttttacccgccctggttagctgtattcctgggtattttattatatctgtggcaattatgaatgggactgcattcctgattttgctttcaggaaataatttttaattatagtaaagatcaacctcttttctgtttcaagtccctattcaggcttcagtcagttgtaagaaagaggaaactgtttggtttgaagtgtgacctatcctggtgaacacctctggctctactcccctggctggcctgactggctttctgttgttgattaccacaagccatgccctgaccatttgaagggctctctatgttctttcctagccatgctttgggagcagaaatgcttctgtgagaatgtctgccctggccttgactgcctgggcagaggtaggatagtacacattcactgctatttaaaaaatatgactctgccatatgagggagtttagaaagaaaaaggatatatggggaaaaaaagtagctgcttaagaaaatacagcaaaagttagctgatcaataatatttaaaagagctcacatttttttgaaaaagaaaaagcacacatgcaagatagctaaaacatattacatttcaactccatatcttgttagaaactttgttcctagcaggtaatacatgatatagatgtgaactcaaaaacaaatgttttggaaaataggcagatgcattggatggtcttcagattcagccagaatagttttcccattcagacaggattaagaagtgggtattgctgggagcagacctacttgaggatgaatgaggctctgggccttagaaagttctactatttcttgccaggtcccaacttggctgctttgtaagaagtggacttctgcctcctcagcctaacctgaagaatagaaccaggtttgtcttaaggagtttggtatatattcaggcccctcttggtactttagattctatctactttttggtatctgcatatcttttatgacaggagactaatttcttttttgttattcacaattggagatatctttaaagacaagtacctggtgaggagataaataacatttgctaaaacttattcttactcagccagtgattttccaagtgtggtccctagaccaacaacacaagcatcacctggggacttgttagaaatgcaaattcttgggctccatctcaggcctccataatgagaaaccccagaggcccagcctgctaaaatttgggaacatatgaacaatcaaactaacattttctcaaaccaaaccaaacagttttctctttctcgcaactgactgaagcctgaatagggacttgaaacagaaaaggagttgatctttattaaaattaaactgaacagtcaaataaacagataagaatagtaactcttctacttcccagccctctcatgcttcctagtcccaacttgattggagataaaaggtaatagataaagcagaggagctttggggctagaggacaaaatgtagaaagcacagaagtagtgttagatggtgttcagtgggaaccatgtgtgaaggcacacctatccttggttgctcagtggaacagtgttgaagccaatgttgccatttgcaatatgcaaatgcataatttgttgaacgactgactaagcactgacaacctgtgtgccaaatacaagagaaacatggatggacctcaagagtctactgggagaaacaggtaagtaatcaagcagttacccttgtagctcgtgggtcagtgtatcggatcctgggaaagccagatgaaggacccataacccagacttggggttcagggaagggcttgagacctaaagcatgagcagctgtcaggtgaagggagtggggctcagggtttagctttcactgagtttttgttcttaataaagaagctctgtttccagatgatttattaatctctgtcattgcactccggacattaaaaaatacccaagacatttcttaacttgtcaagatgtgaaatataatgagcataacaaaacaagtcggctcctgatttatttgggcccttgaggcctccagtttggccaaataacctttcacctggctgtgaacactacattttagatttgaagttacataggaaattacacccaccaaagtcaccatatgtgataaaaaatattacaggatctctttgtaaagaagttacaaatcatggttgcttttttgataaatgtttctagtaatgagtggtagtatcttcaatttattcaaggagagttttgttgaatgattttctttgacattcattgaatatccactccctgccagatgatactgagagataaactaatgccacacggtcttgaaagaagtcagtaattttttttttaaatggtgttatcaataagtaataaggcccattccaaggccttacacatactagaaggcttctgatacacactaggccttattgtcatcacttccttctcattctttccacatagcttctttcgtggcaattttcccccaggagggatttccctgcagtggacctcctccccagtggtaccttcagccatcagaacacctcgctttagatctgtgggtcccaaatttcatcaaatccaatgaccatttctatggtaggtactttgctatatacacctttgactacctggaaatgaaataattataactactttctttgtatgtatctattagatttccattggtgtattacattaattttttaaaattttgtgcaaggagattttctttataaatttcagtatgtatagtagaataaaacctcactagattaagatacaatgaagttatggcactttaatatgtttgtagactcaccttgaatgctgcagctacaaatgcagattgaaaattgtgtttttctctaattgtaaccagcttggtaaaattcaaacaaaacaatgtatgatagtccctcaatttatatggcagttgcattcctggaaatttcagtgagtattaaagtcatacacaaattctttccttctttttctttctttctttcctttttttctttcgctctttcttttctttctctctctttcttcctcccttccttctcttctgccttcccttcttccttctttcctttccttttcttcttttcctcctccctccctccttcccttcctccatttctccttccttcccttccttccttccctccttccttccttccttccatccatctttcccttcttcccttctttctttccataaaagaaaacataagccctttgcctgggtaattataaacaggtttctcagcaacatgaatgctcttagagcattacagttcccacacagttattctctgttgtgtggaaccatccctttcagcacaggcagactagcatctctggcccttggctcacaaagactccccataatttccaaaatgccttccagaagacagtgaaaaccatcttccccacacaccttgaaaaccattattctagaacctagatggattttatcttcctttttctcaaaccaggcttgcagctagcagccaaaatagaaacacctgaaactcatttaacacaaatgtctttgactgacaactttatctctttcttccagggataatttacctcttgctagaataagtgcctaatataaggtagaaaattatagaattctaaaatttagcagcaattttgataagaagaattttgcctgcagaaccttccaagtcgcctcttgccatttgttctacctacaaagcacatgtgaggcccagaaggtggtttttcatgcctttaataaccatctgggcagcagcaggaagttactgacttttaggaagatgacatagaccttaagctaaggcacctgggctagctcaaagaaaggcaaactgtaaactgtacttaaatatgtattcattcagggccccaagggaaatagcacactcaagttaggataattcaaggaggtactaataagggggttgtttagaaagctatgggtagggtgaggaaaaccacagcaatagtgcaggactttaagagctattactatccttgagcctcaagggataggggagacaggagttcctgaaacctcttaaaaaaaaaaaaaaagcactcatagctgggcgcggtggctcacgcctgtaatcccaacactttgggagttcgaggcaggcggatgacctgaggtcaggagtttgagaccagcctggccaacatggtgaaactctgcctctactaaaaatacaaaaattagctgggcatggtggtgtgcgcctgtaatcccagctacttgggaggctgaggcaagagaatcgcttgaacccgggaggtggaggttgcagtgagccaagattgcaccactgcacccccacctgggagacaaaagtgaaactctgtcttaaaaaaaaataaaatcactcagggcagagcagctgccttgagaggactcatgtactttatggaaaaatgcagttagtccgaggtgaccctacatgaagggagttggggaactctccttcctccctctgttcactattggagaggagaaagccaatgggaatctagaaggcaaggaagactgttgatgtaggtcacggaggtccacctcctgggcagggaggagggtggagaaagtggagagcaaacctggagggaaagcagctaggtatctgttgtgctggacgttttctaacttcttttatggaacttctggaatggtagcccattgttaattgatagtcttaatcttgccccttaaggtaaacatatttacctacttttaacatgtatggacattacccagttgaatgtattgtgcatagtgtacaattatgtttgacaaatgaaaatggagcaaactgtgcttgagactacaggtcaagaagatgagaagtgtctggtcttggccacagacacaagacgatgaatagaaagtcaccatttgaaaagcattgcaataagaagtaaatgtgctgccgcagtggcgccaaggcctaccaacttcagaagttgatctgctgcaaatgcggccacactgacaagagcaagagaaagtataacttgagtgccagggctgaaagatgaaatgccaccagtactggtcaaatgaagcacttaaaaattgtacactgcggccgggcacagtggctcatgcctgtaatcccagcagtttgggaggctgaggcaggtggatcacctaaggtcaggagtttgagactagcctggccaacatggtaaaacccagtctgtactaaaaatacaaaacaattagctgggtatcgtggcgcgcacctgtaatccctgccactcatggggctgaggcacgagaattgcttgaacctgggaagctgaggttacaatgagccgagattgtgccactgcactccagcctgggcaacagagtgagactctgtctcaaaaaataataatgataattgtacacctcagattcaggatgaattctgtgaaggaacaacacctaaacccaagaaggcagctgttgcagcatccagtttagcttcagaacgtcaacaattagtcatgcaaataaatgttctagttttaaaaaatagaaataatcctggctaacatggtgaaaccccgtctctactaaaaaatacaaaaaattagccaggcgtggtggtgggtgcctgtagtcccagctactcaggaggctgaggcaggagaatggcgtgaacctgggaggcagagcttgcagtgagccaagattgtgccactgccctccagcctgggtgaaagagtgagactccgtctcaaaaaataataataataataactaaataaacaaataaaaataataaaaataaaaaaataaataaaaaacaagatgcaaagtggagttaatagaaaacagttctaggagattactgttaagactcagactatgcactgatgttcagtccttagtaattggtggcaacctggtggagagggaagaccacaggctgtggagttggacctgggtttgaagattggctttgcatgcctagcaggatgtaagcttggcccactgacttcacttctgagccttgttctccatgtctgtcaagtgcaggggaagggttagtgaaatctatcttatatttttatggacactaatgagattgggaatgaaaacgagatgcccataagcatcagtgcatcataggtacttggccagtggttctcaaagtgtggttctcagaccagctgtatcaagattgcctgggaatttataaaggaatggagattctccaggcccagcaatcagcatactaaagcttgagaactgtgttagactttctgggatctaacgaagaaggcaggacagattttgttagatgtattacacaaggggcaggcacctgtgcacaaaaagaccccacaaaaacacagaaaaaaaacacagaagaggtgctttttgttttgctctctgtgtgataagctaatctgataagtgagaagtcctgttctttctataactgggtaggtaagtctaatttggaggtcaagtattgaagctcattgtagccacatgtctaggccacctcctccaatttagcttctatcaataataaagttaatattttgatctatttgtttgattcttgcattgcatctacttttcaatttgttctggtacgggagagaaaaggagttcttttaaaaattatactctgtggctgggcacagtggctcacgcctgtaatcccagcactttgggaggccgaggtgggcggatcatggggtcaggagatcaagaccatcctggctaacacggtgaaaccccgtctccactaaaaatacaaaaaaattaaccaagtgtggtggtgggcacctgtagtcccagctattcgggaggctgaggcaggagaatggcatgaacccgggaggcagagcttgcagtgaaccgagatcgtgccactgcactccagcctgggggacagagcgagactccatctcaaaaaaaaaaaaagaaaaaaaagcaattatatctgtgatagcctccaaaattaccccctaataatcccaattcaggtattcccaccctcccttgtggttccagagttagtttgtgtgaccagtgcaatatgtcattagacattaggtctctctgtctcttatagatcactcattctgggggcagccctctggcatgtaatgagcagtcctatggagaggcccatgtgacagtagccatgcgagtgacactggaagtgaaacctgcagctccagtcaagcctttagaagactgcagccctggctgacagcttgacagcaaactcatgagagactctcagcttgaacaactcagctaaactgttcctgggttcctggtcctcaaaaactgtacgagatgaaaaaaaagtttgtttttttaagctgccaagttttgggataatttgttattctaatatattttttaatacctggaagtaaggtgctaccataataaatacctaaaatgtaggcacagctaggaaactagacagtggaggtagctggaaagaatttaagaagcatagcagtgaaagtctcaggagccttgaacaaaacattagaaaaactttggactttgaccaggctgctggtggaggtttaaaagaaagtgagaaaaatcttgttgaaaacagaacagggaatccttactatggagtggcataaatcttagcaatattgttgtctgcaataatgtgggtggtgggaatgtacctggtaaactgggtgatctaatttgctattcataaagacataaagattctcagcttttacagatggtgaaaaatgctaaattaagaaatggctgaaggacagaggtcaaatcctgggcaccatcatgaaaacataatccaaagatgaagctgagatgtgactataaatcctttgttatgacctcagaaagatcaaaagtggtgcctcagagtaccagtttggtcacacaaaggccctctaaagtttttaaggctgtgactcacagattctttcaaaaacagggctcctgagaagcttaagagcatagtttttcagcagaatcacaaggtgggaaagggattatctcaaaaagatttttgggcgtgacttttgtctaatggaatggacccccaaaaattcataggtgattcacaaattttttaaaagaattatattagtagaaacattgccaactagaactcaaagggatagagacagtatgaaatgaaaaaaggccttggtactcactttgcccctgtttcactgcaggttaagaaaaaatttcagctgcatacatgtactaactttcatgaaaaagaaagaatagctaagcatggtgactcactcctgtaaccccagcactttgggaggacaaggtgggaagaccacttgagcccaggagtttgaatcagcctgggcaacatagcaagactctgtctctttttaaaaaaggatgactctgaaggggaagctaaaagcctcagagaataactcatgcgtagaaataggactaaatcctaaggcgattccaacatttgcctggctggatttcagagctgctatggggacatagtagtgtgtccagtacctttcctttttgaatattaatgcatatagtgtttattcctgttccaccattgtgtgtttggggtgtgtgtgtgtgtgtgtgtgtgtctatgtgtgtgcgtgttagtttcagattgagaggaattatacccaaggagctagagttaagaaattatacctaaggaacctcttgtgtacctggtcctgatttaaatgacaagactctagactttgagttgatgctgtaatgagacaagaattttagaaatgttgagatggagtggacgtgttttgcatgttggagggacttgattcactggagcctagaaggcagactatggtagccagccctcaagattgtctcctcctggtattcatacccttgtataattcccctcccacattgtaccagaatttatctgtgtgacagaatatggcagaagtaatgatatgtcacttctgagattaggttataaaagacattgtggctaccatctctcatcactcactcaaagggaagccaaccaccatgcaatgagaatctcaggtaatgaggacctgagacctgttgtcaatcacgtgaataagcttgggaggagattctccagccccagtcaagcctcagaagacttcagccctaggtgacagcttgatgataatctcgggaggcagaaccacccaactaagccactcctggattcctgaccctgaccctgaccctagaaacagtgtgaggtaataaacgttgttttaagctcttaaatttgggggtaaatttttaggcagccatcaataattaatacacacctctaatgtatttgtacttacaccacataccatgggatctcacaaaagagcaattttaaagcttgcttggatagccgatatctttattttcagaacatattcttcatgcataaagaagcaaagactctttccttcagtataatccttttgatagaagcgaaaacttaagtctggcagttttcctaatatatgtttttcacacttttcctttattttaggcaattctaaatagacaaaatcaacttgagagtgttcttggatttaatttagaaacaaccccagttaagcttttcataaaacttttaaattgggctggcttttattttaggaatatgaatgttcttggaattcttccagatctctaagcaataatcttttacgcaatcccctttattttgttatgaaaaaagagcctaggtagttcttttaaggtttacttttttgtaaaggtatctttaaaacatccagatgcctctagacattcaagatagaacgaggcactcacaacttctatctgcctatgtttcatctatttttctatgctgttgtgtgaattttgacgttttattttgtcaagaatagtggtgaaaaaccaatgaatttttaagtgattgagctctaacatttcctacattctccttccagaaagtaaatacacagtaattatcattcattattaccttctccatctgacaactgcctttcacccctcaaattattgtgcatttcacattcttttttctacctaggactaatttgtccaatcaaccggacatctgtttttcttccccttttttgaaaacaggctgcttctatgttttcagggccttcctttctagaacatgtaagaacttgttctcagactacttgtaagcaagacactctctgaggttacaagtctggaagcactttctgagaacaattaaaagatctgtctgcctgttagggcgttccatgggaatgttacactctttggaagaaagctttgtgtaagcaacagtcacttctacatagacaatacaaatgtcacttcatttattaacattacgtgtctagatgattgactgcccttggaaaaatatatatggaatgaggcaagcttattaaaacctaaataactctgaagatctcttacttggtctgtaaactttctactcttatagctcatgcattttcacaggaaacaaaagcccttaaaggccaaatttccacaacaaaacagtgaatcttttcaggatataatccttcaattctttcctaagtacgtttagataatttttttttctttttttttttgtttttgagatggagtttcactcttgttgcccaggctggagtgcaatggtgcgatcttggctcactgcaacctctgcctcccgggttcaagcaattctcctgcctcagcctcccaagtagctggaattacaggcatgtgccaccacacctgcctaatttttgtatttttagtagagacgggttttcaccatgttggccaggctggttttgaactctggaactcaggtgatctgcccgccttggcctcccaaagtgctgggattacaggggtgagccaccgtgcccagcccttttagataatttttaaatcaggaaatatatgatggtgatgaccacatgtgacaccccagccatgaataagttcttggcctttcttttgactttagcctcattcttccccttattttctttttcctactttcttcacctacttctctgtttctccgtttcccttttctgaatcacgccatgatgccgtaaaggaatctccttgggatctggtgctggatgcagtctagggggtgccctttgtcagaagaggctgagtggaaaggaaagtggccataagcaagctggtcagttcccaggcaaccagggaggaaagacagggtaggaatctgaggagcctcaccagggaagccccaggccgtgggtcccagccttttgccttgagcctcaggagagctcccatgaggagagctagatccaaggctccactttcctttcagtgctgtgtttttaaactctcctcatgtctgattaaatgtatatgggcagctatattggagaggaactaaagggctctaggagtttctcaccaggttccttttgtatctcttttcactagcagaggtgtctgctatgggtaggattccctctggggttccctttgaccaagcttctgcagccagaagcactgaggagggcactggggtgatgggactgaccctgaggccctgatcacaggactcctaagtaggagttcctctgaggagatatgctaggacctggtttatcaaaccagcaatgggatatctggaaaagccgctggggggctgccaggactgcttctcaacatactgtgtgttaacctgcattaacactgcacgaagcaggaacttagagttttctgagcttggctcagtttgtgtgtaacaaccaggctgaggtttcaggggtggctccatttggggtttaacctgcagaccagaggagggaacaatgaaagactagttgtgtttctgtgtttctgtggtctggaagaggaggtgaagagagcgtaggacaaatcactgagtgttcatgtcaaaatatctgcagactgctcagcttggttgctgttgagctccctagttcagcagcagcaggtcgaggaccaacacttatcctcggataataatgactactatttattcagtcctcccatgtgctagatgacatattaggtgctttatgtgtacaaccttagcaatcctttaagagaggtgatattcccatttgtcaaattttagaaagctagttagacagtccagagaagattagtggtttgttcaatgttaggcttccaataagtggccaaaattttaactttggtacacagttatctttgctaagacatcatatgcattcctaaaaaaaaaaaaaaacactcttcagttagcaatatagtatacttaaaataatagggcttatgagaaaaatggggttggtgttagaattaggaagtaaaaaacctgagagtgtaatacaaatagaaatactagcatggctgaatctctgtaaacatttgcctttagcatcacagacagccctttgcagccttatatcctggggctcaggcttcttgtaggtccttggggcattcactgccaatagagaacataggcatcgacattagaattctgatctagggtttcaatacagagggatgtctcttcaaagcatcttcaactgcactcacagcttcaccagatagtttaatataatagaaaacttagtggctggtttaatggcttcaagaatcactacctcattgaaggtcttcactgtatggaatatacaggtttttccctaacgtactcatatatttcttagattttcttcctcccagtaaaaaaatttaccctgatcacctcaaatgatgggttggcaaaaatcgcatattcaccaccacaacttctgcatcatgatcttcagtacccagtttacctgtcacttatgagatactgttgcatgaaaggaaagaaatgctgcttcagatagaaccagactgtttcagagcccatgtgatttcttttgtgttctaaagagtcctcattggccttgagggaagtttagacaggctggagcgttgataactgatagactattttttctccccacgcaaccaccatggcatgatgctactcaacaaaatgtacagtggtttttttcatttcatgtaataccgagactatgttaagattttgtgatagtcaggccgggcgtggtggctcacgcctctaatcccagcactttgggaggctgaggtgggcggatcacgaggtcaggagatcgagaccatcctggcaaacactgtgaaaccccgtctctactaaaaatacaaaaaaattagccgggtgtggtggtggccgcctgtagtcccagctacttgggaggctgaggcaagagaatggcatgaacccggggggcagagcttgcagggagcagagatagcgccactgcactccagtctgggcaacagagcgagactccatctcaaaaaaaaaaaaaaagattttgtgatagtctcaaatgctttttacagctggtttgttcaaattaggatccaaatatggcctaaatattacatttgattattatatctgctatgtattttattctatacccttctgctgttttttaatacagttgatttgttggagaagtccattcttcataccacagagtattccatatttgaatttggctgattgctttctcatgatggttttaaaaagtagttcctttattcctcatatttcctataaacttattgttagatctcgaaacatgttcaatttggtatgaatactttgtaagtggagctttatagttcctatggcattgtatcttgaaatacaatgtcaaggcctatctaatttgagtgatgctaaaattgatcagtgtattaggaagtggcagctggatccctcctttacaatatttatcaaccattgattatcctagatccatagtatctcactaaaattgaaagatagtgattttctaagcctatcatttcttctgcatttgttagctggaattctgtgaagcacatgacctcaagtctttggataaatggaaacgcagcttatgccggaaaggtaaaatcttgattcttttcttttattaattttgagagtaggccaggaacagtggctcccacctgtaatcccagcactttgggaggccaaggcaggtggatcacttgaggtcaggagtttgagaccagcctggccaacatggtgaaaccccatctctactaaaaacacaaaattagctgggtgtggtggcgtgcacctgtaatcccagctactcaggaggctgaggcaggagaatcgcttgaacccaggaggcagaggttgcagtgagctgagatcacactactgcacgctaacctgtgcaacagagggagacttcatctcaaaacaaacacaaaaaaaattgagagtagagttggtgccctagccaactcagatggtgaccaatgcgttgatccctgagtattgttgtgaactactgaatgtttatatatttatgtttcaagcagtgatattgttccttttggcttgaattgtcacaactttgccagcagaagccttttcagtttaggtcctgtgtacttttgacatgacctctttaaagtttgattatttccctgctttctggcagaaaattatgtcttactcattttgtaaatgtcctgatgtggacctaaaatcaactatttctcaaaaggaatttcttttagtggagaatgatatttaaaaatcacaattcaggcactaaaggggattttactcttgaacaagagctgattgcaatcacgtaggtttttcttggtgccatttcaattttctagctgtgcactaatagttataaatgtttttcctgcaaattctttgagagaaaatatcattattgcaaatataaaacttggtattcttgactccatttttccttaggaaaaatttttttctgcttctttgataacataaatattctttagaaataaaactatttagtttagccaaatgagtagagaagtgaacgggtagaagtactagggaactaccctagatatttcaaaatgctcaactacaaggttttggactcagaagctatgcttcaaaatttgtttctgttttcaagtattaacaaatttaaaagcataaacatttgttcattttttggtaggaaccttaatgttttccattttgtagattattttaggtatatggatattaactattttgtttctatccttggttcagaaatctgttcattttatttgtggctgtcatttgcaattctttaaattaacacatgaaaagagatccaattccaactttattagtagacaaatgatatgcaaattaaaacaagaatatttttattacaacaaattagcaaagacctaaaaaattatactccattccaggaagttttaaatgacagtctcacttttttatgcatgccctgctatcaagtttctgggttttgggtttttttctactcgatatgtctcccattttctcccttcctcaattacagtatcagggtccccctcaccatgccctctattctgacctgccagggttgaacagacacaaagatgcccagcataaaattcaggagcccatgaattattctctgtaaagggccagatagtaaatatttcaacctgtgagagctaagcagcaaaatcaagatattatgtaagtgctaagagtacagtagctcacgcctataatcccagcattttgggaggctgaggcaggaggatttcttgagctcaggagtttgagtctagcctgagcaacacagtgaaacaccatctctctcactcttaaaaaaaaaaaatggtagcttgcacctatagtaccagctactcaggaggctgaggcaggagggtcacttcagcccaggaggttaaggctgcagtgagccatgatcatgctcttgtattccagcctggacaacaaagtaagactgtatctcaaaaaataaataaaaaataaatataaaatgtcaccattaaagatgtaaaaatctacttttaggttggggagctataccaaaataggcagcaggctatatacagttaccaacccccggcttagatactcctcagaaaggacttattgctcagctgagaggaggagtattatctaacagcccccagcaatgagtttcatcacggtccactcctcaacccaccctgcccctcctctaaacccattccacctctcccagtcaatgacggagagaggcctggtctcctgccgacagccagcaaggaaaagcaacctgagtcctatagctgtaaggaacgacattctgccaacaaccagaatgaactagaaagtggattcttccccagagtctcaaaataagagtccagctcacaccttgacttgggctttctaaacagagaaccagccaaattaacccagatttctgaagtatagacctatgagatagtaaatgggagttatttttagctgcaaagtttgcagtaatttgttatatagtaatagaaaattaataaactgagaattgtagtttgcagaggatagcccctgtaacatggaacagacaggggaaagacaatgaatggatctgggagcaaataagccaatggccagacagaccttatcacaactttgttttgtacatcctttagcctagatgtttttggcatgtatggctcactctacgttgtctcaatgagtaaagagatttatttgtgatgatgactgggatgttagggatttcggctaattattgttagttttattggagaaagactttgttaattggtgaatggctatgtgagccttttctttctgtctgattctctcccctctgctgtggtgtttgcaattgaggaacagctactaagaggtggcagctgcagagaaaagtccagagccatacagatgaggctgggaactctgactagcactgagtatttgaaagagagcttggcgaaagtctgttactacatgtagcagatacctgtgactgcatatagggagtgaaggagacagccaaaagtgcacttgaggataacaaatggccagcccctacatgatcactcatgaaaatccaacagaacccagaagtctcacttagctttaaaaaatccattatttttttcagacagaagcacttagggaagcaaaatggcttatttcagcatgagaaagcaatgtaacagtacagctaagctttgagggtctcctgatcaaaaatttgtgagactaatagcttacacaggaaagagatgatagcccttttgaatgccttctgagcgctcttacgagatgcgcaatctaattgtggtgtaaataccagctattgatggtgggttttgttcatcgggtttgtgctaccacagtaccagaggtctgtatctattagtgctagtaatgtatggatgaccagggctggtgcagacatctctgcagcaataataaaaggtaagaagatgcagacaaagctgaatttattgtgtttgagaagatatagaattcaatttccctgataaccaagcttaattgcacagaattatgagagctcattaatgaaacccaatatagacagtttatattagtaatggcattacattgattatctaatttcagagtaaggaattaaagggggccaaattagggattattctgcttttacgtaacacctgtagtcaggaaaaataaatagctcccgttattaaactaaagcttttgtatacaaaagaatgctagataataaatgtagaaataatgatggaaatagaaaatatttttgcaagacattatgaaataatcaatccaaacaaggatcaataatgaatgctaaaactgttagttgaacagtcaacagagaaccagatattcaaaaagcaccaaagtatcacccttaaaataacaagtaatttgctattacttgtttatagcaaacggaggaaaaagtaccctttaccatggagaaatatggctattatcactaggtaacttactatctgattgtcccactattaatgatgctgtgtgacttctgaggtaatgctttataaattatatgacagcacctgtcaataatatttaagagataatgtttaagatggaaatggaatctaaaggctggattagattcaagttaaaggaaattcaaagcagagaagaacaaattaaggtacacttgaacacattcagaatatgggacagaataagacagctgttctggtctcaaaaaaaaaagttaatgacaaggaaaaaaggaagaggagctaggttaagggactaaacaggcaaaaccaattcaacatgggattcttgagtggattttggtttttaaaaaagctttaaaaacactttgggttaatggtgaattttgaatatggaatattcaaatatcaggcagggtcctcgcaggaaaccgatggcaaactcaaaagaacttaatcatgaatcagttaaagaagggactattgagggatgtaggcagagctaatggaatcaatagggggtgctgaggcacccagggcgcagcagggaagctgtcaccaactgctgttagacccaaaggagcaggcatgggggcagttatgagtgtctagtcacagctggagctgctgaacagagtacagcttcacaagggatacagtggcagatgcagccagtaccggacaaggaactcagcagggaggagcagagagagtatcccagccactctcccaccctctgatctcttgccagggctcaccattggcctctgatgccttgtaggtgcctccagttggctgaccccagttggagtcctggccacccatggcagtctgtagaaataagccttttggagctgagagcaaaacagaaaaaagtggagaatgcatctggaggtagaaggcaaagggagaataaagcacgacaagtacagagtagattagagaattactgttgattgttagatgtaattgtcttgtgagatcagagaatgctcagtttttttgttttttttttagatgtacattgaactattaaggaataaaatgtcataatgcctcattcattctgaactgattcagcaagagagacagatagataagtaggtagatagactagatatacaaagcacatatagacacaagcttttttcttatttattgctaccaacttcatgcatccagcctccaatcgtgtcatgcctaaagaaacaatccctgcccccgtttcttagacccagtacctggcacatgataaacgataaaaaataagttcttacccatgcatccctttttcagtgggaattatacttcttggctgccccctacacacttctattataaagaaatttatattgttatattttttcaccacaagaaaaattatcaggtttaaagagggggattaactaatgataaaggtgtaaacagtgcaagaagacttaattattcttagcgtgtgtgtggctaacaacagagcactaaaatgagtgaggcagaaacagataaaagtgcaaggagaaatagataaatccagtatcatagctggagaatccaacacaccttaataagaaatggacagatccagcaggcaggaaatcagtgaggacatagctgaactcagtagcagtaccaatcaactagatatgattgatatcggtagactgtttcaccttacacattcttctcaagctcacatggaacattcaccataatacaccacattctaggccataaaatgcaccttaacagtttaaaagactagaaatcacacatctgctttcagaccacattgtaattaaactagaaatcaataacagaaagatagaggcctcagctcctgctgatgaaaaaataataactgaaggatagctagaaaatcccaaatacttggagattaagaaacactcttctaaataatatatggataagaaaaaaatctcaagagaacttaaaaaatgtttcaaactaaatgaaaatgataatacaactcattaaaatttgcataatgcagcaaaaacagtacttggaaggaaatctatagcattgaatacataaactagaaaggaagaaagatctacaataatctaaacttctattttagaaaacttaaaaataagagcaaaccaaatgccaaataaggagaagaaaagacaatgaagaattagagcagaaatcagtgaaatggaaaataggaaattaatagacaaaatcaaaagttagttctttaaaaagaatattaaaattggttactctctaggccaagaaaaaaagagaagacacaaattagagttgtcccatgatatccctggggaattgttccaggacccaacatggataccaaaatttatggatgctcaaatctcttacataaaatggcacagtatttacatatagcctacacacatcttctctcatgctttaaatcatctctagattacttttaatacctcacacaatgtaaatgctatgtaaataattgttacaatgtactgttttaaaatctgtattattttattctatttttatttttgcttttcaaaaaatacttttgatccatggctggttgattttatgaatggggaacccatgaagatggaaggctggctgtactaatatcagaaatggaagaggagagacatcactagagatcccatggatattgaaaggataataaaggagtattatgagcattgttatattttatgtctcctataagctgtaaattcctacatagcaagaattctgtcttactcatcctttaacaactactgtgtaccttataatgtttcataaaatattatgatttggttttattattcacaaaagaatgctataagaggtgaaaaatggagaggctagaaagcataaaaacaagttacatcaggtggtagagcctggtttaagggtcaaagataaaagaagggaaggttaagggcagggctttagagggagagaggataaacacagtttgattaaatggctgattcagccgggtgtggcggctcatgcgtataatcccaacactttgaaaggctgaggcaggaggattgcttgagcctaggagttcaagaccagcctgggcaacatggagaaatcctatctctaccaaaatacaaatacaaaaacaaaaattagccaggtgtggttatatacacctgtagtcccagctgcttgggaggcagaggtgggaggattggttaggtctaggaagttgaggctgcagtgacctatgattgctccactgcactctagccttggtgacacagagagatcctgtctcaaaacaaaaacaaacaacaacaacaaaaaacatatatatatatatatgaggtttatccacagtaaagttcagtctagggttaataaaagattctagggttcactaagacaaagagtagtcgcagtagcagagccttgggtgaagctaaggtccccaggagatctgggatgtctgtgaggaacagtgaggcttagtcattcagacaagccagcagaagtgaagtttagagaatgtggatgggcctcaggctctagacatcaaaacaaacagatagaaaaggcagagtgtagaatccagacagtgaggctcacaacaaggtatgcaattctgcataagcagatttgaggggacaccaactatggactgatgtagataaatatttctggtaattccagttagtgattcactctgaactcacataggatagtatctcttcaaaggcacttgtgttgtaattaaatgcacacataagacataatgcttattgagcccttagcatgtaccacccactcttatgcatactatatgtttaaaccatttaaactcacaccaaccccctgggggtaggtagtattattatccctgttacagataaggaaagtgagaagtaggagttaattggtctcatgatcccctacaggctggccttccagaaaaaggaggtaacttgccccaggataccctggaaaccaatcagaatgaattgccttaaactctggcttgtagcccaaagcaaggcttgcccacaagtcttgccagtatgtggttgaacagaaattagaatccagacagcctgagtccttttcttgccaggcaggggctggggcttccccaaccatgaaagttcaggtggtagatcctgccactgctttgcacaccagctccctggtgctaacctcaactgccagtgctgagctggaaggatagggctggaggcaaactcctaccccatcatgttgctggtgtattccatcctggtattggtcacaccaaggaagggcctggactttcctaatcatgcagcttaaaagcaacacaaggcaaggcggggagtccgctctcctgaagtctgacatccaggaagaccagattgctatgtgctgtctttgacttacttggagactcacacacctacactagtgcccccttatctgagggggatgcattccaagacccccagtggatgcttgaaaccataaataataccaaaccctacatatactatgttttttcatatatatacctatgataaaatttaatttatataatagattaggcagagactaataacaataactaataataaaatagaagaattataacaacatactataataaaagttaacgtgaacattgtttgtctcaaaatatcttattgtatgtaatatttttggactgtggttgttcatagcaagtgaaaactcagatgggggagggtggcatactgtatttattttcctgtatccattagtgtttcccagtgaacactgcaccaggaggttggccatttgtctttatttatacatcaaactaaggcatggagaataagagcttggtaaggtcatatagccaggaggtggttgaactgagattcaaactgagacagtctgagtccaaattctaccacctcttgtgtgtgacatttaatggataggtgggcttttgtaaccagtgtctctgcctttctccatgattcacagcacagaaacttgtgcatacattctcacttgatatctgaatgactgtaacagtgatgtaaattaacaaggaagggagatagccctgatttaattggaaatcactgacagagctcgcccagtaaactctctacaaacagaatacaaatgttttgtatttaattgctaaagtgttttaaaattgaactcaaattaataaatacttattgtatctgtcagttaaacgaaacaaccaataaacaaccaactctgttttctaatcaagagggactgatcctttaaaaaaaatagggtttaaaaaagatgatatgatcaatgtaaaattggattatagacttttagagtcttaaaagatgagaaaagagataaagatgaatagatatggagtaactaggataagactctctcacaaactggaccttaaacagatttaggaagaaatataggattaggatagagaaaaagaagagaaagaattgcctataggcataataaaaagcacaagtgtatcaatcaacacagggtattgtggaccagtgaggaaggatcatgatctagactaggggattcatgttggaaacagtgagacaagttagaaaggataggatgggacatattatatggttccaaacataataaatgagcacttgagctagaaagtagtataatgttcacaggtggtaaagaggtataatgaaaaaactatacttcacaaaaattagtggtgttcagtgggttggagagaagaccaattagaaggttatctgtggaattacaacaacccagtgaattgagctgatggagagagatgctcctcccactaccaacactcaaacataaggcaaaaatatttataggtgatgagtaatgatgaaaaaacaaaagaacaaatgatagatgacatgaagaatgggagtagggaagaccatatttaagactctgaggtcattaaatgatgtaacatgtttactagcccaaaaatatatactaaaagagtagaaagaaaacaaaaaatttccaaatcagtagcaaggatcaagaaaacaatccaaatggaaggaaagaacaatgtcccttggaacataacaatagaacataatatgaacagtacctccttctatgtagtgtagatattaaacatagggtgggaagtacacatatcaatttcaaaatagtggtttaatctgaaattgttaaacagagagggagggaagcaatagaactgagagagcgttcaaaagccttttgttgtatctgtagagtcttttatttcttaaaaatacaatcgtataccacatgataacattttggccaatggactacacatatgacatggtcccataagattatagtactgtctttttactgtaccttttctatgtttagatatatttacatatacaaataccactgttaaattgcctacagtattcagcacagtaacatgctgtgcaggattgtagcctaggagcaatgggctacaccatgtggcctaggtgtgtcgtaggctctactattttggtttgtataagtacactctatgatgttcacacaatgatgaaatcacctaacgatgcatttctcagaataagtttctgttgttaagcaacccatgattgtatctgaagcaaatatctatatctccttattaaaccttagggtaagtacataaattagagaataagtatattattctctaatttgctattgtattatatataatatatgtatatgtatactatgtatatattatacatagtatacatgtataatatacatatatagtatatgtatattatataatatacatataatatatataatatataaaaatatataatatatataatatatataatatataaaaatatataatatatataatatatataatatacaatatatataatatatataatatacaatatatataatatatataatatacaatatatataatatataatatatattatatatataatgttaatatataatatatataattatatatatataatgtatacatatgttatatacatatataatgcaatagaaaattagagaataatatacatttgtgtacttagcctaaggtttaataaggaaatatagatatattatactatattatatatgtagtataatatttgaaaagctattaaagtaattgaagcctgaggtgaaggctctagtttaatgttgcacaagagggagtcctccaacatgactttctgcacctccatccctggcagaaatcccctaaataatatccatggagctggtgtggcaactagatatgaggttacacattcaccaagtctcaaagatgtgtaccttcttactgttactaacagtttaagattcaacagtcaagctctgtaccaaaaaagacaaggtccaggggatttattctgtaatctgtttatagtgccctctagtggcagctctgcagagatctaacgcagaactcactttttttgtgttgaatattaactttgtatctatttttcaatgtattaacataaattggattttgtttttgttactaagcaatatgagtaattcttaactttaaaattgtattattcattcattacctacagagagaagatcatgctgtttttttttgtttgtttgttttgtttttttaattgatcattcttgggtgtttctcgcagagggggatttggcagggtcataggacaatagtggagggaaggtcagcagataaacaagtgaacaaaggtctctggttttcctaggccgaggtccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacatggcacgtgtttcagagagcaccgggttgggggtaaggtcatagatcaacagcatcctaaggcagtagaagttttcttagtatagaacgaaatggagtctcctatgtctacttctttctacacagacacagcaacagtctgatttctctatcttttccccacatttcccccttttctattcgacaaaaccgccattgtcatcatggcccgttctcaatgagctgttgggtacacctcccagacggggtggtggcctggcagaggggctcctcacttcccagaaggggcggccgccgggcagaggggctcctcacttctcagacggggcggctgccgggcggaggggctcctcacttctcagacggggcggccgggcacagacgctcctcacctcccagacggggtcgcggccgggcagaggcgctcctcacatcccagacggggtggtggggcagaggcgctccccacatctcagacgatgggcggccgggcagagacgctcctcacttcctagacgggatggcggccgggaagaggcgctcctcacttcccagactgggcagccgggcagaggggctcctcacatcccagacgatgggcggccaggcagagacgctcctcacttcccagacggggtggcggccaggcagaggctgcaatctcggcactttgggaggccaaggcaggcggctgggaggtggaggttgtagcgagccgagatcacgccactgcactccagcctgggcaacattgagcactgagtgaacgagactccgtctgcaatcccggcaccttgggaggccgaggctggcagatcactcttggttaggagctggagaccagcccggccaacacagcgaaaccccgtctccaccaaaaaaatacgaaaaccagtcaggcgtggcggcgcgcgcctgcaatcggaggcactcagcaggctgaggcaggagaatcaggcagggaggctgcagtgagcagagatggcagcagtacagtccagcttccgctgggcatcagagggagaccgtggagagggagagggagagggagggagggagggggagggagagggggagggggagggggagagcaagaaccgatcatgctgttttctttaggtgggttaaatcttgcacatttgcataggtaaaatgttaccaatgtaacactttagaaattctgtgcttcatgaaaagtccccggagatttgccgatgcctttatttttaatatatttgaacctcaaggaaaacactgaaataatatgaaataattctgatgaggtttcctatacttatcagttgtagttgtctgatgatgtcagtcaaaaaccctatagggtaatcagtcatcattttattatatgaaacttggccacaaaattacttatttaatttgaaactagcagcttcttggccagtggtttttaactggggatgcatgttagacttagctgtgaagttttactaaaatgtagatatttaggactcactctagacttgctgaatctctaattgatattcttgaaatattcatattggtatagtcttaacatactcttggtatattttgtctcaagattattacatgtaaaaattattttcattctttttaatcaattgtaacacatactgacatggaaaactggctaatcatagtccttgtagacattgaaaattggctagttgtccctatagacattttgtctaaaacttttattttgcatgccacagaaataaccaaactttcttgtcagttgcattattcttgctatgaacgctcatcaggcctttcactttgaaaataatcagtaatcaacttaccacgttgttttaagactttatcatctacagatggggtgtgttttcctctaatgctttcctgaagactcggcaatcagctaccctccagagttgctgccttcaaataatgactacctcagaaactgatggaaaagaactgtaccatgtacttttaaactattgacacttctaaaaatagactctttcatataggcttctgtgcttagcaacttttagtctgtccctgaggattgagtcaggattttcagaactctaatggagaagcagaaggcttcataaaactgctaacccaagctaccgcagaacaagaattaattacataggaatgaatgaatgaatagagggatgattgaagttatgtgtttggaatattgttgatattgttttaatgctgtattttctggatatataaggaaattctttcttaagctatctgtaaccccataactccttatccatttgcttttgtaaacagtaataaaatatttttaaataatatatttttctcactgaccctttccacctaccgcttgaattcacaaactattatcaagtattcttacttttcatggcaatatacttattagcaaatattcaataagaaactgttctttgtttaccagaccataattggaaaaattggttatgtaattaaggccttgcctggaatgtcatatttgggaaagatgttcatttaatcaggtacgatcagacaattttgaggaactaaagaaccaacactaggaaaattctcccagggaagctgatgtggtacctggcttgtaggctgtctacaggtaagtaaggaagatcaacgctgggaaggacaggaagggtagggtattttagggaactcaaggacagaggaatttgctgattatagatgctactggtaaaatcaggtagagagaaattcttcagcttggctaagaaccaaagccttgaaatagcaaataataaaggcttttaaaagtccatctgagatccctatggtaacttccagaaaagtaaacttaagaagacccatatcataaagtaatattcttgttgcttctatgtaaaaaatcaggcaaacttacatggtttttcttatagtttagatgtcatctatgtttgccgggcgttaacattctgattaagatttatggtaaaaaaatgctattaatatggtttctatttcttctttataaatgatttatcgtaaaattccttagttcattatttaatatgaatgagaaggaaagaagaatgcactcattccattttcacaccctttagggagagacagcgtatataaggtggaagggaattagagatggtggaggggaatattgagtctaggaaattaaagaaagaaaatgacaggttaaggttggatttcagaaatatcaacacacttggcagacattctgagaaaacaatattgttgccccaaagaagtgtttactcataataatgatttgaggtaaattacattttcacctacacaaattatctatgatccatttcttattccttctagcatttttttctcaaattcaaaaaaggaggattggagaaaaaaaataagttttgaatttgttcactgtacctcacagctcacttctggccatatcacagtcttaagcattttcatctgcttttttgtgagtcccctttacttaactcatcacaactggttttaattacttggttaatggaccatattgcatcctagactataaggtaataaatatattttgttcaagacaaaaaaatgaaatgacattcaaatgtatctaaaatggaagtaactagttctagatggcatttgctccagtaggttttgcttttcctgattcactgtttgcacctccacgtccccacccaccccatgtaagagtaggggactatgcctagaagtaccgtgatagtgcagttggcacacacgtttcatgggaacttctggaaataaaatgggtggcaggggtggaatatgagtttaaaatacacactcagaactgattatttcaaaccacctcttaccatctgaaaattggttttgtgtgtgtattttaaacatacattcccccttattttatttctagaagttttcacgaaatgcctgtgccaaccgcctggcattttcctccattttcatggcacttccaggcatagtcctttaatctttttttttttttttttttttagatggagtcttgctctgtcacccaggctggagtgcagtggcatgaccttggctcactgcaaccttcacctcccgggttcaagccattctccaacctcagcctcctgagtagctgggattacaggtgcccaccaccacaccccgctaatttttgtattttaagtagagacgagattttgccatgttagccagactggtctcaaactcctgacctcaagtgacccacccgccttggcctcccaaaatgctgggattacaggtatgagccagtgcacctggctgagttctctaatcttatatggagtagttggagattgggggtaaatagccacttcacagtgtagcccagtggttaggagcatggactgtagggcttcactgttcccatccctgcacgtttcctccctgcaagcaagctatttaaactttctgtgcctccattttctattctggaaaaggtcgtcgtaaagcctaagagcagcaaatgaagagtttcatatatggccagcaacacattaagcacttagaagctagctactgttattattactacaaaattatttttagccactcggaagacatcattctcttacagagttccaactgaagtgtaaaagaaataggaagccataatacaagacataataagaaacggcaaggtggtaagcttcagatttggaggtcagctatatttcctgtcttcttggtagaaattagcattaagttttagaaaaatcagcttttgtttacagaaattgcaggataacaagtgattgggctgcttacctttaacccttcagtgttggaggatgctcatgtctagaagttacagctgggatatctgacactgttaatgagcttctcttcctgagaatcctaggaagcctggtgccttctgagagccccagcaaaggggcttccccttatgtcatgtttctctttttggcctccactcacttcagataccactagaaaggatttaatgggctattagtatctatttcttttccaccatgcttttcttcccaggtattttctatccatgcccatgtattggatgggctaacacaaagcctcccctttcttataagctgctatgtatcgccagcctctggtgctcccttgcccagagagaagcaaaaaccagtcagcgtttgagagaattgcctgcagctgacttctaggctgggcactgtcaaccttagttactactttctttccaagaagcataagcagatatctttttctaatgttgtggattttaaaaatatgtagcatgttaatcttttgaagctttgaaaattaaattgtgtttttcctgctcacttttcccataggccacttctcttggtttatatgataggaagggaattgataagagaatcctgagttgctgtcactgtatatgagtttatcatctccttcacagtgggcacttggctcatcagccacagaatatccaatgttctgaatcaacagcctgcagcaggatggcatcaacagaaaaatcaggctgacatgcccacaaaaaaaccaccctttctccaaaaactattggaaacagcctctttgagtcctcaaaagcaaaaaatattggggaccagacacggtggttcacgtctgtaataccagcactttgggagtccaaggtgggtggatcacttgaggtcaggagttcgagaccagcctggccaacatggtgaaaccccgtctatactaaaaatacaaaaattagctggacatggtggaacacacctgtaatcccagctactcaggaagctgaggcaggggaatgggagaatggcttgaacccgagaggtagaggttgcagcaagctgaggtcatgccactgcactccagcctggccaacagagctagactccatctcaaaaaaaaaaaaaagaaaagaaagaaaaaaaaagaaaaaattgacttttctttccattgagaagaaattgtttttgaaccatgtgggcaggggtataattcctccactgtgcttcactatgcttctggttgtgttattgctggtcccatagcttcaaattatataggtgatttgcatgaagaaagggaaagaagaaatttctctggaggggaaagacggtggtaagaccactaccttcttcatttcccttttttctggctcaacctcagaaactaggtctgatttctggatttaggggtgttaggcagtggttgaaagagctgttgagactctggggtacaaagcagtgccttctccagttttatagggccaaatgtcacctctgagcagctggagagatgttttctctatttctgtggtatgccatgtatatagtgtttggggagaaataaggccagaagtcacatggccccttcagcatgtggagggatttgcagctgtggaacccaggagtgctcaggaagtgggggcagcctcgctgaagagctaggagcagcagacatcagcaggaagagcagaggataacatcaagaggaatcgtgcctgacaccaccctgcatgtccagggttatttctgggaaagccaaagcctaaggggtattgggtttgctcaagactcaagtcacctatgggtaggtggtggccaataatccggcaaagtggggctaaagacaaactagacagcttgggcatgaggtttgaaaataggaggtctgggatgtttgggttacagtcaaaaaactaacatggctttagcaacttcactgaaccaagtcataaaatttgtttctctttcgtggctccaatactttggtgctcttagtactctccaaatatagatcagagatgcaggagaaatcaacttttagcaagctgaatgaatgatcttctagtgattaactcttctctaagttttaagtgaaaagcagcaggcgtcatggtgagtgtgagtatcctgtgttgaactggatcattcgtgtaggtttggggagctctagtgagcattatggtacctttcttcctggaacaccaagttttaggcagtagctacaagtacagcgattagttacagaaagcagttattagcacacttgctctattttactaccacttaaaagcaattaagatggagaaaatataagccagacttctcattagaggtttagagaatatgttaaacaaaactttacctttcttccaaaaccagggaattgttcctattatcagatagaagtgaagtttctatgcaaagaaagctgagatacttagtccattgttctaaagagcattttttcttttagtggtccaagaaatgtcactagtttccccaaaaaggtcctctggttaaatactggtaaccaatgagttaagtaatgttaaaccggtttgattactgactttttgaagactttaatatgcccacatatgtggtctgattccatgatagaggaatgtgaatacgcacctcatggacaaatacattcaggacgctgccagtacattttgtagaaggctggtgctctagaatgtaatttcaaaaatgccaggtcggacgctgtggctcactcctataatcccagcactttgggaggcccaggcgggtggatcgcctgaggtcaggggttcaagaccagcccggccaacatggggaaaccatgtgtctactaaaaatacaaaaattagctgggcatgatgtcaggcacctgtaatctcagctactgggaggctgaggcaggaggatcacttgaacctgggagatggaggttgcattgagccgagatcacaccattgcactccagtctgggtgacaagagtgagacttcatctcaaaaaaaaaaaaaaaaagtcatatgtgatagacattgagaagcaccacctaggtcccctttcaaggaggacttgctgtccacctgcaggcagtgtgacagcagactgtttcagctgtctgcttcttcacactctgccaccactgcaaagagcaccttgcccttccatgagcagtccatctggcggctgagcgaggtgggtataaaggacctgccctcttatccacccacaacagtaaatacttgctccagagctccccaggggagtggctaagacttgtcaggcccacatcacttctctctctgcccaatctttctttctccctttcctttcacagttgtttatccccaatcaacaagttggacctcagactttgtctcagtatctgctttcataaaacccaacctgagccagtactgagattaaaatatgtaggattactcttttctatgagtgaggattcctacatgtcaattttacttatttaacatttgttcatttcaatgacataaccaagcatttgttacctaggctggttataaatggaatacttcctataatgaattgttcatttactgttatctaatacaattaattaatgtttctattttaatatatttcaagttctaatattgcaatgtctaatgtacaaaaatttgttgaactcagagtggttgaaatactccacatttgtaaaagtatatactacagtaaaattagtactactaactgaataaaacaaatacaatctaatggaaagtatgtcagttgattgaccaacaatcccactggttgaactaaaagaggtttcctttgaagaagttcagagtcttagaaatatttaaggatgtgaagaaaatttctagacattttcagaacatttgattccattaaatgttgatggcccatatacttctaatccttcatgctactaatagacatagccataaaaagagaaaaagaaaataatcaatttgattagtatttagattataaatgaaacaaaaaggaggagaaaatgagttgataggagagaagttgtaaaagaaatatatccataggtgagacaactctaactcaagcaggtaaaagacagagccaaaaaaaaaaaaaaaaggacaatgaaaacatgcaagtttcccctgtttaggaaataaggaggtgatagcagagaggcagggggccaagccatgctccaagggacccaagtaacagagtcaagggtcccaggagtaggtgagagggaaaagctacatgtaaggagccactaataggcatgggaagtttgtgtgtgtttaattcaaacatttctaataaaagccagttaaaatatccaccaatgttcccactcttcaatcaagtgggagcagacatcaaatattcattgagttggtgtaaaaaccattgggtcttttaataacattaaggtgctaaagagaaatagcatggaaattaccattttgttgattttattattccataagttcttttaatcacattcctttttttatagtttatatttattgcattcttcctatgtgtctacacatgggttagctcatttaatcaagtcgtcaaggaacttgatatcagagctgctctctccttcatcaaatctaggcctttccctaaaagatttgatgtctttagcctagaaagaaagacacgttatgatgttacagtcaagtccacaaatatatggactgaaatacagagaatctgagcccctgggtagaacatgttatcagcgttggaatggatgggtgacacagccaccttcttcttggctggaagagtctggtcttgctcccaaaatgacagctgttctgtttctgcattatttatttaacttgacaatacttaaagcaaacctgatttttaaggccagttccttctgagcagtttaatctgaaaacatgatttccttaaataggatctcattttgtctgctgatttgcattgactgaggtgctttgttagtttctgctttccatgtggctggaatgacagtgctggctgtcattcctctttgaccacttaaaagtaattttatggaatttacctactatgcctctttaatcttcttcaggcacagatgagtagaaactatttagtgtgatcagagaaatggaggaatcattctttccaatattatatcaataatgactttaaaaaatatttttattacaacacatttggtgggtagatagaaggaaaggagtaatgatggtatgaaacaaacaaacaaacaaaaacccagactgctgtagttatcaattgctatgtaacaaattacttcaacaattagcagtttaaagtaataaacttttattatcccagtttctgtgggtcagaaatttaatagtggcttagcccagtggttctgtctcaggttctcatgaggttgcagttaggatgccaccaggggactttgagacctcatgtctacaaaaaaaaaaaaaaaaaaaatgatcaagtgtggtagtgcatgcctgtagtcccagctacttgggaggctgaggcaggaggatcgcctcagcccaggaggctgaggttgtagtgcactgtgatagtgccactgcactccagcctgagtgacagagtgagagacaaaacaaaacaaaacaaacaaaaagatgtcaccagagctacagtcattgaagacttgactgggactggaggatccctttccaaaatagttcatccatatggttgttggaaggaggcttcagttcctacctatgtgggtctctccatgggatgctggagtgttgttatgacacaatgtctggtgtcccccatcatgagtgacataagagagagcaaggaggaatgcacagtgtctcttacggaagcctcaggagtcactgatcatcatttctatgacatcttgctggttatatgggtcaaccttactcagtttgagaggggactacacaagggcatgaataccaggaggtgggcatgactgggctaccaaagaatgtcctctggtcccccagtgattcacctccttaccacatacaaaatactctcacctcccctcatgaccccaaaagtctaatccctttacaatacctgctgaacatccaaaatcttgctatataaatcaagcacaagactccttggatgagatttcttaagagcagttctttaagtttagctccttgaataccattctccttcatctgaagacctgccaattaaagaaacaagtaacctaccctcatcacacacaacatgcaatgggaggaaaaatataggatgtctatagttgtagacaatcctgttcaaagtcacccagtccaggctgggcacagtggctcacacctgtaatcccagcactttgggaggccaaggcaggaggattgcttgagcccaggagtttgtaaccaacctgggaacatagggagatttcatctctgcaaaaatttaaaaaattagctgagtgtagtggcatctgcctgtggtcctagctactcaagaggctgaggtggaagggatcacttgagcctgggaggtcaaggctgcagtgagctgtgattgtgccactgcactccagcctgggcaaaagagcaagaccctgtctcaacacacgcacacacacacacacacacacacacacacacacacaccaaaaaacaaaatcacccaatccatgctacctccaccttactgaaggggacggtgttgctaaattttctaccactatataacaaggatcctctttcctttcatttttttgtttttgtttatttgtttgttttggctttggctttggaatgaggaaatgaatggaagctggaaagactttgaggagagtgttagtgaaagcataacatgttgaacaaactgatagtagaagcctgatagacattcactaggctgccagtgtgggattaaagggaggtaaggaaattgccatcaaaaccacaggaggccgggcagtggcttacactcttaatcccagcactttagaaggctgaagcgggaggattgtttgaggccacatttgaggttttgttaggatagtgcctcacattcaggtacccgatatctgtgttagttatctcttgctgcatagcagatcattccaaaacttagctgcttaaaacaatgctaaatactacctcacacaatttctgtgaaacagacattgaatagtggcttaggtggataattctggcttggggtctttcttgaagttacagtcaaggtgttgtccagggcaacagtcatctgagggcttgactggggctgaaagatcccctttcaagacagtttgcttacattatgcttattgtcagcaggaaacctcagttcctcctcatgtgggcctctccacaggctgctcgagtaccctcacaagatggtggctgccttgcctcagaggaagagactgaagaaaataaggtaaaaaaacttccatgtctcttgtaacttagcctaagaagccacacatgggcatttctgcaatatcctattggttacataggtcggctttattcaatatggcacagcactactaagggtgcaagtaccaggaatctgggatccttgggaaacatcttggtagcttcttaccacgctaatcaacagaaattgagagggaattcaaacacagccaagggaggcagaccttggtggctacatgatggcctctggttgtaaagctggaaggaaacagacatggagatgtccactgcaggggctcaggttctaaggacacctcaccagccgggcagcccacatacactattcaggaggaatctgttaggccgggctgaaaactaatgttcttgggagatgtgttctttagaattaatggctcagagagctttcctgttgacattggtgctggatccatcttacccttcttttgctacatcttggcagttacatttaagatgctatttctcttcctcacttcaaactgtgcctaattttcaaataatttccattcttttttgaaaaatggcaattttcttatagttccaatgcttcagtaactggggagcttctcttgtgcctggatactacttttctttattaaaaactgatatgacccagataaagggaattttattctgagtgtttatctctaaacttcttttttattatttgtctcttgcaataatctgagcacttttaagagatgaatgttttatcctagtattcagtgctttttccagacctgacacatagtaggtattcaattaatgtatgctgccaaaatatatttcagtgttagaggccaccaaacagatatcttttcattctctcccctctgccgcctacataaggagccaatgaagcacgttttaaaaaagatagcacatttgtaattgcttcaaagttaaacctatatacttttttggttaattttattagctgtagttgctcttgttttccatactataagaagattatctcaattagtgttaattgtctccttccacgtggtccttcctccatctgacttaggggaattttcttggtgtttttccatctcattcagacataatggtgtggatggtgggtggtttggggttacatattggagctatgtaaggggtacaattccgatgacggttctgtggccctaatcccctgctccccacccccactttttttgaagagggtgtcaaatatggattaattacttatctttgtgaccagaaaaaaaaaaaaaagcctaagttaactgaaggaaaaaaaatggaaatttactaataagtgtcccatggaacttgtggattaaatagcagtcagatatcgtcacatctctctccctccctctctctcccccactctctcctgctcgctctctctctctttctctctttcctcagtgtatgcttcattcttctctttatatagattgttttcctcttctccattcccatgcatgcccaagtatggccactgagttagctgggtcctctgtgaggcagacattgagatggagctgggagcacatgaggtttgttgagatgtaatccctgtgaaagagaagaggaagaggaaggtaactggacagggaaagtcttcacaccatgatgcatactggacacctattaaaggaaagcgggaggaatcaggattgggcaagtgagtctcagatcatgatgtggacatgacaaaattcagaccaagccaatggggaactccagagcaaaaagatgatttgctagaggtgttccatgttggagagaaatgtccaggctctaggacctctgtggtgcttagtcattagctgggggttgcctagaagaagtatggctccagctcaaaaattgaagcagattctgaaggcactaacagctggaggccgtcagctaactccgctctcgcacctcccagctccactcctttcctgaaggaagagctgagcagtggtgcatctctatggctgccacagccaccaagacccaaaagttccctcactgtgaacatctatgtagagcatttacctgtagtagagtctgtgtgtatctgtcctccaaattaccatacagttctggcccaggagagtgggttcagttttacaaaatgatccctggggccactgctatggttaagaggatgagctagacatttgcacctaaagatattgtcattattatgttggataaaatttgaaggtcagagggcaccaaatagagtaatatattcactattttgtcctctctagcatgtagagccacgaagaagcatattttatttatttatttatttatttatttatttatttatttatttttgagacagagttttgctcttgttgcccaggctggagtgcaatggtgcaatctctgctcactgcaacttctgcctcccaggttcaagtgattctcctgcctcagcctcctgagtagctgggattacaggtgagtgccaccacgcctggctaattttttgtatttttagtagaaacaggatttcatcatgttagccaggctggtctcgaactcctgacctcaggtgatccgcccgcctcagtctcccaaagtgctgggattaccggcatgagccaccacgcccggccaagaagcatatttttaaaaaaaagttttttttttcgtttttgtaacctcattagcagaaagcatacttctgttcaaaagtattaagataatcatgtctgactttaggtttaattgcttcaatgataagcactgtcttctgctcccctccccacatccaacccttagaatttttccaagattcttgttatccattctattcatatttatatcatccatcatatgaggcagaggggagggaaatgtgtcaatagaaatatgtaaaggcattcaagtgggttggtattttcagcattaactaattattctttctttggaataatgtaccaaaaaccatattaggactttccggttgaaataaactactgttaactagctcaggtaaaaagtgaagaatttagtgaggaagcatgttcagctgtttggtttttttgaacccaacccaatgaggctttgggaatggcatattattacacattgctgtgtaacaaattgccaaaagcgtaatggcttgagaagaacacaaatttataatctcacagtctcttcaaggctgcattgcatgtgtcagcgggggctggttctcacttggagctcagggccctcttccaagctcattcagcttgtttgtgggcagaatgcagttccttgaggtcacaggactgaggcctccactcctgcaggccacttctctccacagacagtcacccagggctgtttgctttctttcttgagcagttaagagactctctctgctgctttttaaaggttttcaccccattaagtgaagttcagtgaggattatattccttttaactccaaatcaactgatttaaggccttcattacatctagaacacaccttttgtcatataacatagtaagttggccaggcatggtggctcatgcctataatcccagcactttgggaggctgaggcaggtggatcacaaggtcaggagtttgagaccagcctggccaacatagtgaaacctcatctctactaaaaatacaaaaaattagccgggcgtggtggcagccacctgtaaccccagctactcgggaggctgaggcaggagaattgcttgaacctgggaggcagaggttgcagtgagcggagatcgtgccattgcactctagcctgggcaacagtgtgagactctgtctcaaaaatatatgtatatatataacatagtaagttataggagtgatgtttcatatttgcagatccttccactgtcaagggtaggtattatacaggtctataccagggctggactcttagaattctgcctaccacaaatggactcagtttaagtgctggaaaactgaaaaaatcttcttctcttctatcttacctcttctctctaacagtctcttccctttggattctctaaattaccaaggaagagctctggcctaacttggatgggatgttcaaccctggtattatcaactgtggccaggggcatgattccatgttgtataaagtagcttctgggggtccactggtgtggttgagaaggtaggagtagttcacttaaggaagggccgtgtgagctgggaagatactccaaagctatttacctcgtgctgccttttattcagtgaagagcacattcttctgataggtcagacagcaatgggtagtaagtgataatggcccctgggcagcaatgaattgtgttgtgtcctcttttatgtcaccctgcaattctcccagaaacaaactcattctaaaactaggctgtgttcattcacgccacattcaacaaatcaaaacaatccaaaactgaaataaaaattcatgtagggtgatggtgaggaaatggggaatgactggtaatatgtataaggttttcttttgggggtgatgaaaatgttctaaaattagtgtgtatatattccactgcagttcatagaaatggccctagcccatagattgaggtctcttagtaccgttccccattaaaaagatcctgggctccttagcggtaatggcttattccaagtttgaggcatggaagatatcaggtgagcctggtacatcttttggggtgtctaaaagcaagagtccagggtttaatgaggtcaggtgaaaggtttggtcagttttagccccttcacattggctacaatgttgtgtgttatggtttggcctcataagcacctattcaggggagtacaacagaggaaagctttgtcactcagacacctgggaggtcctgcagatgatgcctgaagctgcagctggaagtgttgcttgtgcctgctgggtcactgggaagtgctatgcagtcacaatgaaattttcaggtggcattgtgtgccatcttagacttttttccccccaagtttcatccctcccacccctcagttcatgaaatttcactctcccagatactctgtacatcttttcttgtactatgtaataactacattctttcaccccgccccaccctgccaggacaatttttgccccgtaggggctgatatttcccttattgagaatgcatgctccactccatttgtgctggcaagtgtggagaatgtgggcatttatgtagggtggtggtagggaaatggggaaactagtaatatgtatgggggtttttttggggggtgataaaaatggaggaccccaaatgactgttattttggggcccagaaaaggaccagggtaaatacatttcatcattgggattcaaggctggaatcttttctgattgagacccttgggtcatttggacagagaaacagcgagacagatttcattcccttctctcccacaggagctgaccccaaatgtgtctcctgcatgctggtaaccatctcgagtccgctgcccagggaacccaccttgggatcattttgctaaatatctctaatatgtggttgatttattactgctgggtctaaaagctactgtttgagcatttatatagtgtgcaaaaaacttgtcactatgcatacagtgctggctgtctcccgttgaccctcccaagctactctccctctgctctgtgctcagggagactagccataaggattacatcaatgggcccgttgccacaggttcctgatgggcttggccaatggaaagcagcaggtagagcatgaggtcagagtatattctcaactcctcacctgtcagtccacagggggttgtctatttctctctgcaaagggtttctggtcctgctatgtggacccctctctatatatatttcttactatgggttcaagtggctaccttctctctttggcttcttcaggccaaaactccctgctcttgctggccctggagacactgcattatccctgtgtttctcctagattctgcccacctttgtaaatagtctatattttgaacccttcttcaatttctcagtttgcagatgccgtattccctgctgggaacatgactgacacattcaagtctcctcgaaagcagttatttccaagatggtataagatcctgtccctgcctcagaggtcaggaacagtgacctggaacagaacagctttgtggataacctaaaagcattttgcaagcatagagggtgaggtgattagctctatctgattgagttggggaaggcttctcagaagaggaaacagtatagtctgacaggaattttccatacagaaaaaggaactgcaaatgcaaacgcatgaaagcttgaaagggatggccttttggaaatctagaaaaaagtctcagcaggtaaaggtcaagtgtgtgcacacaggcttgtttgcagggaaggtaggaaggggaagaggcatgcggtgaagttgtaaggataagttggttgcggaagatgcagtcttgaaggcagtaaagtctaaaagtctatagttctctagaggtcggaaagtataaaagtctatagttctctagaggtcagtagaagtgttgtacagtgttgtaagaaatgaaggtaatacatttcataaaagcacatgctgtaactaccaagatattatcacaaggaggtagttaagagatggctagattgttgcaaccctagatggtgacacggttaagttaatgttttgtagaaggaagggaaagaaataaacacttaagtgtttactctgtgctagcgttcggacataatatttcactgtaggagacatgcctgttgactttgcatctttccatctataaagccaatgagattgccactggatagtacatcttgctttggggcttagaaaaatacatcatcagaatattccactgtgaggacccctgtctgacacatatacagacagtcccagactcatgatttttcaacttcaacttacgattttttgactttatgatagtacaaaattgatacacatttagtagaaaccatattttaaattttgtgggtttttttcctttttataaaaaagaaatagggtctcactatgttgctcaggctgatctcaaactccttacttcaagcaatcctcctgacctagcctctcaagtagctgggattacaagttccagccaccatacccagcttaattttgatcttttcccaggcaagctatatgtggtatgatattcttacatgagatatttaacactctactataaaataggctttgtgttgatttagctgatttagcttacctgcaggctaatgtaagtgttctgaacacatttaagctaggctaggctaagctatgatgtttggtaggttagatatactaagcgcatttttggcttatgatatatctaagttatgctgggtttatcagaacataacccctaagtcgaggagcatctgtagtggtaaacacatcattagggtttttaatttgattgttactgagaaattgttgcaggttgtgagtttctaaaatgaattttaattaactcccttcattgctggtcctgggtactagaatcgtaggaccacgcatgggttgtgcatgtgtccacaccccacaagccccagtttcttagtggtctctctaactcctcttgtgatcaataagctaaggtactctacgtgcatacatgctagctttcattttcatgtaaaactatgcagaatagtgtctggaacccactggatactccatacatggtctcttttgatcttaaaagaacacagcgaggtgggcattcagtaacttgtccaggttgagagtggagtcaggatttgaacccaggtgaccgtatcttatgttcttgatcatcacgcaaggccacctgtcattgagacttgaacagcagatggggccgggtgtggtgaatcctagctctttgggaggctgaggaatgaggatcacttgagcgcaggagtttgaggttgcagtgagcctctgtgctactgtagcacggagtgactgtgcttctgtactccaccctgggcaacagagcgagatcgtatctcaaacagtggaatgacaaagaaagcaaaaatcaaaaaacaaaaaccccgaatagcagatgggctgtgagcatggagcagattgcatcagctgcatgagccttcattcttcctccagaagggcctccaaagacagctttttcaaagtctaggctataaaaataccaccttgagtttcacttcttttcatgtatgagatcttagatcttagttcctgtttgctttgcaaaggacataaagagcctgcccaagcatgttcctctagaattcccaccgaaaccaggaagatagcacaggaagctgcctgtggacttaaaggaccccaagaagacccttcagccctaaaatatgtttccaatagctcatcttggtgtctgaaatgtctttatttgagggttattacttcaagtcatgagctttttggggtttgagcacgagaataaatttcttcatgctcttctgccagtatgtatttgctctttaaaggctaacagaaacctattcagtccagctttagaaataaacagaactgtatcccagtgatataagtgttacttcccagagcacaggggcagataatggcttgggaattggctcttggcaattttttggtttctgggcaattcctagttctaaggcaactattctccccgaagctgtgggatgccctgtttctgctgctcgctacagagccaggacagtgaggccaacatgaaggctggtgtggtctgccctgctttggccttcctatggcaggaaatagccgcctgaactccatgcagacctcagttaaagggcctaatgcacacctaattcatgccccaataagggcctaaagtctcagaatctcaattccaaatctccggtcaagggtccgccctgggtccactcactggacaggggttggggccgcatgccagggccatagtgctattggatcaggctttcagtcaagggggcatacaagatgggtttttcaagagtgtggggaaatgacaagaatctcccttataacatcccaaggacaaatgccttccctccaattaattaactcctcatatctgatggcagggtcctcagataaaaatgtgcttatgggccaggcatagtggctcatttatataatcccagcactttgggaggacaaggagggaggattacttgagcccaggagtttgagaccagtctgggcaacatagtgagacctggtctctataaataataaaaaagaaaattagccgggcatggtggtacacacctgtggtcccagctacttggaaggttgaggcaggaggatcacctgaccccaggaggtcaaggctgcagtgagttgtgattgtgccactgcgctccaccctgggtaacagagtgagaccctgtctcaaagaaaaaacaaagtgcttctgaatcacctgcccctctgccagtctttagtgctggagaaaaggcaaccctggctggtggtatgaaatgaatggaaagggagttgctggggctggggagtgggtgcacacagaataaaatgataatgtttttgagaacactttggcaggctatgtgtaattaacatgatactcaagtggattttttcttttttcttcatttttttttaacctggaagggactttgtaaatgtagttcagtcccttgccctattttccagctgagaagtggggttcatggaggttttggtcatctacccggtgttaggagactcattaggactcctgtctcctacctttgcctttgattgccagttcttccctctactctctgccctagtatctccaattctacattttctttatcttgacgtccttatctgatctctcagttaaactatgttgtggaaaaataactcctaaagccccaagaaccacttctgagcaagccatagcaagtatttccttggaatttccctcaggttaaaaagcagacttgagtttctcaagcttagtagctcagcaactaaaaagtaatgttaatatcaccaaagggcttaaaagtaaattgcagaaaaagaataaatatcatttgatcacagctgataaaggtaattctagtgtgatagggaagtcttagtgcattccttcccaagtgctagcttggtctgaacctcatctgtgtagaaattgtggcttgtgtagttatccagtaacatctaatatttgccatggctttgactaatatttaaagaaatgtgggcaatgctacatgctattcttttaaaaatagccataatggaattgaagtgggtcagctttttctccaaagagtttgcatcctgttacatactataaataataatatctaacatgtattgaacatttactatgtgccaggctctactgttttacgtctcttttctaacactcaaagcaacctaagagatacacatattttccttattttactggtgaagaagaaatgaaggcttagggagatcgtgacttgccctagatcaagcagatggtgaaaggcagagtgaggattcaaatttaggtctttatgtcccttaaaaaaggtttctttcatcatactaataagatgcctctttcagaatatgcatgtagaaagaaccagcataatttgtgctttgtagcttccaatcagaaagcctgggttcaacgtttacccttcaaaaattttccaaatagggaataagattctaggcattaaagaaatttttgtttccccaagcctgccacctcccaccccatataatacaagtaatttaaaagctagtcagaccaaatagtgaaatggactcagtatatggggatctttatttggaaaataaagtcaaaagacaagaagaataagaattatttgtttagaatctcagttattattaaagaaccagtctttcatcagtaaaattctagcctctcccaccagagggcagttatcacataaaccagaaagcccctcttggcttcactttcagacaccacatcacactacatctggaattaggtttacagcccagtacagatcctgagaacatctctgcttcttttaagtctgaaactaacatgtcatgcctttcttttttgcctgcaacttaaaggagcttatgatagcatagaaaccatctcttcataaaggaatgttaaaatggaccaaagacagatgcttgtattggttctattttgaggggtggaaaccctgcaccaaacactcagtgacagagtaaaaaacatttttctgtgtctaaaactttatattttattccatttatgtaccgtctgtgtttcagtaacctgtatttccccagaaaagtagctttatatgctttttcatgaaaattctaaagattagctgagaaaaaggattatagtttttgttttgtttttgagacagggtctcactctgtcacccaggctggagtgcagtggtgcaatcttggctcactgcaacctttgactcgtcggtcaagtgatcctctcacctcagccccccgggtagctgggactgcagatgcatgccaccacacctagttattttttttggtttatttttttgtagagatggggtttcgccatgttgcccaggctggtctcaaactcctaggctcaagcgatccacccatctcggcctcccaaagtgggattgcagtttttgatagacaacaaattacttttcgagtgtccagactgcttatgttttggagaaaccaacagaaacattatatatattgatcactgttgcgggaagtcaaggaccccgaatggagggaccggctgaagccatggcagaagaacgtaaattgtgaagatttcatggacatttatgagttccccaaattaatacttttataactttttactcctgtctttactgcaatctctgaacataaattgtgaagatttcatggacacttatcatttccccaatcaatactcttgtgatttcctgtgtctgtctttactttaatctcttaatcccatcatctttgtaagctgaggatgaatgtcacctcaggatcctgtgatgattgtgttaactgcacaaattgtttaaacaatatgaaatctgggcaccttgaaaaaagaacaggataacagtgatgttcaggggacaagggagataaccttaaagtctggctgcctgtgggccgggcggaacagagccatatttctcttctttcaaaagcaaataggagaaatatcactgaattctttttctcagcaaggaacatccctgagaaagagaatgcatccctaaggggaggcctctgaaatggccactttgggaacgtctgttttttttttttttttttttcttaacggttgtagataagggatgaaataagccccagtctcccatagcgctcccaggcttattaggatgaggaaattcctgcctaataaagtttgatcagactggttgtctgctctcaaaccctgtctcctgataagatgttgtcaatgacaatgcatgcccgaaacttcatttgcaattttaattttgccccgtcctgtgatcttgccccacctccatttaccttgtgatattttattaccttgtgaagcgtgtgatctctgtgaccccaccctattcatacactccctccccttttgaaaatcactaataaaaacttgctggttttgcagtttggggggcatcacggaacctgctgacatgtgatgtcttccccagacacccagctttaaaatttctctcttttgtactctttccctttatttctcagactgactgacacttagggaaaatagaaaaggacccatgttgaatatcgggggctggttccccccgatagatcacttagcacagtgcctcatagagaacatactttatggccagaatcaaattcaatctttccaacatctctggatggtatgttctgtagttatacccattttagagaagttgaaacattctcaggtgaagtaacacatcgaaggagacccccttactccatgttcttaaccaccacgaagaagtggatctgttggagatgagatgggcctaggtatagagacttggcaggtttacaagggaggcgcactggtgctcagaagtcaatgtcaggaaaaggaggctgacgcagggtaggtaactgtggaagctacccagttgctctcactggctgagactacagtctccactacttagtcaaagggcatggctgctcaagtgatgtttacagaccattactccatgaagcaggaggcatggatggctagaatccctaagtccaaaagtcagacagtctggcaggagccttgtgcgatacttgtatgtgttaacttgactgggctaagggatgcttagatagctggtcagacattctttttgggtatgtgtgtgaggtgtctccagagggatgagtctttgactgtatagactaaaaaaagaagatcaacctcaccagtgttggtggcaatcagtcaatcccttgagggcctgaatagaacaaaaaggaggaggaagggtggatttgttctttctctttatgagctgtgacatccatcttctgccctcagacatcagagctcctggttcttgggccttcagactccttggaatggaagttatagcatcagttcccctgtcttaggcctttggacttgaactgaatttcctagctcttcagcttgcagatggcagattatgggatgccttggcctgcataatcacctgagcctattccaacaataaatctccttttatagatctctatatttgcagtttatttgttctgtttctctggagaaccctgactaacacacatggctagcagattgaaggcacagaactaggatctatctccgtaaaaagaacaaatggactctagaggaaataccactgccccaaccaccagtgaagtctcagttcagggcaggatccaggcctttagagggactgtggaatttggctggggggaaagcaaacagaggagaaaatcttggccaaatgttcagctttatgaattgcaccaactccaagagtacgagtggctccggtctggaatctggttggagatttgagagcgcaggcagatgctcagctgttgaagctatgccacagagtctggcaggctagattcatttccagtcctgatgagattgagctgaggctgttgatgatttgtttgctttggttacaatcaactcagtagcaggaacagagctgagcctgagtatgggtgcattggtgagcccagcagtcgggactcaggggaggcaaagtgaacacagtggggcttgctccacctgctaacttctggttgctgacattccagtccctgagcagtgcctaatgaacctgactccatcatgacagtcccagaaggaaaaatcttataaatagtcccttcagagtttgtggccctgaagtttcatgagcacattagataccaattcaatgagtagaatcttccaaagcttttttcctgtattagttcttgaacactaactcttatctctcatgtttcctagcctagtgtctcgcttaacaatgcgtaaaagagatccacaagtttatacctaaggtgccaggtggacctcatacccagcaagtacagcaaaactgctttcagctgaagcgatatgggaactctacagggaggaggaatgtttgggtcaaggcttaaagtaaaaacacattttgagcatcctagctaatatctgtgtcagagggtgagggtatctgtattcatatcctgtggctctggtaacaaataaccataaacctgatggcttaaccaacagaaatggactttttcacagttctggaggcccagagtccaaaagcagggagctgacagggctgtgctttctctggaggctctggaggatagtctgtttcttgcctcttctagcttctaatggctgctgggattcctgggcttgtaattgcattgctttcatcttcaaggcctgcatcttccaatcctctctgctctctcttcccattgccttctcctctgtgtttctctgcctctctcttatagggacatttgtgacggcatttggtgcctagccagatcatccaggataacctcctcatctcaagatctttattaatcatgactgtaaagtctttgccatataaggtagcagattctaaagatttacagattccaaggattaagatgtagatatcttttggggggcattatcaagcctaccacagcagccctgctgaaagaaatagcatgtaaggaagaaaagacagagaaggagaaagaatattcagacagcgaccgccagttagttggagggttgggatgatacagaacaatcctataaggtatggcttcttacaaacacctatttagcggtcttggtggggtccttgaattccagaccaaagagtttggagcataggatggaggaaatcctaaaaatacagatttggaaagaaagctaagatcagattgtataatcacaacagttatgtgagaaaaccaagaaccactgcaagtatttgatcaggggaaagatgatgtgatcaaagaaggaatattggaaatcttaggaagattacattctccatccttcaactctccttctatttgtgtttattatggctcctatggaaggacaaagtccttaacattccaggctaacattccagagttgacttcagccttcaagagtgcagcagggtccaatcaaacctcctgtcataaactttttggatgcccttgggtatgtgtagatattaactgggttgccaattttatctttttccaaacaactattttcatctcctgttgtctcattactgcttctctgggtagccgaggccctttgctctaatgtatataatatatagtacagtcccttccttaattccccaaagcctagtttacattaggctgtagggctgaacaaaaccttaccaatgacttgaggatgacataaggaaattactttgtttaaaagaaatattccaaatgggatattgttcatctaggtctcagactcagacaagcacagcctgtcagggtctcttgctaaccagttctctcctatccgtcaggctaatggtcaattttcttttgtttttgttttgttttttgagacagtcacactctgtcacccaggctggagtgcagtagcatgatcttggctcactgcaacctctgcctcccacgttcaagcaattctcgtgcctcagcctcctgagtagctgggattacaggtgtgtaccaccacgcccagctaatttttgtatttttagtagagacggggtttcgccatgttggccaggctggtctcgaactcctgacctcaagggatccacccgcctcagcctcccaaaatgctgggattacaggcatgagccaccatgcccggctggtcaattttattaaaagcatcttattagacaaaacaaacctggaatttatgttaattttttcatccccttacatgcttataattgtagtttatatgtaatattcactccctgaccaactgcagtttaacttctgtccctaccttaccatggactctcctcttagttaagtcaaagacaccctcactgctaaatctaggattccattcgtaccttccttaacctcttcaacatttgacataagccatgctgcctgctcccactgcactccttccttccctacctgctcaatgcctcaccacagccacagaagaacaatcagttaagaccaccacagtcaccctgcagagatgtaattcaccccacaaacatgataaactacctgcttaataatgtaaaaacttaagtaactttccaaactatcaattttaaccaattttggggtcatgaaatcaatttagagagtttcaaggatcacttttcttaagctacatagaactgaatagagaccatcagagtgtattcacgtaggaaagctaagtgttttgtacccagtatgtgtatatgtatatccactaggtcatgatagtaaatatatttcttattgtgggtggtcagaaaagtttttaaaaaggcactgatttgggttttcctgaagttaactctattattccaaaatagaatccaaactttaatttggaaaaaaaaaactcaatagaaattttgattatgaggcgatgaagaatcgtctttaagatttctgctgtcgcagcttaaataactggtgaaagttcaggcaactttaaaaatgttattttgtctcaagaaagatgacaaggcttttcatggctggtctcttcctctccagcctcattttccccgtttcctactttgcagagtgtatcgtggccacgctgagattcttgtatcttctcttggcatgatgttttcttttggctccaggaccttgaagatgccatcctgttacctggaacactcagatgtcctccctctccttctctgctcaaagcttcctgtggcccactctgtcagccttcttatcccagctgagtcatggctctttttagaaaaccttctcggacttcaagccaagctgttattggaatttgccgcctgtgttcaatggtcaatgatctccaagtcactgcaatttaacgttcaccctactgatgactctgaccttggtttggtcgaggacagcattgctgcatctatactgtcatccttatccacctaagctcttcagcatttggcataagccatgggtgtcttgatgggtgactaatgaagcagactacacagcatttctcacctgttttattactgtatcatttatcctctcccagatatctttagatactgttcacctaatttctcctccatctccccattagaattctaataacccagatacatgtccatttatgcactgtggccctttggaggatcacaaaccattacataatatctcagattttatataatcttagattatgtgaatcttttttttttttttgctccataggaaccaatttttacctccttgtgggcactatcacccccagtgagaatgcatgcaataaaataaaactctatttgtcctcttgagagggataagaaaaaaaaatagttcccactctttaataaaagaatgtggattattttctgtatattatgatgttttgatatgttaaaaacctttccacctggaaagagactgcacctcccagggctggccaatccttagagacagcaaagggctcagctgggagtgtgcctttgatacgcaaactgcccaacccagagccatctctcctctatgtggcccctgcactccaggacacaacattcctctgccttagtcaaccaaaggccaggtaccgggcaattggagacatcctgtagcttagggcctgctgaaattattcaaactagccagttctaaactgttcatcctgccctgcctttccctgtggaaaccccaataatggctgtggctaaatcttccacttgctcctgtcttctgcctcctgactgcttatgtcttcctctcaccctccatagccagttgtctctaggacctgtgagtataacatactttgttttcccgagactctctcctgtatctcctcttgtgaccacaccgccctgatcatggcgtaaaagaatacaaaaaaaggtaaaatagggttctatgggctgggcacagtggctcacgcctgtaatcccagcactatgggaggccgaggtgggcagatcacgaggtcaggagatcgagaccatcctggctaacatagtgaaatcccgtctctaccaaaaaatacaaaaaattagccgggcatggtggcgggcgcctgtcatcccagctattcgggaggctgaggcaggagaatggtgtgaacccaggaggtggagcttgcagtgagccgagattgcgccactgcactccagcctgggcaacagagtgagactctgtctcaaaaaaaaaaaaaaaaaaaattgggttctatgatggataacaagagtactttccctagatagttggaaaagacttggctgaagaagtaacacgtgacctggagcctgaatgatgagaaagaggcaactttaagacaacttgaaagtcaagttttcagaacaaaagggactccaagtacaagaagcctgaggaagaaccaagcttagagtgttcaagggacagacaggaggccagtgtggttgaagcaggggcaccaccattttacctgtggtcaccagcatgcataaaatgtacaacacgaagactgaaccctagtgtgaggtggaggggagcagggcagaggggccagattataggttctcaaaggccatggtaagaattttatatttcattctggttgtgatgagaaacttctgacttcaagtttgaagcaagggagtgacatcatctatgtgatgctctagaacaactgctctagttacaaggcgaaggatggacaggagggcaggagaaggaagcctgacagattctccaaaaggacaaaaagtcaacgtagctgatgatcatgatgagggcagtcacgcttagggctggagtcaaagggcagttttgggaaaattttgggaaaatggcagaagtagaagtcttgaatatcgcatcagaaatgtgatgctcatttttatttttttcttttcttttagatggagtcttgctctgttgcccaggctggagagcagtggcacgatgttggttcactgcaacctccgcctcccatgttcaagtgattctcctgcctcagcctcctgagtagctgggattacaggtgtccaccaccatgccctgctaatttttgtatttttagtagagacggggtttcaccatgttggtcaggctggtcttgaactcctgacccgcctcggcctcccaaagtgctggaattgctcatttttaatctcagcagctcattcacagatcatacatggaaacttatcactcacacctaagccttctttgcctgtcttagagatccctggtgcaagaaactgtaagattatttgacacattttctctgtctcaccctaacagcctctttctagtatttgttttaaaaaacttattttttttttttttgagaagttttttagagcaagggtttggggagacagagggatgaataagtggagcccagagggtttttagggcagtaaaactactctacatgatactgtaatggtggatacatgtcaccaccatgcataaaatgtacaacaccaagactgaaccctagggtgaaatatggactcaggctgataatgatgtgtcagtgtaggtttatcagttgtaacaaatgtaccactttgaggctgggagcggtggctcatgcctgtaatcccagtactttgggagtccaaggtgggcagatcacctgaggtcaggagttcaagaccagcctggccaacattgtgaaacctcgtctctactaaaactacaaaaattagctgggcatggtggcgggtgcctataatcccagctacttgggaggctgaggcaggagaatcgcttgaaccttggaggttgaggttgcggtgagctgagatggtgccactgcactccagcctggtccacagagcgagactccatctcaaaaaaaaaaaaaagtaccactttgggggtggtgttgataatgggggaggctgtacatgtgtaggggtaggaggcatgtaggaaatgtctgtagctttccctcagttttgctgtaaatcttactagtgtttgaatgccaaatccttaagatcatatctatttcttgtcactggcagtgagttctgttcttgactttccactaagagcagtactgatgacaacatcccgcagtattttatgagccggagaacattaacatatctaaaagagtacattttcctctggagggccaccagcctgtaaactgcaggtcaaaaagctgagtgtgaacagcattgttaggacatgtttctaagtgtatgccaatatgtccacagaggtttttttagacttataaagcgagctaaagaagacttttgttccattttctgatttttaatttatatagacattttttcatttgaagaaagtgcatatatttttaaaggaaaggtactcttaagtctatccatttaagaaaatattaatctccatggagaagaaattttccatattttaaaatttattgtgtgtaggtatattccatatacactctataaataaaaagcacactggctgggcgcagtggctcatatctataatcccaatgctttgggaggctgaggcgggcagatcacctgaggtcaggagtttgagaccagcctggccaacattgtgaaaccctgtctctactaaagatacaaaaattatctgggtgtgatggcagacgcctatagtcccagctactcaggaggctgaggcaggagaatcacttgaacctaggaggtggaggttgcagtgagccaagatggcactactgcactccagcctgggcaacagagcgacactccatctcaaaaaaataaataaataaataaaataaaaagcacacactatcacaaagaagatggtggcaaaaataataataaaaatagtaagtaaataaatagcacagaagtatttacagtaaaaaattaggtctccttccagcccccacctgccaatcactctcaggaggcacccactgtcttcagctacaaagctttcagagagattttattaatataagcaaatacatactttttaaaaaagtataaataaggcctggtgcagtggctcacgtctgtaattccagcactttgggaggatgaggtggaaggatctcttcaggccaggagttagagaccagcctgggcaacataacaagacccccatctctaaaaaaacaatcaaaaaaactaactgggcatggtggcatggttctatagtcccagctactcaggaagctgagagtgagggatttcttgattccaggacttcgaggctgtcacccactccagcttgggtgacagagcaagactctgtctcaaaaaaaaaaaaagtataaacactagcatatcatatattgccctggacttttctttttgatttaacatatcttggagattcttccatagctgtggataaggagttgcctcattctttttcagggtaagtttagtataaagggtgatatagtggggaaattatatttaatttatttttgccaactcagtagcagagctgtgacaagattaatccttagatttttggaggttcatatcaaatcattcaaagctttgacatttttctcttctttgtggctctattttcatcactaaaattccccatcctatgcccctgcagcccccatctgacgtttgtcacttctctagcttagtcatctgatctaattttgatgagtcagatgtaaataaacccagataatgtgtcttttagcccaaaagactaaaagataaaataaaaggaaatgcataggacacagggcagtttgttgaatggctgagatttgaatatgtgtgtattaattctttctgaattacagctagattctgccctccccagctttgtatctggagacgagggaaaatgtgatcccagttcatattatgagtgaacatctctgactgttctaagaagtcctattcccttagattactgaagttcacagggagaaagcacccacccagatatttttggtttttgtttgtttgtttgtttgttgagatggagtctcactctattgcccaggctagagtgcaacggtatggtcttggctcgctgaaacctttgcctcctggttcaagcgattctcctacctcaacctcccaagtagctaagatttcagacataagccaccatgcccagctaatttttgtgtttttagtacagacagggtttcaccacattgttcaggctgggcttgaactcctgacctcaggcgatccacccgcctcagcctcccgaagtgctgggattacaggcatgagccaccgcacctggcctcacccagatatttttcaaataccattttcgattcccactctctttcttgaagtaagcaaggcagacacatttgccaaggataactgagaatgtaagggcaatccatgactgggcagcttgtgcaggctgtgtgctaaatgcactgggaaacatgccctataaatagccgttcattgtcagcatgtgtgaaaagacaagagagcattccgtgctatgattcaggcctaattaagtgattgcgtctgggcacggctataaaccactagctgcttcaactggtaatccagtcagtaggcaactgcaggggctcgccactgactgaaggcagtggaaggttggcagaaggaggctgttcaaggctgtttttgccttcactatggcaaaaatcattttgaggcacctcatagagattccagtgcgttaccaggaagagtttgaagctcgaggtctagaagactgcaggctggatcatgctttatatgcactgcctgggccaaccatcgtggacctgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctgctgataaaagcacaacacggaaccagaatggatgagcacggttttatctcaagaagcttcacccgacagtacaaactaccagatggtgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatacacagttcctggtatgttgaggttgtctttattattcttactcagaaaggaaaatttgtaaatatgtttgtgtggctcaaactgatactattcttacaactgaaacattgaaaatacagaaggctgtatttggatattagagaggactccgaattgtttcttattattccaacaatgccagctgcatttgtaatcactgatggcaaaagagctatacccatttaaggaattcctatccattttatgaaaatcttttattttgccaaaaagagttgtgattcccttcactcgataagcttttctttttaatgtattttaattaaaatgaggttttataaatatggagtgcaaaaattaaaatacagtatttggaaattgggtctgatatctatttatgatttagtatagttgttactgccttaaaggtcaatgggaattttcagatataaatcttatttttaaaaagttcaaatatgtacctcattcatctttttaaagatatactgaatcctatctgaagtgttttgactttttaaagatagtataagttctatggacacgtacaaaatgttcatgagatatgtatttacatatcctcttgtaaattaatatgaagcttaaggacaccacttttaaaagtttgattgctgaattcagtgagttttaatctgtgctttttagatgctccataaacttagatggcaaaatgtaacacatctgctatctctgcataatccttagctttaaatagcctggcagccaatggaagttcaacacctgagcttacactgcgtgtctgagtttacacagcacatctgatgattggtgcttattatattctcccaaactactgccttggctcaaggtggagacattggtagaggttaaggactagtgccttcaacagctgctctgggacattccaaaggtttgctatctcattctgtatacattaagtatttcttcagaggcagtggctgcctgccttttaccccgcactgaatgtgagctgacaagcagcccaaggacagtgctaagaatagacatggaatgcagggtgtggaaaacaccagggcaaatgcagattgctgacagtatcccagtactcccccacgttgttttactgtagctcaagttaaaatgtaaaagacatgaagcaatagaaaaacgaatcaaacagttctaaaagttattttgaaaacaaatgtaatctgagaagaatgtttactgtctaattaaattgaaaagattttgcagttatatgcatatctgaggtttatgcctatacatggaggtttgtgtgtccaactcagatatgaaaaattttgtttgaccaagtgaatatcacagatcagcttggctgcataacaaagttaatagcagtcgttgagattccagatctactaatatgatcagaactgggataccatttgtctggattatcattctttcccagtgattggcagaatagtgtgaaaagaaactaatgtggtgagaaacaaaaaaaccctctctttcggccttgatcttactctagatgagatcctcctcccgggaaaattcaggaggtgaaattcctaccatgaggagccactgatagaaaatattctctttaaaaataaaattaaagtaaacacatgtctaatgagctcttgtttttacaagataaattttaaagtcttatagataagatatagataagttttaaagataaattttaaagtcttatagccatttttttgatttgggaaatataccaaacactataaataataaaaatcatctatggttcttctgctaccatgaggcagctattttaaatatcttgttcaacaacaggactacataaatacatgtatcacttttcacaaaattaggattatatctgtatggagtttgatatcctgattgtactggctactgtctgttgccctccccactcccaccaagtcaaaccattctctgcccttctcagccccactctgagcccaagcaggctgaccctgatgggccacatcattctagtttctggttgggttcagccaataagaggcactgactggagaccagagattgcagagagattagtgggcaagaggggagaatggtcagggaattcttctgtcgcccttaacctgctgcagaccaaggccctgtcagggctgcatccttctatgactgagttcctccagggctgccactctcacagggcttagggttgtaacactgtctcttcctttcgtctgttcaaaaggaggaggaggggtgactctctgctctttcttgtaccctgtgtgtcactatcccttattgattctccttactttgcccactctctcataaatggtcctttaggcaatggaattgttttctgccagaactctgattgtttgaccttttaatcaattgcagagtaaatgcatgtgatagcaaacatttaagcatacctttagaaagacccagtacggtagatgtacctgaatgtgtgtttcaagttaggcaatctgtgcatggccaacctggagattcgtttttttatctatacatctgagcccccacccagcctgttccatggaatatgtgccgtacaggagattgaggccttgagttttgagttaaatgatggttgccaggtggagttctttcgatggagggtgttaagtgaaagtgctgtagaaactgcataatgtttgcaagcagttgtgttctcccagccagcctgccgctactggactctctcttctgtattaaccccctaataaaacaccgcatttcatctgctggctctgggtctcttctttggcctctttaacctggtgctttccctattggggttgataggtgttcatcgcaacagtgactttttaaaaattagtgcatcgctttctttttctaccaaacaagaactgatttgtaatggctattcactgttccaacaaagcttaattgtattagcatttaaccatttcttttcattcttggttccagtaggaaacagttggaccctatcaaattggaaaaattcaagaagggtttatttataaagagacattacaggctgggcattgcggctcacgcctgtaatcccatcagtttgggaggccaagatgggtggatcacttcaggtcaggagttcaagaccagcttgaccaacatggtgaatcccagtctctactaaaaatacaaaaattagctgggcatggtggcacgtgcctgtagtcccagctactagggaggctgaggcaggagaattgcttgaaccttggaggcagaggttgcagtgagccaagatggcaccactgcgctccagcctgggtaacagagtgcgactgtctcaaaaaacaaaacaaaacaaaaataaaaaacaagagagagagaaacattacaaaggagtggggagggcatagaggcactgcaaaggaaagcggagtaatctgacgttcagtgtggagttgttacgtcccccaggtccaaagggatgggaggaggaagcaggtctcagaaatcaaaaggaaagtcgcatagaggagactaccagctgtgactttcatctgagggcatgaccagtccaaggagacctcttacagggagggagccaggagaacaaatacttcctccttcccatctcctgctagggtcccccattggctggatctgactggaggccagagggcatgggagtcctgtcatctagttcaacggccccccagggcaaagggcaggatggagaaaagtgaggatgaccctcaggggcaggaggataatatccagtactccaatcaaatgagtcctattgtcagagttctctgttagaaagtctctttctacaaagtaaagcttgggatgaggatgggatgaggaagagctgacactttatttggaaagtgtcaagcccaggatagtaaagatgaggaaataggggaaatgagacaaggaaaaactggggagctaagatggtgtgattaggggatgtgtcactgtgctgaccaccacgccacagggagctgtgaagaggctcagcatgtctgtgggcagggatgttggctcagcacagggaatcgctccatggagaagttttcttcagggagaaacaaatcttaaagaagtccccaggaaaatcaaggggagagagggaatttgctcaccttattctctacaatatcccatctcctattagtcaaggttcagctcacaggggataaactttcctgtacttctgggttctatcattcaatgccttgttggaaaccagaccctgatgatgtgacatttcatccaagctgggagcagaagaatgacagcatgattaggagcagaagaatgactcagcatgagtagggctcaaggcttcagtcagtggactcttgctgccttggaagcctggcaaaactgctggcaaaagtggcagcagcatggtctgggaggcaggcgatgccttcagaaacaaggtgtcagtcaaaaagatatgcaaggtttgtatccagtaaaccttaaatacaaaactgcaggaagagaatgccaggcagatcagacagtcttatatcatctactgctctgcaacctacactgccttcagattttatggaccctaatgtcactttatattttgatctaatttttaatccacttaggtgcaaagttagtcctcttaaacatctccaggatttttctttttctgtaaattgtggaccaaggttgtgtgtttattatttaaagctgtctgccagaaagctagaagtcaatgaagattttcaagatttttgttctcagtgatctctccaagtccaaactgcactgaggtatcagggaacctgccccaatattcatgtaggttcttttccattttccttaagtgtcagccagcttgaaaaataaagggacagagtacaaaagacagaaattttaaagctgggcgtccgggggagacatcacatgtcggtaggttctgtgatgccccacacgccgcaaaaaccagcaagcttttgttagggattttcaaaaggggagggagtgtgcgaataggtgtgggtcacagacatcaagtactttacaaggtaatagactatcacaaggcaagtggaagcagggcgagatcacaggaccacaggactgaggcgaaattaaaattgctaatgaagtttcaggcaccattgtcgttgataacatcttatcaggagacagggtttttgagatcaacgggtctgaccaaaatttattaggcgggaatttcctcttcctaataaatctgggagtgctatgggagactggggtctatttcatccctgcagtctcaaccctaagagatggctacgcccagggtggccattcataggcctaccctcaggcgtgcattctctttctcagggttgttccttgctgagaaaaagaattcagtgatatttctcccatttgcttttgaaagaagagaaatatggctctgttctacctggctcaccagcagtcagagtttaaggttatctctcttattccctgaacaattgctgttatcctgttcttttttcaaggtgcccagatttcatattgctcaaacacacatgctgtacaatttgtgcagttaatgcaattattacagggtactgagatgacatacatcctcctcagctgacaggattaagagttaaactaaagacaggcataggaaatcacaagggtattgattggggaagtgataagtctccatgaaatctttatgtttagaggttgcagtaaagacaggcataagaaattataacagtattaatttggggaactaataaatgtccatgaaatcttcacaatccacgttcttctgccatggcttcagccggtccctccgtttggggtccctgacttcctacaacactgaggtcccccacttgtccttggcctatttttctcacctacttgtccttcaaggtagagacacagtcctggaaatcttatttggaaaacgaaacatcaaaaacagaagaaacaacatgcttcccagctagctctcctcattatcctttctgccatcacagcatactgtgccccacactatgagcagcatgccaaaagtgcctggttcctacccaaaatacttcctgaaagatgtccagctagtccaaggctactgttagccaccagcgcactgactgcatttggcaatcgcatgcacttaccaggcacgctggcccttctcaaagagccaccttgaagggttttgtttgtttgttttgtttttttgcctgagtgtctcctgtttgcccactgtgtgcaattgtgtttggaccacgtcttttagcattttctgatattgggaagacagtacagtgttatgaaagactgagaacttcaactggagttccacaggtttttctttcatgaaacattgctttaacacaatcctattcaatttccatacttaccatgaaaccccaaacgagaaaaatgtatggaggtcttgctttacagtagggtgttactcagtaagttacaaaacacatcttggctgtaaccctttgctgggaggcgatgaggctctggatatgaggaaggaaaatggccagtatcagggatatggacaatgctttcttccttaattcctgattctcctaagcttttgctataggcatagcctcttgtccctggaatggattacctaagtgtacacttgtcactgttgaaaatgttatatggatggggacaggaggtggggttggaagcatcatatatggaagccctatgcttaaaaatatgtaatgggatcatgtatggtcagtctatgtagagattgctaacaagtgatcaaaaaaatcagtggattgggtcttgtgtttgtccctattgatgtgattatctgaaagttgatctgttaaggaccttagcaagtcaaaaagttattttcatttattttttattttattttatttttttttgagatggagtctcgctttgtcacccaggctagagtgcaatggtgtgatctcagctcactgcaacctctgcctcctgggttcctgggactacaggcgtgtgccaccacgccctgtagcacaaattttttttttgtatttttagtagagacggggtttcaccgtgttagccaggacagtctcgatctcctgacctcgtaatccacccacctcggcctcccgaagtgctgggattacaggtgtgagctactgcgcccagccaaaaagttattttagaaaacatatgaggcaaggaaaataaaatgagaaaaaactgggaagccaacttggtgtgatgatgggatgtgttactgtgctggttaccatgtcacagggagctgtgaagaggctcggcaggtctgtgggcagggatgctggctcagcacatggaaccgttccatggagaaattctcttcagggagaaacaaatcttaaagaagtcttagccagttgctaggctcatgcctgtaatctgagcactttgggaggctgaggtgggaggatcacttgagctcaggagttccagacaagccttggcaacatgacgagactccatctctacaaaaagaacaaaaataagccatgagtggtggcacgtgcctgtagtctcagctactctgcaggctgaggcgggaggatagcttgagcctgggagggtgaggctgcagtacagtctaggcaacagaacaagaccttgtctcaaaacaacaacaacaaagaaaacccaagaaaataaaaaacaaaaacaaaaaagtcccccaggaaaattaagggaatagagggaatttagcatacaacctcaaatttttaaaaacccatgatttccactagtttaacaaaaatactttttactaatgatcatagttctcttcagagtctgtcaaataattagtcacaaagaagaattaaaaattaaaatgttggtttggtacagctcttatattacattttgaaaataattttatttagtggttgagtgggccggatcccacctccacccctgaccccccgcaaaataagagaggtagtatttttaatttgaaaagcaaatgattcaaactgctgtttacatttcctgtgttgtttaatacacagtgtgtgtgtgtatataaaaatataatcctgtttattaatgttttctaacctcaaggaaatacaaagaatgtgcaatgtggtaagatcaaatgatctgtatgataccattctttgtaatgtgttgttcaaatattctatgttcttcccttttttcccctgatactagaaaacatatagattgttgtcttcgaatctctcaaaattggagattcgaaattggaaaaaaggcagttttccatttttaaaaaaagttctggcccattttttactttgtgtatttttagattatgttgttatacttttaagtttgttgtataaacttatataactttcctaattgtaagtttaaaattgtaatttttttctatcgaattgtttcttatattattatgtaggcccactttttatccctatttaatgcttttagccttaaattctattttgcctgaaaaataccacgtttttattatttacatggcaactcttgttcttttatattcaatatattgaatacactacagtatttaaatgtgtctcttaaaagcagtagcatatagctgaatttttaaaaatgcagtctgatcatctgtcttttagtagataagtttaatccatttacttattggaattaaatatttgaatttatttcttatttcatatttctgtttatcatgcttttctttgcttttttccctttcagattttcggtttacttctttgttttttctactgatctttaagatgttaaaacttaaacactgcctgaaaatttataggctaatatacatttttgaaggaaaataatacaagtataaaaatttaaacattttctttgtctttttttttttgagacagagtctcaccagggtggagtacagtggtgcaatcccggctcactgcaacctccgcctcccaggttcaagcaattcttttgcctcagcctccctagtagctgggactacaggcatgcaccaccatgcctggctaattttttgtattttgagtagagacagcatttcaccatgttggccaggctggtctcgaactcctgaccccaggtgatctacccgcctcagcctcctaaagtgctgggattgcaggcgtgagccaccgcaccccaccaaaaaaactgtcaatatccttctcctgattgtgactaggtcatttgtgtccttactacccactgaatactgtcctccatcttgttgctattcttaattttacttttagactgggctcaatggctcacgcccataatcctagcactttgggaagccaaggtgggaagacagcttgaggccaggagttcaagaccaacctggccaacaatagtgagaccccacctcttatttatttaaaacatttttaaaattaaatttagttttgggctgggcacggtggctcacacctgtaatcccagcactttgggagactgagtggggaagattgcttgagcccagaagttcaagaccagcctgggcaacaaaatgagaaccctgtctctacaaaaaaagaggaaaaaaaaaatcaaaaatgagatgggaggattgcttgagccacaaggtcaagactgcagtgaactgtgatcgtgccactgcactccaacctgggtgacagaacaagaccctgccggaaaaaaaaaaaagttttacctttaaatattgactgttaaaatcctactattggccgggcatggtggcttatgcctgtaatcccagcactttgggaggctgagtcgggcagatcacctgaggtcaggagttcgagaccagcctggccaacatgtcaaaaccccgtatctactaaaactacaaaaaattagccgggcatggtggtgtgtgcctgtagtcccacccactaaggaggctgaggcaggagaaggagaatcgcttgaacccaggaggaggaggtttcagtaagccgaggtcatgccattgcactccagcctgggtgacagagcgagactccatctcaaaaagaaaaaaaaaaatcctactattaaaagaaaatgtatgaatttctgtgctcacctttgtttcttgttttccacagctgaactttgggttcctatctcttccggttaaggtttctagttattttgaggctctgtaggtgaaaactgtctttacattgcttcactcttgaatgatatttagcaaggtataaaattctagatgaatggtaatttttacctcaacactgtaattattctgttgtcctctccacttagagtggagttcttattagcagcaacataatcgttcctttgtatataatctgttttctctggtagtctcagatattttctctgtgatgttctgtggtttcactgtgatttgtctgggcttggatctggatttgtttgtgctgcttaatatgcagtctgaacaaatatctttttttaaaggtctggacatttcatggctatttcttcttcacatgctctccacaaaggctccattcccttcagttagaactattactatatatagattgaagcctctcaaaagcccttggtctttctgtgctctatttctagctgaattcctcagtcctttcgttctttctttccttttgaaatatgccatacatatagaaaaacttaattattattgttcatatgtttttttaaaagatcatccatgtaataaatcacccagcataagaaatcggtcactgacagcacccagaggctactctccttccagaggcaaccaccatcctgtcctatgtgatgattaagaaaagataaaaatgttactacatgtatttgcatctctaatcaatgtagtttagtttttacttgtttaaactttatataactggaagtatagcctatgtattttttgtgacttacttcctttactcaagattgctttagcgccatccacagagaacagtactctgttcatttttattgatgtatatagttcattgaataaatgcaccaatctgtgaattctattgataatagtcattcctttatgatattaaaatatattttgtttttatagaggcagggtctccctgtgttccccaggctggtctcaaactcctgggctcaagggatccccctaccttttctcccaaagtgctaggtttacaggcatgagccaccataccggggcgataatagatattctcttttaaacattaaaaaataatttgttaaagatggggtcttaagctaggtgtggtcgctcatgcctgtattcccagcactttgtgaggccaaggtgggtggatcacttgaggccaagtgttcaaaaccagcccagccaacatggcaaaacactatctctactaaaaatacaaaaaactagccaggcacattcctgtagtcccagctactcaggagacatgagaatcgcttgagcctgggaggcagaggttgtagtgatctgagattgcaccagtgcactccagcctgattaatagaaaaaaaaaaaaaaaaaagacaggatcttgctctgttgttcaggcttgggtgcagtggtgtgatcatagctcactgcagccttgaactcctgggcccaagtgatcctcccatctcagcttcctgagtaactaggactacaggtacatgtcacaatgcccagctaatcttttaattttttttgtagagacagtcttgctttgctgcccaggctggtctcaaactcctggcttcaaacgatcctcccgcctcagcctcccaaagtgttgggattataggcataagctttcatgctcaaacaataatagacattttttattaatttagagctatagaacaataccactatgaatatttttgtacatgtctattggcttccggatgcaggaatttctttctttttttagaagcaaagtcagtgttgcccaggctggattcaaactccttggctcaagcgatcctccaacctcagcctccctagtagcttggattagacatgtgccacttcacctggctaatgtgcaggaatttctttaaggtatatacctaagaataaaactgatgaagtattgagtgtggccaccttccatttaataaatcataccagcgttttccaatgtgatttaacaatttatgttaccgttagaattatatgagggtttgaaattatcctaaatcctcatcaaaccttagcatactcaggcttaaatttttgccagtctaattgtcttcatctgtatgtgctgctataatggaacacttgagactggctaatttatgaaacacagaaatttatcttttataattctggaagctgggaagtccaagatcaaggaactggcatctggtgagggccttcttactgttttctcacatagtgaaaggcaaatgtgcaagagataacaaacaacactctctgtcaagttcttatataaggacccctaattccattcatgagggaggtgcccttgtggcctaatcaccccttaaaggcccatctctttgtactatgagattggcaacacctgaattttggagaggacccattcaaaccatagcactgtataatgtaaagcacagagagatacgaagtctcatttttaccatgttactgagtttatctcatgtgtgttctcaatggctatggttttaattacattttttatcaaactattccttttttctttttttgtgatggagtttcactcttgtcacccaggctggattgcaatggcatgatctcggctcactgcaacctccacctctggggttgaagcgattctcctgcctcagcctcccaagtagctgagattacagatgcctaccactatgcccagctaatttttgtatttttagtagagacagggtttcaccatgttggctggactggtcttgaactcctgacctcaggtgatccactcaccttggcctcccaaaatgctgagattataggagtaagccactgcacccagcctatcaaactattctgcctgccatttctttcataatttcttattctttttaaatagacataattctttgagcatcctaaacataattattttcaaagtctttattggattgttctatatattaattttatctggagagaattcaagttcaaagtatggactagtttgattttcttagcattaagttttttgaagtacttgggaattttggttttcaggcttgttttgtgtgaaacagtagttgttgttatcttccctctatcccataatcaaccttccctatctagaggatttgctgttaactttgctctagactttaacttgaggattttagaaatctctgcctcaaagtgaccttgtgaatactgcagattcggtcatcaaacaagcatgaggcttggtgattttcttctttcttcttagaaagcctgcaagtggtttcagttccctttactgggcaggagggtctccacacaccacagctcccagtctcacatggtgaatctgtctcctgtcctctgaattccttgattctcattacttttcaagacccaaagttcccctgtcactgtccatttctgcctgaaagccagcaggcacacggtgtcaatccactgctttctgtttctgttttgtttgagtctacagagctgtttatcttatttttgagactggctatgtctttttgtttttttctgttttatttataatcgccaagggttatggcagtacagtgttctactagattctaaattttctcatgaaatatgtcaagtgatgggatggaaaggagagattagatatctagtaaagaatacagtaagttcaagcattgatgaacccctcctttctcattgcaaattgtctcccatcggtggcagctgtggctaaaattagctgttttccctccttcctccctcattttccaatgctttaaaaatagagtaatgcagctgcatttaagatgcttaagacttaacttattttttcagaactcatttcaaacttttctcattcctggagcagatcatttggacaaaatgatatctcatttttgttttcattcttttgcaattacgtgcatatttgaactaagttcataatgcacatgattcacaatgcaaatgcaaaccacatttagaatcaagagacagaagataaaaggtctttggaaatgttgatagaactcttttctttaatatttccaaataagtatagaggtgtgttggaataaagatggccaaacatttttagactccacctctaatgacaagagtagcaatttgctctcccatggggtgtagactgtccttgtgtccctccttgaccagcagaataagaaggaaggggcactatgtaacttttgaggttgggtctgaagaaatctaaagctttcctattcacactcttccatacactcccttttaaaacccaagctacatggtgaaactccttggagaagaaccaaagctctctctgagctctctcagctaagctcctatccaacaagcagtcctagctattagctatttaaatacccctccttgacatttcagcccaggcaagcctccagatgagatcatatggggcagaaggaatgcccagctgagcccattatcacagagaattgtaagaaaatacagattgtggttgttttaagccactgagttttgagtggtttgcatcaaaacaagaggaaaacgaattctagtgactttggtatcttgccaaagcaaaattatatggctaattatcagatattcctatgtttatctttcaaaaaaactccacctcttcttgtacaatctagtaatatatattgagttcctatgttagggaactaattagaatttgtacatatctcttaattgtacatatcacttcaaaatatatctgaataagaaacctttttgtatttgacagttcccccagttttcaaacctattgattccctattagtttttcaccagaactttagaatacatgggagctgctctactaaatgttaaaacataatgttacggtaattaaaataatgttaacataagagtaaatcaatagaaccaagtaggagacactgatcagaaccccatcacatcctagagtttagtttgataatagtagcagttgcagttgtaatacatgttaacatgattctgagagaggagaaaggaagaaactggtcacgcaagcagttagggtgagtcttctgttgaattgtttcaaacaaaagaacaccccaaaacatcaagctaccggcacagataagggaacttgcatgggagattgcctaagacaggcccacagccacacagataagaaaggctatacagctcagtttcccagacatgcccacaatgaaaaattttgtcccctgacacatgcacagtaaggggaacaaagcaatatggaataactcaagctaagggcccccgtgtgcactaggaggatggggtggagctaccacagattcacaccttatgcaaatgagatgcccagctctcatcagtttcctataaaatcctctgcattcaactgtaaaaacagcaaccctcttccaggtcccccctgcacaggagagagctttcttctttcacttattaaacttttgctccagtgttacccttggcacctgtgctccttaactttcttggtcgtgagacgaagaactttgggtgatatgtcaggctatgagagactgctacgttgtggtgtattggtgagacataacaattcaatgtatgtacctaaggtaactgtagacctgtctagaaaaatgaaattaaaagctcatccctatcatatatatctcaaaaagaaaaattccaaatggactaaaaagtaaatgtaaaaacaaacaaacaaaaaagctctgcatgtctgctgcgctggttgttctcattcttccatccccacccctgacctctgatcttctctgccctgttctgtgttctgggggtctgtcctctggcttcaggctggattcactcaatggaaggcaccagcaagagagcagagggtggaaggaaagggggatttaggaaatttcttctccaactctcattgcttcaggtccaggttctggcaggggctgcctcctgcagtggctgcctctctgatgagactttctctcctggctgcagcccacactgggcaagtagttccattttctttcccttaatccttcatgctctggggggtaatggcatcccctctattacaggtctctgggtgtctcaccatttttgttcatccttcagtcctgcccacatctctataaataatcactttattgtatctttttaaaatccaagctgaatatgcattttgtttcccttcggtactcagggtgatatatctacctatatattcttctagggaagacttttaaaacaagcaaaaagacaacaaaaaaatagcaaaacatcaaaggaaattttaaaaaaaaattttttttatttttttgagacggagtcttgctctgtcgcccaggctggagtgcagtggcgcgatctcggctcactgcaagctccacctcccaggttcacgccattctcctgcctcagcctcctgagtagctgggactgcaggcgcccaccatcatgcctggctaattttttgtatttttagtagagacggggtttcaccatgttagccaggatggtctcaatctcctgacctcgtgatccacccacctcggcctcccaaatgctgggattacaggcgtgagccaccatgccgggccttttttttttttttttgtcgagacagagtcttgctcagtcgcccaggctggagtgcagtggtgcaatctcaactcactgcagcctccgcctcccgggttcaagtgattctcttgcctcaacctctccagtagctggaattacaggcacacaccgccatgcccagcttatttttttatttttagtagagacggggttttgccatgttggccagggtggtctcgaactcctgacctcaagtgatccgctgtgtcggcctcccaaactgctgggattgcaggcatgagccaccacgcctggccacacctggtaattttgatcagtttgcttaacccctctatgcctcagtttcttcatctgtagaatgggggtaattatggtaccatcacatacagttgtttggaagactaaatgagatgaagatgtagagtgaccaacaagcctggcttgtccaggcctgagtggtttctcaaaacacaaaacttacagtgctagaattgggacatcccaggcaaactaggagagttggtcactccataagatgtcaagtactcagcacaaagcgtggtacagaatatgagttcaataaatattagccattattttatatatttcaaatatgtatttgagcaaattcccagtcatgttttttatgtagtttaattatgtacatctctaccttatttaaagactaaaacataattttaaaaaataaaatgcttcattagtgaatcaatatcactgttcatttctaacgtctatttggttatttctaaaattctatgattctgtcttttttggttttcattttgttttgtttctgagacagagtctcgctctgttgcccaggctggagtgcagtggtgcaatcttggctcactgcaacctccacctccagggttcaagtgattctcctgcctcaacctcccaagtagctgggattacaggcacccaccaccatgcccagctaatttttgtatttttagtagagacggggttttgccatgttagccaggctggtctcaaacttgtgacctcaagtgatctgcccacctcagcctcccaaagtgctgagattacatgtgtgagccactgtgccccgccaattctttttgttgattgctctgtctctgtctttgcatggccaccttctccctgtctgtccctgtgtcttcacaaagtgttctctccctgtgtctctgttttcttattaggatgccagtcacattggattaaggcctaccttaattgggtgacctcatcttaactttattacatctacaaaggccctattttcaaacaaagtcatattcataggtactcaggattaggatttccaacatacctttttgggggacataattcaacctgtaacaccgtgaaagaccagctcagtttcttaacaagataattgggttagaattctttacttttaaggtactgcccaagcagcctgaacttctccagaagcttaatctcatgtttagcatgttgtctcacatgctacacatctctaaagatttcctccaaaccagtataaactcatgaagaaagacaatgagcctcaagttattctttttaaaaaaataatagctttatcaagatataatttacataccataatttacccatttgaagtttgcaatttgatgggttttagtgtatctacagaggtgtacaatatcaccgcgatcaatttctgaacatttctgttgcctcaaaaagaaaccctggacctactagccatcactccatctttcttcaacctcccctgtctcccctatcccccagtgggcaaccaccagtctattttctgtctctctgaatttccctattttggtcgtttcatataaatggattcatataatacatggccttgtatgtttggctcagttcaagttattcttctattttaaatgggtgaaagtctgacatgtgggtgggatgaatgagtgggaaccttgccctgaaaatcacttgcaccttgtaattatttcaacatggcctcacaaagagttatcacaacgtccctgcattgcgtgggcttcaacaagtgatgatgattgggttccgcgtgtgtagatcagctcctataattacatccaatgttgtagaacatgggtgctcttcaccccaagggccagctggtccattctgttgtagcatctcattggccagggcctccacctctcttaaggggaggatgtgtccactcagtgtccagcctggcaaaaggtgctctgtaatgtgcactcccatcctccatcccctccactaccaccctataggcccgtttcttgtgcagatggatccacattcttccaccaatgaagtggtgtattttcttattttgatttttctttttgtattttttttcttccacaaatgcctacttaccctaaagctgtacaaactgaaaaggccactcaggtcatcttttatagggcaaagaaaatcaaattctatccctccttagtggtaaatagaaaagcatgtgaggctacaaaaccaaacactggaaataggacaattactgaattcaacgaaattccatatatcatttagacacttcgttaatatttgttaactataggacttaacaaaattacagatatcccaaaggagccagactaaatataggctgacctggtaattttccagcagatgatagtatcactctctttgagagacaagggaaaaatacatttatacaagtaataatcatttttatctgatttattcctgttcttttctccaaacattatacaatgctatgttttataagtaacacgaagaaaaagatgtactgtttgtttcagaagggacattttgaaagaaaagaaatcaccatgtgtagaaggatatattttaacaggacttctttattcctttccaactcactgctcatcaccatggcatgtatactcctatttctatttttattccctttaggactgttcctagatatttgtaactagttctctatacctgtaagttttcatttgcccagggttatgtcttcttttattttgatttttcttcttgtattttcctcttccacaggtgttctttcattcctccctccccgcaccatgcttactttctgtcaacctacttctctttccttcattttctctctagcatttacttccttccagttttctgatctagagtcttcagtgcttgtgttatttcttggctgtatgatctaggatctgttatagagtgaccaaccatctgcttagccctacactaaaacccctcagtcctgggccaactaggctggttgatcactctacttaacaagttacctggggaaataatatattgacactaacgtagagaggatgagtgactggaatcagtagcatcctactatgttgctgttgctttttagtgaataatcattggaagagaatgcaaatgcaaaaaaaaaaacaaataggggttataaccgattattagcaagattctgatgaactgagggaccacagaaactaagtatgtgagtaaaacagactttgaagatgagtgtgagagactgagttggtcattagagccatcggctgtaaagtttgtgtgcagcctgaaccactgtgtgctgcactcaggagaaaataggatgccttctgcactgaggagtttggcttggataaaaaccattgtactgacaatgtagtctactccagagtaactgacaaaacagggggagacattgaggacataacaacatggctcttccttctcctgagaagcattgtcaaagctgagtagttgcaccagtttgagttacagcattggggaattcccccagaagctgagtgggagctctacccggggctcagtctgtggctgtcacttgtcttcttgcacagagcttacttatgagggaagtaaggggctataatccttggaaaacacaggcttcactacccttttcattcgaccattaaaaggaccattcctctttggatgtggagaaataggaacacttttacactgttggtgggactgtaaaccagttcaaccattgtggaagacactgtggcaattcctcaaggatctagaactagaaataccatttgaccaagcgatcccattactgggtatatacccaaaggattataaatcatgctgctacaaagacacatgcacatgtatgtttattgcagcactattcacaatagcaaagacttggaaccaacccaaatgtccatcaatgatagactgcattaagaaaatgtggcacctatacacgatgaaatactatgcagccataaaaaaggatgagttcatgtccttcgtagggacatggatgaagctggaaaccatcattctgagcaaactattgcaaggacagaaaaccaaacatcgcatattctcactcataggtgggaattgaacaatgagaacacttggacacagggtggggaacatcacacactggggcctgttgggtggggggaaagggggagggatagcattaggcaaaatacctaatgtaaatgactagttaatgggtgcagcacaccaacatggcatatgtatacatatgtaacaaacctgcacgttgtgcacatgtaccctagaacttgaagtataataataaaaaaaaataaaaaataaaataaaataaaaggactattcctctttcatcttcagattgtctttggacatgccaatctccttggtaagaggtgatgctataatataagtaatccctgctaagatgttattaggccagacccctattgactgcaataaagataacaccatgtcctggagaccaaaaaaagagaccaagagacagtgaatgagatatagtgcttatataggggaattacatacaggaatggtccagttgtggtgggctggaccggaaaactactaccatgtgtaaaaagcatgcagcttccatagcattttcacttagtaccctctacctagcaacctccagtttgcaacctccaggtaacccaaaacaaagggcctccatctcctgtatggcctgcattccaagggaagggctaggggttgagatgcccttcatggataaggagtgaatctctaggttggccactcccagattccttagcctggaactctgaacacacattcttcttagaccatagggccattttcagggtattctcaagttcagttactgctgtcaggtgtgtctcccatatagctgataattgatgacttaagctatttttagaagtcatatgaagaaaggatcagtagtcccttcacttgccctgtgagagagtgtgtcctgctttcagagacacacaatggccatttgacaaatttactaagaccattctgaatacatgagaaattatttcataatacacccattctaatggaaagcatagaactgtgagattatcaatggataaaggaagtagaatttacgattcccaagtagttatgtggaaagtcagactaagccattcttccttgcctttttcatttggcaaactgccctgagcattcactatgtactgagcaccctgcttggtgttgcagataaaaatatggaaacagtatgattcttgacctcaaggcacttatgctaagacttctagaatggaacatacgtataaacaaagaaccgtaatgagggttacaagtgctattgtataatcatactcagatcacaacgtaggtactaaaaaaggtgtggtctgctaagaatgatggtttccagcttcatccatgtccctgcaaaggacatgaactcattcttttttatggctgcatagtattccatggtatatatgtgccacattttctttatccagtctatcattgatggtcatttgggttggttccaagtctttgctattataaatagtgctgcaatatatatacatgtgcatgtgtctttatagtagaatgatttataatcctttgggtatatacccagtaatgggattggtgggtcaaatggtttttctgattctagatccttgaggaattgccacactgtcttccacaatggttacttctctctgagccaggggagggtggctgtggtctctttaatgatctagcctactatatcttgagggtaaagtctatgactgtggtcactttattcatcattgtatctgtaccatcttgcacatagtaggtgctcagtgagtagtatttaaatgagcaaaagctgatgttgtcggagggcatggtgtacatgaagcaatgtaagcagtttagcccaagagtcaagatcctgcatgatcaggccctgattccctcgccagcttcatctcccaagcactgctccccttctgccatgatgaacagtttgagctttatcctgggtcagtggggacccataggagaagtttaagcagggccatgatgtgacaagctttgtgttttagaaagctctggctgccgtgtgaaggattgactacagagggcaaccctggagctaagaagatcattcagttctgtagtagttcaggtgggagaatgcacctaagaatcccctggtgtttgtccagggcccaccccaggccatttaaatcagaatctctggtgatgggatctaggcatcagtagtttctaaatccttccagatgattccagtgagaaaccaaggctgataatcactagtgtgaattaagagagttgcagaatggaaagggggctatagatgcaaaggctgttagaggtaaggggacagcatgcctagctaacagagcagggccaatgaagaaaggggaggaattgaattattcacaagttctgattggagtcattgaaaatgggaagtagggtgatcaaccttcccattttgccagggactatcacagttctcttactgaagatctctcattctgcaatagttcgttactgacatggcttggatctgtgacctcacccaagtctcatgtcgaattgtaatccccaatgttggaggcagggcctggggggacgtgattggatcatgggggcagaatcctcattaatggtttagcaccatccccccttggtactatatagtgagtgagttctcatgaggtctgatctccctcctctctctcttcctcctgctccagtcatgtaaaacgtgcctgcttcccctttcccttccccttccaccatgattgtaagtttcctgagacctccccagaaacaaatgccagcatcatgcttcctgtacagcatgtggaaccctgagccaattaaacctcttttctttataaattacccagtctcaggtatttctttacagcaatgtgaaaacagactaatacaacagggaggatggtagtaccattcaccaagataggcaatacaggatcagagtgtggttgggggaaaggtgattaattttaaacatgtaacagctgctaagtattggtgactaatgccattctaagctcacagctgaggatcatatgagttaaatcccccacattctaaattcctagaaccacagctgttggagtgggtcagccacaccctgacaaggtttgctaagaggaaccaggaagcagaaccagcagcaacacctctcaccctaatataaagtgagactgaaagggagaagactgttgccttttgcagaagtgcagtgctcatttaggatgatttactcccaagaacaagggtagggggtaggttgcctcccatcctcaaagccaagggtaagagctgtcgagagaaccactcacaggtttgtaagtatctgatatgtgctacctgtctgaacagctgaaggatgctaggctcactgtccagcccctgtgccaccacagtagaggaaaaaatacattgggaagagatggcatgatggggggctgccaagcagggcaggggtcgaaactgtcttcacttgaagtcatggtgtcctggaggcttgaaaggtggattccacaaaagcctgaagacccaggagttggctgtggtgagtagaccatatttggagtcttggtcttgtctggctatgctgcaatattgggcaaagaggggcacacatcagaggaatgggacataaggccaccagctcgagggctgggcttgaagttgagaatgaatctcttataaggaacccctagcatctagaattactggttgggggcaaatcccctgtctgaagatgttgtcttccttcatctgtccacactaacacaatggcaataagctgggtctcacggggcacctctcccttccatttttctcctccatggtcattaccagcaggaggtatggtagacttacaagttgtgtgtgacccagatcacatctctattctgcagggcataggagaggaggagagagccatgcattggatatgaaactaaagctttaaaataaaatcattggatcttaagaataggaagtcttttttttttttttttttttttttgagacagagtctcagtcttgctctgtcacccaggctggagtgcagtggcatgatctcagcttactgcaacctccgcctcctgggttcaagcaattctcctgccttagcctcccaagtagctaggactacaggcacccacccccaagcccagctaatattttttatatttttagtagagatggagtttcaccatgttggccaggctggtgacctgcctcagcctcccaaagtgcaggagccaccacacgtggccattttttttttaacagctagtagtaactattctaatgactaaaagtgaccaagacatgatatggggctgaaattattaaggaagtctgctttacatagaaaacaggattttgacccagcagtcattgccatgttgtgggcaactttatagagaggccaaggtagtgagagactgaagccttctaccaacagcaatgtggaccccagccccttcagatgtgacagcttgactgcaacagcataagaaaccctgagatggaaactgaagctaagatactcctggattcccgaaccccacatattgagagataatagatgtttgttgttttaagttgccagttttggggtcatttgttatgcaacaatagataaccagtaattgtcctgagttgggccaaggggaccagacctttacatcggactcattgattagtcgttggatgcaggctgtgccggaaggaagcgtgactctggacgaggccgttttcttcagccaaggcagccccccagaaggcagtcagctgaaggctgttttcgggcaacattcgcagcagccgggtgaccaagtcctttattgctaaagaggagggatctgggcagttcatcaagtggttagtgggaggctcctgtgggtctcctgaaagaagtttctctacccaattaaccaccttagcccaagatgtcaccagccaagggagaaattggagtttgaggagcctgggagccatgcttcgtcttctactttcctcctgaccactgctctctttttaaatggtggtgtttcactgggctttatccttgactccctcctacatctgtaggaggggatgtagggagagcagtgtccatcaggttgaggaagaagagggcattaggaagacagtcgtggtcagtgagtgtttgctgaatgtattggttggggtctaaggtgaaaccagacagcacacacaaggcgagtggcagaaagtagcttaacaaagggactccttacagaattgaggtcaggggtgaggggccccaacagggaccacaggattcttccctcctctaggcctggggggtgtgagagcatggagtgggtgccagcacttggagagggccatcttcatggagaaatctgactgttggatgaagccatggccttcagagaggaacacaggcaaccgaagtttggtactgcccataagtcatcctcacggggcacacggcagggtgaaggagggcaggaagctcatctgcaagggcaagaatgaaagggagtcagcagacaagagttagaaatgttcggccaggcgcagtggctcacgcctgtaataccagcactttgggaggccgaggtgggtggatcacctgaggtcaggagttcaagaccagtctggccaatatggtgaaaccccatctctactaaaaacacaaaaattagccaggcacagtggtgggcgcctgtaatccccaggtacttgggaggctgaggcagagaattgcttgaacccgggaggcagagattacagtaagccgagattgcgccactacactccagcctgggcaacagagtgagactccgtctcaaaaaaaaaaaaaaaaaagttcacgactgatctcccttttaatagcaatttaaaatgtgaatgtttgggtacactcctaaactttaaggatgatatcagagaaactagtactctttttctgtaagtattcctggtgccactgacagatcctagctaaagagaccactggtctgattcagtggagtattactttcctaggaaattataaagttccctaggacactgtaattggctgtgtcagtgttgatatgctagctgtgatagtgtactacagttttgcaagatgtcaccattgtgggtaaccagctaaaggatacaagctatctctgtattattttttacgactgcatgtgaatctgtaatcatctcaagattaaaaatgtaattaaaaattaattcacttattctacttgaaggaactaagaacatgctactccaaactatgctgctctggtatattggctattttgtgtttagggactgaataaaacagcaggacaagaggatcactcagcccttccttttatttttttgaaagcaagagatgaaattcccatgtgaaagatgccctccttataccagaaagaaggtattattcttatcatcaaggataggagatctgtactaatgaaacttgttaaattaatccttattttcctagtcacttctctacccagttaaccaccctagcccaagctcctttaccttgtcacattttaataattcatgactctttgtctaattcagtataagtgttcaattctgcatctttgaatcttcatttccttagccatgtaacatgtgtattacatttgtatgcttttctcctatgaatttgtcttctgtcaacttaattcctaggcccaaccaaaaaaccctaaaaaagcagaggtcaagttttactctccctacacgcttatgataattaaatgtgaggctttaaacttcgatgtagagttccccagtaataactcaactacttagtattctaattttaccggaatgaaatctttgagttacttgatctgctatgacttgaattttatttctgtcaaactcggctgtcgttgccttgaataggaagaataaatccaaagcctgggagagaggcctgagtccttgcaaagccagtaaacaaaatcgtaattggatctgcctcatgtgcacacagggttttacctctcctgttgatcttgtggtagaactcctctgcatggtgtgctgttctcctacagacagatttggagaacttacatgctgttgttcttgaacaggcttttcagttcttagaattaactagctcatgtatcattagaacaaagtagtaatttaaaaaataaatctacattaatgggctatttggggggaacaacagctgctccaagatcacagaggagaagagggtgttaaaacacccaatcctaaagatagttctagatcagaagcttgatgactaattcaattaaaatgagtgtgtgtctgttggctgcataaatgtcttcttttgagaagtgtctgttcatatccttcaccaactttttgatggggttgtttgcttttttcttgcaaatttgtttaagttccttgtagattctggatattagccctttgtcagatgggtagactgtaaaaattttctcccattctgtaggttgcctgttcactctgatggtagtttcttttgctgtgcagaagctctttagtttaattggatctcatttgtcaattttggcttttgttgccattgcttttggtgttttagtcatgaagtccctgcccatgcctatgtcctgaatggtattgcctaggttttcttctagggtttttatgagtttaggtctaacatgtaagtctttaatccatcttgaattaatttttatataaggtgtaaggaagggatcctgtttcagctttctacgtatggctagccagttttcccagcaccatttattaaatagggaatcgtttccccattttttgtttttgtcaggtttgtcaaagatcagatggttgtagatgtgtggtattatttctgagggctctgttctgttccattggtctatatcttgttctggtaccagtaccatgctgttttggttactgtagcactgtagtatattttgaagtcaggtagcatgatgcctccagctttgttcttttggcttaggattgtcttggcaatgctggctctttttcggtttcatatgaactttaaagtagttttttccaattctgtgaagaaagtaattggtagcttgatggggatggcattgaatctataaattaccttgggcagtatggccattttcacaatattgattcttcctatccatgagcatggaatgttcttccatttgtttttgttctcttttatttcgttgagcagtgctttctagttctccttgaagaggtccttcacttcccttgtaagttggattcctaggtattttattctctttgaagcaattgtgaatgggagttcactcatgatttggctctctgtttgtctgttattggtgtataagaatgcttatgattttgcacattgattttgtatcctgagactttgctgaaggagatttgcttactaaggagattttgggctgaggtgatggggttttctgaatatataatcatgtcatctgcaaacagagacagtttgacttcctcttttcctaattgattaccctttatttctttctcctgcctggttgccctggtcagaacttccaacactatgttgaataggagtggtgagagagggcatccctgtcttgtgccagttttcaaagggaatgcttccggtttttgtccattcagtatgatattggctgtgggtttgtcataaatagctcttattgttttgagatacgtcccatcagtacctagtttactgagagtttttagcatgaagggctgttgaattttgtcaaaggccttttctgcatctattgagataatcatgtggtttttgtctttggttctgtttatatgatggattatgtttattgatttgcatatgttgaaccagccttgcatcccagggatgaagccaacttgatcgtgttggataagctttttgatgtgctgctggattcggtttgccagtattttattgaggatttttgcatcaatgttcatcaggtatattggtctaaaattctcttttttgttgtgtctctgccaggctttgatatcagaatgatgttggcctcataaaatgagttagggaagattccctctttttctattgattggaatagtttcagaaggaatggtaccagctcctctttgtacctctggtagaattcagctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcaattcctcaaggatctagaactagaaataccatttgacccagccatcccattactgggtatatatccaaaggattataaatcatgatgctataaagacatatgcatacgtatgtttattgcagcactattcacaatagcaaagacttggaaccaacccaaatgtccatcaatgatagactggattaagaaaatgtggcacatatacaccatggaatactatacagccataaaaaaggatgagttcatgtcctttgtagggacatggatgaagctggaaaccatcattctgagcaaactatcacaaggacagaaaaccaaacaccacatgttctcactcataggtgggcctgtggacacaccagggcctgtcgtggggtggggggattggggagggatagcattaggagaaatacctaatgcaaatgacaagttagtgggtgcagcataccaatatggcacatgtatacatatgtaacaaacctgcatgttgtacacatgtaccctagagcttaaagtataataaaaaaaattgaaattataagaatgtatacaaacaaaataaaaatgaaataaaataaaataaaatgagtgtgtggaatatgtaaagtctccaggtatgtttttacccccagatttttttttttcacaaacttaatacatggggctgggagtggaggctcatgtctgtaatcccagcactttgggaggccaagttgggaggattgcttgagctcaggagttaagaccagcctaggcaatatggtgagaccccatctctttaaaaataataataataataatacattggtaggctaaagttgcagaacaaatataattcttggtcctgtatacaaaagaaccctcagtgatagtatgctttttattcaaatccttgaagatcaaggtttaagtagttttattttagggtaggatgtgtttcatgcagcattaattttattgtctttttttaaaaaagcatgtaattggtgtagtcaggactgaaattttattcgtctcctcagatgaaagtagtatcttattaaacagccctagaccaggaaatacaagggcattataatgaataattctaagctcattatgatctcagtgaataggttcagattcagcacaatactagaactgatgtttattaacactgatggcacaaagtacatgtctgatccacttcaatggagtcattatttagtgtgacactgcactgccaaatgcagccatgtttgtggaaagacaggaagttgtcacagggccaggagcagtggctcacacctgtaatctcaacgctttgggaggccaaggtgggaggattgcttgagcccaggagtttgagaccagcttgggcaacgtagtgagacctcacatctctaacaaaaaaaaaaaaaaaaaaaaaaaaatagaaaaaataaaaaaaaaactagaaagtcattacaacaaaattttatgccagaaaatgtactatcaagacccatagacatatgtaaacatggtctctttcctaggcatggacacttatacctttatcacctaagaaagatgaaggtctaaggcagaaacacagctcctttattagctaaaacgtcttgtaacatcagacgccttaaattatccactaattacatttaaataaaaaatgtggggacaaattagctttaatcgaattaaaatgaaatttctagtgcagctagatggctgttttgctagaatctgtttagctgtaaattccatttagagttgttaatagtattcctcttcaactctgtttaacccacccatcatcatggtgaattgccaaatgtcttacaaggtagaataaatattcttggacctcttttcaggtcaggcatcattggaaatttctccttttcactttactattatttttgagacagagcctcacacaggctggagtgcagcggtgcaatctcagctcactgcaacctctgccccctaggttcaggcaatcctcccacctcagcctctcaagtagctgggattacaagtgtgcaccactatgcctggctaattcttcttttcttttctttttttttaatctttttttttttttttttttttttttgagacagagtttcactctgttacccaggctggagtgcagtggtgcgatctcggatcactgcaacctccacctcccgatttcaagtgattcttctgcctcagcctcccaagtagctaggactacaggcgcccactaccacgcccaggtaattttttttttttttttttttagtagagacggggtttcactatattggccaagctggtctcgaactcctgacttcatgtgatccgcccgccttggcctcccaaagtgctgggattacaggcatgaaccactgtgcccggcctaagtttcccttttttatttaccagtcctgagctgggttcacaacctgaattaagtccttgttgtgcaattgtgtgatgttatgactttgctgagcttcaatttcctcatctgtaaaatgaggataatgttgcagcattcagagacaacatatataaggcacctagcacagaacctgcccacagtaggccctaaatcaatggtagtcaacatcaaataaagctgattaaccagcttgatttgaaacttatttctactttagataatttcacaataagtctgagacatgctgtaacaaattttcatgcctctccttcataaacatgaatgacatgaatgaagcaaaacgaacatttaggcctcggttttcacagataaaagactaggtagtgacctctagtggtaaacaggcaaaatgcctaaaggcgatacattttctcccttacttaggattcagcctgaaattgatcacagaagtgcaatgtaaagctatgagatcaaatgtaattaatacttggataagaatttagccttcatgccattctgtaaaacaatgaaataaaggaaaatgtccttgccttctgttatgccaaaaattgcagtttaatcatatgagtaacaaaagaatcggggccaggcaaagtggctcatacctgtaatcccagcactttgggaggccaaggcaggcaaatcacttgagcccaggagtttgagaccagcctgggcaacatgtgaaaccccgtttctaccaaaaatacaaaaattagcctagccaggcatgatggcatgtacctgtggtctcagctacttgggaggctgaggtaggaggattgcttgaacctgggaggttgaggctgcagttagccatgatcacacccctgcactctaacctgggtgaaagagcaagaccctgtctcaaaaaaaaatcagagccagaaaaaaatcaaattatatttgatttttttgacaaatatgagctattttgattcatttttgcacaaatgaccagatgttacattaaaatttatttcagtagtaccttaagtggaattataaacttctttccaagtacatagagtagttcataatggatcattttgcagaatttctgatagtgtcgtaaaaagaaaatgtgctgtaggatcttcactgatgacattgtctaagcactagttattacttacagagcttgccttcactggacattagcagggctggttcccatccagcttctgaactcttacaatctccatttctgccaacattactgctcgtgaaattcaatcagtacagtataggatggtggttaagagcatgaactctgaagccagactgggtttaaatcccagctttaccatttgttgactatgagagattgatgcctcagtttcttcatctataaaacatcagtgttaataccagctaccttataggtggttctcatggtggattaagctaatatatagacagtgattagaacagagcctggaattattattgagcagatgttatgcacctataccattctagggactatagagaatgcatccaaagctgaaaatccaggccctgtcctcaagaatttatagttgacatggaaagatcttgctagaggaatgggccttcattccacttgttggtttgcaggagggggacttttttttttttaaacatatgcctggcttcttatgtccctattcttgttcccctgcaagatgtggagcaactttcttggagtgaagtggcattgggcgcagtcccacaaggaaaaggacacatatttttgaatgcagttaggaagtatgtttggcccttactctatagtatatcctacaatttgcctccatcaataataaaggtaataacctgggttctgggggtcaactaccggttatggttcatttttttcagaactcagccagaagtggcaaactatttactgaggagacacttagagaccccacaaaacacaagagccattcagcgccaacttctatggtgtgaacctactataaaagcatttccagaaatgagaatttggtgtagactgaagcaacaggaattgatttcatggaagtgggacttaagctggttcttgaagaatgagatagaatttggatggggagaaggaggaaaagcaagagcccttctgcaagcaaagcaattttttttgaagtttgtacttctatgtaattgaaatatataaaatattgattaaaattagttatattcctgtttgatgacacatggtgacctagccaggctgtggtggagaaatagatgacataggtccttgctgcctgattttttagtattatgtgacccaattgccaggaatgttctaagcactttgcacatattgagtcacttactcctcacaacaactgtatgacatagacatcatctcctccactttacaactgaggttactgaagcatagagagtagttatcagcctaatgtcacactgccagtaagagacagaactagggttcaaacccaggtagtttgacctgcatcccattctctctcatcattcagctttacgatttctcagtccaagggaagaagttgggtggtctctcttgtgaaggaaaccagtgaagagaccagagtgatggcttggactttggaggctgccacataaagctgggaggtagtgggggctcatcaatggagggtttggaaagccaagcacaggaacttggctgtggagaaagaaaaagaagattcatctttctgtgttcctgaccaagaacaattccatactgttcattgcattaattccaaagatttcaagggttccagtttggtagactggacattatgtacatatgagaagagggtaaaacaaaaacagaactggaccctctatgcatcccctgggctgctgctgggaaggcacatagctgaaagtggaaacgtgttctcttgtcctttttttccaagcacctgcctagaagacaaacaaggctggaggtatgaatttgaggtttcacctatatttgagagctgaaaccacaaaatgttaaactccctgggaaaaaagtcactaaagaagcagaagagaaacaccaacagaggagggcatatggacagcacggtgctgtggaagttactctgcataatttaagaaattcccagtcagctacttcaaagaggtggtagaagatgagaactgggatgaagccaggaaatttaacaatgagcctaagaatgttgaagagaggaaatgaaacttggctctgcccttatgatgctattgcatagggtcaaaaaaggcatgtctggtttatgtgagcctcctcactgtttcccaccctcccgggacataaggcccctttcaagttggctgggatgggcatgggagtgaggaactgagtcctcaagttacaaagttggaattcctttttatgcattaggcttggctccttggtaccacaccttagccctctcccatgggctcttcgcacacctcctactctcctgatctttgatattccctctgctgtcagctggatttgcccatgtcacaggcagttcagttcctggtgaccacccctgtccagctgtgaccttcaagaggggccctgccccatgtctctctcagctcctgcccgaccccagtctggattgtcgcactccttccaggaagcattagcctctcctccttgcccctctggctccttagagctactctgccacccccaaattaccttggaaaaggttagctgtgtctgcatacttgttactttgtgcatctgctggccttctgctcaccccacagacagggtggtggacacacagtaaggtgacccccagggagtcctgcccttgtgtagtcccttcccctgagtgctggtagaatctgtgatttgcttctaaccacaagaatatggcaaagttgatgagatgtgtgatatgattttatatatatatatatatatatataaagcatgaaagtcatagtttctggctgataactcccatagccctcttgttatagcctttttggctataacaagacattggctggggcattttaggcctcaggaacaggcctcaggaaacaatctctctctgtctctctgaacttctttcctcctttcacctgtccaaggcaagtcaaaagaccctcattccagaaagcgtgccccatactctgaaggaagcaatgctgcacagaggccaggaagaatctcaacagtgggtcttactgggtttccccgctcagcctatttgtatgcagtcatacccttttcgtccaatcacatttctgcactgttgtcaatcatgcctatgtaatgaattctcttttaaaacacaagagggccgggcacggtggctcatgcctgtaatcccagcattttaggaggccaaggcaggtgaatcgcttaagcccaggagttcaagaccagcctaggcaacaggtggaacctggtcctacaaaaattaccaaaaaatagccagatgttggtggcgggctcctgtaagtcctaactacttgggaggctgaggtgggaggattgcttaagcccaggaggtcgaggttgcagtgagccatagttgtaccactgcactccagccttggtgacagagtgagaccctgtctcaaaaaacaaccccacaaccgttccccgccaacaactccaccacacacaagaggacagggttcagagagcttctgaagaggtgaccacgtggaggttcctggagggtggtatacctggagacggccttcaagctttgtaccccttcccctataccttgccctacacacttcatctatatcctttgtaatatcctttataataaatgagtaaatgcaagtaagtgtttccccgagttccgtgagccactctagaaaattaattgaatcctgctggactcagtggctcacgactgtaatcccagcactttgggaggccaaggtggatggataacctgaagttaggcattagggaccagcctggccaacattgtgcaatcccctctctaataaaaatacaaaaagtagctgggcatggtagtatgcccctgcaatccctgctacttgggaggctgaggcaggagaatcgcttgaacctgggaggcggaggttgaagtgagctgaggtcgggccactgcactccagcctgggtgacagtgcgaggctccatcttaaaaaaaaaaaaaaagaaaaagaaaattaattgaaaccaaagagggggttgtgggaaccccaacttaaatctggtcagccagaagttccagacacttggactggcgattggtgggactgagccctcaacctgtgggatctgacacaatctccaggtagacaatgtcagaactgaattggaggacactcagctggtgtccactgcagaatctattgtttacttgctggtggagagaaatccccacatatttcggggtcatagaagtcttctgtgtttattgtgttgatatgagtagaggagtttggcttgagagatttttccaaacaggatatcattcccttgatcaatttcattatagaagactgtctaaagtaactagagagactttcttgctgctaatttttgtactttttgtaaagacagctctcactgtgttgcccaggctggctcctgctcttgagtgatcctcccacctcagcctcccaaagtgctgggctaacaggcatgagccactgtgccctgcccttgctggcttgttgtttggggctgccatcagctcctagaagccacccacagttccttgccacatgaccctctcacaacatggcagttcctatcttcaaagccagcaagaaagtctctctagcatacccagcaagaatgtatagggctgttcagggctcacagtagattacctttctcaacagatggagtagggggtgacttaaagtgtgcataatctttaaaaattagcattttccatttgtactctctaaatttgggttagctggatccaaaccccatgattctgctacatatgggatcccagtccacctatctctagcatacttcctctattaatcattctctcttgacatttgccacctcattttagccagctgtgcttgttttcacttatgttattttatgagcagtgcttattttgacagcagcatacatagtggaatgatggctggttctggcatttaaaaagctggattcacattcaagctctaccatttgccaaataagaaaccaatactcccatcagccaactcaagtagtaaagttggaatagcatagtgcctttgattttttcccttacaggggtgtagtagtgaagggtatgtaactcaaaataatcttcttgaaagtcaagcttctcctcctttccccaaaacttgttccccacctgaattctctacttgttacagtcaccattcatccatcccgacctcctcctcttcatacctttgcatcaaggcttgccagttttaccttctaagcattgttcttctgcccttttcttgacctcccaactgccattgtctatctttatcatgtgtcaatccagtagttccctgaagtagcttctagcatcatgctggccaccattctatgatgtcttactactgcctgagcttgtcatttctctcatttcaaacacctttcatcctcatacagtccaatttccttacacatgtttttgccttaattccttctacatctcaccttgtgttgttttacactgtaatattacttatttcttgtatttcctaatatccaccatggcatttaacattttttgtgtctttgatgctcttcctacctggaataccaatcctgtttttgactaattccaactcatttaaaaattttgatcagcatgggacatggtggctcatgcctgtaatcccagcactctggaatgctgaggcaggaagatcaactggagaccagcctggcaacatggcatgacccccatctctacacaaaatttttttttttttgagacaatgtctcgctctgtttcccagactggagtgcagtggtgagatctcagcttactgcaaccgtcacctcctgggttcaagcgattctcctgcctcaacctcccaagcagctaggattacaggcatgcgccaccacgcccagctaatttttgtatttttagtagagacggtgttttaccatgttagccagggtggtctcgaactcctgacctcatgtgatccacctgcctcggcctcccagagtgctgggattacaggtgtgagccaccatgcctggccacaatttttttttttttttttaattagccaggcatggtggtgcacacctgtagtccaagccagctgggaggctgaggtgggagtgttaccaggatgtgtggagtcctctgttcttagtcttcttgggagaagaaatttggccaagagaccaattagtaaagtaaacaaagacatattaaggaaataagaatatgctccaagagaggagtgggctgaccctgctgggagcagtagtagtagcagtctgtttaaagagatagtatgctctgaaagaaaagtcagagtgggctgctggaaagagaatgagccagcagcccctagggttctgcattgagatttttgttatgttgggactgtttctttaagttcccacctctgtctcaagtctccacctctatctttatctagcttcccccttctgcattaagtccctgcttttttcctgcctagttcctgctctaggtttatgggattctcctttactggtagttaaggcacatgcaaggactggtgttgggtacaatcctaatggcagctttgcttattaccctctagcgttgccctctaggaaggtcatatagcagttatatgtgtacatattacccctgcatatctctcagactcttagaaatttcccctttgcccttttttttttttttgagacagagtctcaattgtgcaggctggagtgcagtggcatgatctcggctcactgcaacctctgcctcccaggctcaagccattgacctgcctcaacctcctgagtagctggaattacaggcacttgccaccatgcccagctaatttttgcatttttagtagagacagggtttcaccatgttggccaggctggtcttgaactcctgaactcaggtgatccacccacctcggcctcccaaagttctgggattacaggcgtgatccactgtgcccagccatcccctccttatcagcatgtggctagctccattctgaccgattagctgcagcgtgagtgattactgggcatcttaagagttgttctgaggtgtttcttcgtgcacaggtattttccctcctttatgctcatatctagcatgcagatttccagtggtctctgaggtgtgagattttccagacctccctttcttcaggctccccctcctgctcatgtctaggtatctgcctgctgtaacaggagaactgcttgggcccaggagttcaggctgcagtgagccatattttggggtgaaattccctgtgctccctcagtatgtccacataatgggatattatgttgctataaaaaatgagaacactctattaattgggtccaggacaagtcacgccaaaatatgactttaggagaccagaatatgccaggccaaaatatgtctctttaacataaggattattttgagctgttattttgagaaattgtagacacagtagaggctctgaaaagttatcctgtgtgagagaaatttacatctatcaaagaaatctccatttgtgagactgtgtccctgtctacaccaggaagaggaggacactagatcactagactcttaatcaatggagaaggcattgacttaaatctgcatagcagaacttacctttgtttatggtgcttttcctggtcatcttgtcatactgaaactgctgttgcaaaattataactgagacagtaaaagagatctgacctaactaactccatcttgcttctaacctccaagctgtccttgtttattcgtgggtgtaggccaaactaacatcaggagaaacttagtttataatttaaaacaaagacaataacagccctttcccaaaacagacctgctgagaccagctcggtcggggagaccctaactcagcagcgctagaggaattaaagacacacacacagaaatatagaggtgtgaagtgggaaatcagggatctcatagccttcagagctgacagccccaaacagagatttacccacatatttattaacagcaaaccagtcattagcattgtttctataaatattcgattaactaaaagtatcccttatgggaaaggaaggaatgggccgaattaaaggaataggttgggctagttaactgcagcaggaacatgcccttaagacacagatcgctcatgctattgtttgtggtttaagaatgcctttaagttgttttccgccctgggtgggccaggtgttccttgccctcattccagtaaacccacaaccttccagcttgggcattaaggccattattaacttgttacagtgctgcagagattttgtttatggccagttttgggggggcttgctcccaacatgtctcccttctttgatttgcagagagataaaagcaagggcagctttgtcacggtaagctacttctcgcaggagtcaggatccgcacctgcagactatacaaagacaaacaacacagattaaaagcacagtcatcattgaaatcacagagcttccaggtgtttttatccattttaatgggttactagctgctaatttgtctgcagctcctttaagcactccagttcctggcattaacatcaggtgtgccagggatgctttaaatatttgttcttttaattttgctatatccaaaaacaagtttgtagagtctccttctagaagcttttttattctttcccaaattttgatcttattaagagcatttaatagtttccacaaatccttatgtttagctcctacagcggaccatatcatttgagtttgaggtgccactataccgccatgtttccagataataggaacttttgccgtacttcttatcatttctaccatctgaccattttgttcagatcatctgaacacagtgtggccatggcacgcagactgagagtgcaattcaagctaaatatccccttaggggatcaattaataatgattccataggaattgttgtgcagcacctctgctggttctgaaaagcaatcttcctaaacaactactttcattttttctaactgggtccaatcctgtttacaaataggtttttgagggcagtatgcctcaattataggagcagatttattatggtaaatactgagaccagaaagcatgtgtaattctcatacagtgattgcatccaggcattattaccagcccttattgaaggaatactcacagtagtggtgataaccactatcatagctaccattaaattattcattgtgactggttgtcccactttcctcaagttttcttccaccatctgtgacagcttcttgatctgcccccagatgggtggctgtgttcgacaggtgttgcttgtgacagttggggtcctcctcagcatcagtctcgacatggctgcaaccgaggggtccttgggatcctcccggaatctcttcctcagcatctggctcatgataaggtttcaggtgtcttgatggtatccaaatcggctgttgattttggcctggagaaatacaagcataaactctaccccaagttattattttacctatttcccaactttttgttatcagatctctccaacaaatcagttgttctgtttctgtctttgcagctggtttctgtagatgctgttcagctattgataacatctggcctttgggcaggctcaaaaaatttaaagttaataatgctaggttcagttgcatctgtgctgttccatattctctgtctcttcctttctgcttttgcaactgctgttttagggagagatttattctttccactatggcttgtccttgagaattgtatgggatatcagtaatgtgtttaatattccacatagagaaaaatgtaactagagcttggctattatagcctgggggcattgtctgtttttatagaagctggaatgcccatcaccgcaaaacaccgcaaaagatgacgtttaacacaggcagaagactctcctgtttggcctgtagcccagacaaagtgagaaaagatgcccacacatacatgtacgtaagctagtctcccaaacgagggaatatgtgtgacatccatttgccaaatagagttagattccaatcctcgaggattaactcctcctgtgaaagatgaggaatgtaccatttggcaagtcgggcatagctagataatagctttagcttctttccaggtaatgctgtatctgcatttgagaccagaagcattaacatgggttaaattgtgaaagtgtctagcattagatattgcagtagcaagtaggcaatcagccatttgattcccttcagtcaaaggtcctggaagaggtgtatgagctctaatgtgagtgctgtaaaaagggtgcattctactcctaactgctgtttgcagttgggtaaataaagtcatcagttgttcatctgtatgaaatcgtaactgagcattttcaattaactgtgtggaatgaaccacgtatgaagaatcggaaatcacattaataggcatatcaaaagcagtcaatacctcaattacagctacaagctccgctttttgagctgaagtacaggacgtctggaaaactttactttttgagccaaaataagaagctttaccattactagacccatctgcaaaaacattctcagcaccttcaattggtttaaatttagttattttaaggagaatccaattagttaatttcagaaactgaaacagcttcgttttaggaaaatgattatcgagaatacccacaaagtcagctaaatgggtttgccaagtaagactatttataaaagctagttgtatttgtgccttcatgagagggacaataatttttccaggatcatatccatgtaattaacaatccaagttctcccaatccctatcatagtagcgatttgatctaaataaggagttagagtccgtgaattagtatgtggaataaaaagccactctactaagtcctgttcttggacaataacaccagtaggtgaatgctgagttgaaaaaattagcaaatctagagtcttctctggatctattctatttatctgagctttatggacttgcttctcaatcagttgtaactctgtctccgccttctttgttaattgccaagggctagtgagactaggatttcctctaaggatagaaaacagattactcatggcttaggtaggaaagcctagagcaggtcgtatccaattaatatcccctagtaatttttgaaagtcatttaatgtttttagttgattcctacgtacagttactttctgtggcacaatggtggtgtcatttactaaggtccccaagtaggagtaaggagtagtagtctgaattttgtcaggagctataactaaaccagcacgagaaattgaattttgcaagtgatcataacattggagtaatatttctcgagtgggggcagcacgtagtatatcatccatacagtgaataatgtaacaaagtgaaaattttttacgagtgggttcaattgcttgccccacatacgtctagcaaattgttgggctgtttaacatgccctgtggccacactttccaatgataatgcttagtaggctgcaggttatttactgcaggaactgtaaatgcaaaccgttcacagtctggctcagctaaagggatagtaaagagacagtcttttaaatctatgactattaaaggccaattttttggaattatagcaggagaaggcaatcctggctgtaatgctcccataggttgtataactgaattgatggctcttaagtcagttaacattctccatttacctgattttttcttaattatgaaaactggagaattccaaggagaaaatgtggagctatgtgcccattttctaattgtttggcaactaatttctctaaagcctccagtttttctttacttagtggccatttttctatccaaattggcttatttgttaaccattttaaaagtataggttctggaggcttaacaatggccaccatcaaaaggcgggcagatcaccaggtcaggagattgagactatcctggctaacacagcaaaaccccatctctactaaaaatacaaaaaaattagctgggcgtggtggcaggcgcctgtagtcccagctattcaggaggctgaggcaggagaatggtgtgaacccaggaggtggagcttgcagtgagcccagatcacgccactgcactccagactgggcgatagagtgagactctgtctcaaaaaaaaaaaaaaaattatttcctaatctttggtgagaactttgtttttccacttgaagcggttctttcaaaccttgcaaatttttttctagtcccataccagggacatacctatttcctgcattgtacattgactttgaggactatataattgttctggaattagaacttgtgctccccattgttgtaataaatctcttccccataaatttataggtacagacgttataattggttgaatagtcccaggttgtccatcgggccctcacagtgcaaaatataactaccttgatatacttcagtggctttaccaattccaactatgttaaattgagtgggttgaattggccacgtggacagccagtgctgtagagaaatgattgaaatatccactcctgtatctaccaaacctttaaatttctttccttgaatagttatttcacaggtaggacgtttatcagtaatttgatttagccaataagctgctttgccttgtttatttgtgcttccaaatcctcctgttcatttaatttcactttttcccattcccacatatggcacaatcaggagctgtgctatgcactctcctggctctgctttccagggaacagaagtagatataacaatttgaatttccccaatgtaatctgaatcaatgactcctgtatgtatttgtaccccttttaaatttacactagaccttcctaaaagtaatcccattatccctgctggcaagggtccacagactcctgttgggaccttttgcaggggttccccaggcagaaggctgacagcttttgtgcagcataaatctactgtggcactaccagctgtggcaggggacagacattgtacaggggtgagggaatggcctgagctggaaatgtcctgatttagaatggggcctgggacgggctcctcatggcgtttcccaaaattgggttcccttctttatcaaacttagagtgacactgactagcccagtgttttccttttttacattttggacatatttcaggctcaacagttttcttttttcccctatctggcggcctgacttgctgattttttctacattcctttttagtatgaccatgcttcccacaagaaagttaaaacaagctccaggaaatggagtatttcctttatccactctccgtcctgccactgcctgtgccaacaaagtagctttatgcagattacctccaataccatcacaggccttgacataatcaactaaatgtgctttccctctgataggtcgcagagcagcctggcaatcgggatgagcattgtcgaaagctagtaactgcaacactatctcctgagcagccgaatctgcaatcatctttttaagagactcctgtaaccgagctataaaatcaacatatggttcccttggtccctgtttcatagcactaaaggaagggtattgttccccacctgaggtgatttttttcccaagctctaatgcgcactcctctaagctgttctatgggatcatcctgcatggacaattatgcatctaaaccagcccagctgccaacccccaaaagttggtctgcagttatattaatttgaggttgggcctgggcattgcgagcagcctgaatggaggctgcatctgcccaccaagttttaaattgtaagaactgagcaggagttagacaagctcgagtaagagtgtcccagtcagtaggaatcttctgactggaaactgtaacattctttaacagtcccattacaaagggagaacctggtccatactgacttattgcttgtttgaattctttgagtaatttaaaaggaaaaggctcaaatgtagctataatatttccctgttgatctggggggtgtattctaacagggaactgccaagcctctaaatcaccctcttgtctagcttgctgaatgcctgcctgaatagaactaagagcagtccctcgaggtgctgctcgaacagtcacgggggcaactacttttcgcccagtgtcctccggaaaagaaagatctggggggtcattttcttcaaaataataatgagggggtgcagaagggtagggatgaacctctccctcctttgccactttggctttagctggcaaataaacctgctctgtaacctcttctgttacttcactatactcttgttcctcctaattatcagtgtgaaaaagttccaaggtgaaatgaaccagaccccatacctgtccattgttaccctgacgcttccgagctccccttcttactcaccatgcggattgctttaagagtacttgggtgtcctccagctagttttctgttccaaccgttgctctggcaacccttcgacctggattcaagcccccacgaatggacgccacttgctgagaccagctccgtcagggaaaccctaacccagtggcgctagagcaattaaagacacacacacagaaatatagaggtgtgaagtgggaaatcaggggtctcacagccttcagagctgagagccccgaacagagatttacacacatatttattaacagcaaaccagtcattagcattgtttctacagatattcgattaactaaaagtatcccttgtgggaaacgaagggatgggccgaattaaaggaataggttgggctaactaactgcagcaggaacatgcccttaagacacagatccctcatgctattgtttgtggcttaagaatgcctttaagtggttttccgccctgggtgggccaggtgttccttgccctcattccagtaaacccacaaccttccagcttgggcattagggccattatgaacatgttacagtgctgcagagattttgtttatggccagttttgtgggggcttgatcccaacacagacccctttctttactgagaactagactgcctttgtaagactaacaaattagccaaaagatatgaaattatggtttaggaatcatgcagctggaggctgcaagattctgaccctctccaagttgtttctggggataacatcactattgtaaggcctaagatcactgcttgagatattttgcagagccatattttgaggtatcacctctgtaggggtgaaagtataactgcccaacaggttcattttgcccactgcccagatagagccaatttatcaagacaggggaattgcaatagagagtttaattcatgcagagccagctgatactagagttttattattcaaaccagtctctgcaaattcagaggccagggttttttaaggataatttgctgggtaggggctagggaatgggtgctgctgattggttggtgagtgcaatcataggggtgtggaaaatggtcctcttttggtgcactgagtctgtttctgggtggagccataggacaggttggtgggtctgaatggagccatcagtcatcagaaaggttaaaaacctgaaaatatatctcaaaaggccaatcttcagttcaacaatagtgatgttatctgcaggagtaattggggaagttgcaaatcttgtggctagtttgttagtcctacaaaggcagtctggtccccaggcaagaagggagtttgtttttggaaaaagctccaaattctgcctcctgggttcaagcaattctcctgcctcagcctcttgagtagctgaaactacaggcacacaccaccatgcccagctaatttttgtatttttagtagagatcggttttcaccatgttggccaggctggtctcaaactcctgacctcaggtgatccacctgcctcggcctcccaaagtgctgggattacgggcatgagccactgtaccaggctgataaaatttctttaaaaagattttttaaaaaggaaactccccatgttcacttaaaatgttttatttcctgaattttaattaaaactttttaatgtccttcatatactatatgatggtactgaattttaatctttttgatttattttatatgaaagcagaatctctgggggtgggagtgataccctggttaattgttctctaggtatatgtgtgtgtgtgtgtatataagtgtgtgagtattttatttattttatttttttgagatggagtcttgctctattgcccaggtgcaatcttggctcactgcaacttctgcctcccaggttccagtgattctcctgcctcagcctccctagtagctgggattataggcatctaccaccatgcccggctaatttttgtatttttgtagagacggggtttcaccatgttgcccgggctagtcttgaactcctaacctcaggtgatccacctgcctcagcctcccaaagtgctgggattacaggattgagccactgcacctgggcttctctaggtatatttttgagttggtttggaaaattgtgacaataatgcctggtgcatatgtagatctttatgtgaaattcgttgacatcagtgctatctatgccattgaaagatcatctgatccatttctccactgctcctctaatgtttataaaaatgttctcttagtttggctaatatacatataatgaaatggggaaaatgtttaagcacagggaacccatcttttcctgttatgagaaggaacatttgaattaatgttaaagagaacagagattttctctaaaggaggggtttgtctacaactgctctggggaaaatctgtccaagtgtttgccacgcctatggcctgaactcctgaaacatctttcaaaacatccaagacaggtggggcgtggtggctcactcctataatcccagcactttgggagactgaggtgggcaggtcactttaggttaggagttcaagaccagcctggccaacatggtgaaaccccatctctactaaaattacaaaaattagctgggcatggtggcatgcacctgtagtcccagctgcttgggaggctgaggcatgagaatcatttgaaccagggaggcagaggttgcagtgagctgagatggcaccagtgcactccagctcgggtgacagagtgagaatgtctcaagaacaaagaaaacataatctccaagcgagttatagtgcatgctacacagcatcacctcccagatctcaggtattttttctacaatcaggattaagacaggtaggaaataacttggtctttcaaaaacggctgtggcatgctggaggccaggagggcaaatcttgccattagatacatgttggctggcgcacataatgtttttaatactacttttttatacacaaacagaatttctggcttcttaggaatatcaagctatatgacaacacaaggtccatattcctgcataaaaccataggggcaggggttcagtccaagtgtcccctttaaatggggcaagtgctcctcagttcaccaaaggcccccacctccctaccactccctacccctccaccaggcccacacattagttacctgtcaataaaaagagttgaactctgtaacatatttgaagagatttattttgcgccaaatatgagtgaccatggcccatgacacagccctcaggagggcctgaaaacatgtgtccaaggtggttggggcacagcttggttttacacattttagagaggcatgagacatcaaccacacacatttaagaaatacattggtttgttccagaaaggcaggacaactcaaagccgaggcttccaggctatggtgaatttaaacattttctgattgacaattggttgagtttatctaaagacctgggattgatagaaagggaatgttcaggttaagataaagactgtggagaccaaagttcttttgaaatcttatagtggctgccctaagagatgatagatgacaaatatttcctattcagatcttagtctcttcaggattgggaggatctgcaataaaaagatctagctatgttaagagattctttacagatccaaactttcccccacaaagaacagctttgcaggacaatttcaaaatacggcaaagaaacatgttttggggtaaaatattttgattttcttccttgtctcaaaatgttatgatgccagagtcagtttggaaagtaagtcatgatatatagagttaaaacccatctgatgtgaatttatgatttgtaggttatgactccccagaccccttaggtaggaatttgggcaagataaaaaatcaagagtttagtccttatatccaatgagggcatttgaactaatgtaatggcttctgtttgttgttttgttttgttttgttttgctttgttttgttttgagtcagggtgttgctctgttgtccaggaaagtgcagtggcacaaacatggctcactgcagccttgacctcccaggctcaggcgatcctcccacctcagcctactaagtagctgggactacaggtgggtgccactacacctggtggatttttaaaaattttttgtagagatggggtgtcattatgatacccaggctggtctcaaactcctcagcctctgattctctcaccttggtctcccaaagtgctgggattacaggcatgagccactgtgcccaggcaatggcttctttaaaatgctatttatctctcctatttaagtgcccctctctatatttaaatagtagtcctgctggtacccacctcatgcaacttagattactggatttgtatagttttaccctttaaaaatctattttgtaacttgctatactctcctagaatactatgcggattaagttcttaatgtgataaatattctattatatacatattcatttctcttccaagtgatttccttgtcttagggacccattagttacttgctattcaatgggtatcaatatattgtgaaaattaatctttagtaaattttcatttaggttttgtttgattgtttattcttttaggtttgattgctgatttacttctctgaattttagattcttctgtagtttctgacctccaggcaaaggtggatgaatggagttctgatatattagtgagataaagggctcaatagaattcatccaagagacacagctgctccagggagagccaccatcattagcaataaggaaagtaagagtacaaggctcctttgctagaacaactgggtgcttctttctttttttttttccctcttctcttcctgacctccatattctaactttacaagtgatttttttttcttttccaaagtaaaggatgagaacagaagattctttctacttccatatccaggaactgaaactcactatatttatccccaaacacctccttccattcttctcccagattggctaatgtccacatttatatgcttaatgtttcctatagctactacacatttgatcacttccaacatgaaacattggaacaaccctgaatatcactgccataaagatagccacagagattggttactgcttggtgtttgccttatttgaacacagtttgaacacttagcagtctgagtggttgcagtatggcttctgggattggccaaaactcagctgttgttacaggtgcatacaactaagttaggttttcaattttgtctgattattaagctaggttacagttcatccacaaggactcaaatatagaagtacagagtcctggctgggtgcgggtggctcatgcctgtaatcctagcactttgggatgcccaggcgggcggatcatgaggtctggagtttgagaccagcctggccaacatagtgaaactccgtctctactaaaaatacaaaaattagccaggcatggtggtgcgtgcctgtagtcccagctactcgggaggctgaggcagtagaattgcttgaacctgggaggtggaggttgcagtgagctgagatcatgccactgcactccagcttgggcaacagagtgagatttcgtctcaaaaaaaaaaaaaagaaaagaaaaagaaagaaagaaaagaaagaaaaaataaaaaataaaagaaatacggagtccttctcaggccatatttagttagctttaatgctgcatacaccttaaccataccacatagcatatggtttccatgtcagtttcacccaccagctccttaagggataaagcaggtatcttctttagattttggtgcctacttgtttgatgaaaggaaagagggaaggaaggaagggagggagggagggagggatgctgacagacattctgagagcagtgtctagatatcccgagggccgtggcagagagggatgtgaattacccatggtgatgcccccaaggtgatggctctttggcccagaagatgtgtacagggcaaactcttacgcctacagggacagtgaaggaaggtagtcttaggtataaggcaccaaaaagtagtggggactgtggtgaacagacagagaggaaatgctctgtctaaagggaacaagctaataattgctatgcagaaatgctggccctgtgtggccagaccttctgattggatttttttttcttttttgagatggactctcattctgttacccaggctggagtgcagtggcatgatctcagctcactgaagcctctgtctcccgggttcaagtgattctcctacctcagcctccccagtaactgggactacaggtgtgtgccacacacctggctaatttttgtatttttagtggagactgggtttcactatgttggccaggctggtcttgaactcctgacctcaagtgatctgcacctcagcctcccaaagtgctgggattacaggcatgagccatcgtgcctgacctggattcttctttttttttttttctttgagatggagtctcgctctgtcgtccaggctggagtgcagtggctcagtctcagctcactgcaagctccgcctcccgggtttatgccattctcctgcctcagcctccctagtatctgggactacaggcgcccacccccacaccccgctaatttttgtatttttagtagagatggggtttcaccgtgttagccaggatggtctcaatctcctgacctcgtgatacgcccgcctcagcctcccaaagtgcagggattccaggcgtgagccaccacgcccagccctggcctggattcttttttgactgtttttaaaaaaaattggatcattattttaatcagttaatactgattgtattttttcccccaaagaagtcagaatcaatattttagaatgagaaatctcctacattttaaatattggtcacattaaacattaggctagattctggtcttggtttgacaatttgtggtttctggtacaagacattgaggaatgttgatttgtaaaactataaaaatgtgagccagtgcagtggttcatgcttgtaatcgtaacactttgggaggccaaggcaggtggattgcttgagaccaggagttagagaccagcctgggcaacatgtcgaaaccctgtctctacaaaaaatacaaaaattagctgggcacagtggcgtgtgcctatagtcccagctactggggaggctgaggtgggaggactgcttaagcctgggaggtcgaggctgcagtgagccatgttcatgccactgcactccagttcctggcttgggctacaaagtgagaccctgtctccaaaaaacaaaacaaaacaaaatgggacagttgcagagcaaatggcgaaatatatctacaagaacacactcatcaatcaaaagctgagttaatttagttaaatacacattggagaaaagaggaaaatgtattaagggaagtgtcaggtaataaatattgaatcaggtccttgatttgattttgaagcagaaatgagctatgtatgaaggaggtccagtaataaaaacaatgggagatttcttcaataggggtgaataattttgtaggtacttatgcattctcagctataaatacccctgtagaagcagctaacatcattaaatccaaatatgaaaatttatccatgctaagtattcactacaagaaccaattgcacaagttggggacctgattttaataattggactatatttttatattaaaattacttttcatcttgagcactgtaaaataccatacaaacttattacttcattaagtcctgatattacccaatgaagtagattatttgtattcccacatttgctaagaaattaaggtttggaaaagtttcattcattcatttgacaaatatttaatttagtatgcagtagtgaacaaagcaaaccaaacctcctgccttcatggagtttcaactccaggtgaaaccaagtaaacagacacagtaaatagccttcctttcagacgcagcactgtttttgaattcaggcttgccttccttccttctttccttccttccttcccttccttccttccttccttccttccttccttccttccttcccttccttccttccttccttccttctttctttctttttcttttcttctttttttctttgaggctggagtgcagtggcatcatctcagctcactgcaacctctgactcccaggttcaagcaatcctcatgcctcaacctctcaagtagctgggattacaggtgttcaccaccatgcctggctaatttttttatttttaatttttatttatttgtttatttgtttattttttgagacagagtcttgttctgttgcctaggctggagtgcagtggcatgatcttggctcactgtaacctccacctcctgggttcaagcgatcctcgtgcctcagcctcctgagtagctgggactacaggtgtgtgccaccatgcatggctaatttttttgtatttttagtagaggcagggttttgccatgttggccaggctgttctcgaactcttgacctcaagtgattcactcaccttggcctcccaaagtgctgggagtgcaggcttgagccaggctttctattaagcctagctacaaaccttctagtaaatggctgttgctcttcattttactttatttataatatataaaatatataaagtataaaacaatattacatatacgtgtgtgcatatgtgtgtgtacacacatatacacacgcatgtgtgtgtacacatatatacacgcatatgtataaaatgtatacctatataatttttatttatatataaatttatatataatatatatttatatataatatataaatttatatattatatatttatatataatatataaatttatatatattatatatttttatataatatataaatttatatataatatatatttatatataatatataaacttttatattatataaatttatataatatataaatatataatatataaatatatatgatatatataaatttatataatatataaatatataatatataaatatatatgatatatataaatttatataatatataaatatatatgatatatataaatttatataatatataaatatatatgatatatataaatttatataatatataaatatatatgatatatataaatttatataatatataaatatatatgatatatataaatttatataatatataaatatatatgatatatataaatttatataatatataaatatatatgatatatataaatttatataatatataaatatatatgatatatataaatttatataatatataaatatatatgatatatataaatttatataatatataaatatatatgatatatatatttatataatatataaatatatatatcatatgtataaatttatatattatataaatatatatgatatatataaatttatatattatatagaaattttaatatagtatatataaatttttatatattatatataaaatatatataatatataatatataaataataaaaaattgtatatataaatttttatatacataaaacatatatatgtaggtgtgagccactgtgctgggcctggatgctgtttaataatagtagtagttttgaggcgccagcagagtgcagacctgtgacacagtgaaccgaagttctcaggacagctgagtagctgctgggtcattcctcagtcacctgacctcagcagacgaccctctctgcagttggctgtcctgatctgggatagtggggatggcaatatctgctccatgcatggatgagttggtgtgaaaatacggcaggaaataacacaggaaaggtgtaagtgcatctaaaatcatatgtacatatttgtgtaatgcttgatgcattacatgagtgttttcaagtaaaatatagtgttaattttaataatgacccactctgtaatagtgaaatttctaacaatctgaaaatttgcagtggtgttctgggtggttgtgttacctttaacgttgttgatttaaagaggagtgttacttagctgccttagaaacagttacagctgggtggcagagggcaccaggcaagctgacccagacacaataagagctactggagagagctgacttcatctagggaggatgtaagtggacattctttcattcatctaacaaatactaactggttgcctaacatgtctgttttgttcattgctatatcctcagtgctcagaaaacctcattgccctgaaaaggtttatgttgtaataggggaggccgttaatgtatagacgtgtttatcttaggtcatagttgctacaaagaaaagtgagactgtgggatggacaggggatgggagggagggagggagattatattagcataattagtaccagctgcctcagcaatctctgaaatttcagtggcttagtcggacaaaggatttttctctcacaaagtatgattggggtcggtgactcagggacccaggctccctctgtcttccggtatctccaaggaaggagaagaaaggagggatggaaagccccatggttctgaccgaatgaagcgatgatgtggcatggtggatctcccggggaagagggctccagggagagagaaaagcgaaggcaaaaacttcagcaagaaacgtgcttgacttgtcccaaaaatagcaaagcaaccactgtggcttctttcagtggaaaagggggctggaaagatagccaagggccaggctatctaaggcctctcaggccaagggaggaagtaagaaaatgcaattgtttggggtcatttagtgtcccctaaaaactttacagaagcatatgggtggttataatgattgtgtaaactaaactgtgaataatatgctccattttctagagaaatctttacaaaatgtgttactgtatctatttccctgagtgaacagttataggttgttaatactggagcacaattttctacatatctaagaccctctagaggtaggggttttcctgccactagtggccatagggccaaacatcatgacagcctgtcctcatccttctggaagcctgatgcgcggcaagcacagaggcctcccactggactcctacaaagtaagcacctgcagacgcccatgccccagtgctacaaacaaccttggacacccaataattcctcaaccaccatttctacagagtagctcaaccagtctgtaaaaaatcatcaccttaaactcctggaattttcacacctgaaataagcccaaagttactgtacttaactctaatctaaaaagtaactactaaacgaacagaaggggcgaaactaaatttatttatcttacatattctaggttagcttttcagaagtaaaatgagtcatattctagaggtttagttaatgtggacttcatgtttctgaccacatgaaatgttggcattgaaattcaatgatccctgttgcttactgtgagaatagtcaaaacccagaattttcagctaaaaatgtaatttagaatatgcttactgaattgaattaaggttttgcattaggataaacactgtgggagtgattctggtatagtgggtttgtgtttttgtgcaagatgcttacaataccacagcccttagaataattgtacactcttctggcccgtttcccaggtttccttgaaaagggtcagaggacaggctgaaattaatgacacatgaatgcagaacctcaattagaagtgtcttcaaaggaataattaggctagacttaataagaggggattaagagaagaaaaagctttgggcaaattatacactgaaggaaaggaagataggaaacaaggcaacgatagattggagctgattatttcaggaagtgatttttgttctatttatcttaaaaataatataaatatagtgagacatagagacaacagatggatggatggtcactgacctcttactaggagtggcaatgtgaacattgggacgcttcctggtgcatgtaccctgcaattgttagtttagtacccctattccctttgtgaaagaggccagggattttgcttcccccaaataacagtaacagcagcaaaagcagcaacaaacccttcaaatctgcttaccctgccagatattgtttcactttcctcatctgtaaaatagggattactttatgatggaatccccacaacaacccccggaggtaggtacgatataagtgccttgttccaggtcatacagctaggtagtgtcagaacacagattgaaattcagaagcctggctccgaagtttgagctctcattcaccgcactacatatatctatgggaggataggcgacacatgcatgtaataaatgtgtgagcatttattgtactggaaactctccagctcctccctctctacatgatcctttgcttctaattttgtcaatcacagcaccttccctggcccttactttgttcttgccaatctcctctccttgagcagaagagggaagggagcctgctctgtaggtgaacagctcctccgcagaggcatcctgttttcttagtgcaatcactaattcgcattgcaaaatgctttattacatgactgggttgccattctaggagcattcactgagcgctcagagtgggaacgtttatcaggcatgcaaatgctaacttactttctagagaatgtttaacttaaaagcctaaagaaatctcagataattcacttcggagtagaaacctccttcagccgcgctcactacggcgcccggcttcgcggcaccggccactagagggcagtggccgccgcaaagccgacgcgggcggtgggctcggcggctcggccatcgcttgctctcgcctggcaaggggctctcggccgtggattagcgcagctggagacgtgggaggccgcgggccccgcccccgaccggcggcggctgcggcggcccagcgcggcagtcggcgctgcgaagtggaggcgctgcgagcggagccgcgcggagggcgcgaccggctggtccgggcagcgtgggtttgccgccttcggggctccagtccgcgcgccagggctcgagcagtaccgcgggcccctcaggtgggcctcggctcgggacgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcctgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggttcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatcgacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggtaaagcctggcccttagagcaggtgatatggagtgtattgtgcaggctgaaaggggcgactttgacagcagtaccactgtgggtttcagaatcatattctacaggtgaggaagcgagcagagacgtggacgcctgggtcttttccctagagtgtaagttggattgctcgacaggcagcttcctcctcgagtatcttgcattagggaatgagtactctttctcgaaggttcaaagagtacctttgatgacagtgctatcattttagagtttgaatagttgagtaatgagctgctcaaatctgtaatcttgagacgagggtagaattagaaggggacctaaaccatgttaggtatctgtttgaacactgcactgtcacttagtggtgagtttcaaaaagtgaggaaataatggagaagaacggatgtctgtaaatagaaatctgctttcacccttccacacctctcaatctctgctttggtagaggaattaagatcaattctctgagtttaagaaattcctgcaaagaattcttgcctgcaacctttacgaagtgaagtaatttcaggaaaagcgtactcattttgagtttgaaatctattaatgtactgaaattgagaacgttgtttaggaaaattgtttagggaaactacatagaatgaatataatctgagtattggatctgagagcagcgttgctggtatcccagtgagttagctgtccaactatcagagttcatgagttattaatagttgttagtgtctctgacctttgctaaagcaccagaatttgcaaattaaaaaaatatatagcagta

SEQ ID NO: 218 - DNA, 7354 bp, Homo sapiens
taaactgcatttattctgggcttgaaccacatcaaggcagtttcagaaataaccttaaaaaagaggagccagagattaaatactatccccactccccataattaagatgcaatttgaaactttatctgaaatcattgagtcaatggaaagccgggaggaaaacaatgttaaatcaatatctgaaaagctgtttctactaaagatgtctatacacacacacatattatatatctatatatcatgtatttggactgattcaaggaatctgtgcttctcaaggcaacttcaagaactgttgatagtacagagaaatggatatcacagcttttttcttaaagaaaatataggttgaggtagggactggtaaaagaagagactgctttctttcattttttttcttttttaaaacaacttgtctacatcaccaggtatcagtaattgattcccactggacacaactacaggatacactccatgtttattccttgtgagaaataaacacagtaacaaattttcactagcatcattatgtagaacataaattcatgtttccttaattcagtaggtatttattagaaatctatgaggtaccaacatctatgtgaagtcctggttataatgcaaagaagccagtctagtgaatagacaaatgaatttattaaattaaaatacaatgatatatgtcatgagatgttcaagagctatgggggtacagtagagaaatatctgaggaggggtaaagaataggagaagtttccccggctgaatcttaaaagtaaggtattttaagatgctactataccattaccacttaacaagtaaggaaaaaaaaaattacaaaaaaaaaaaaaaaaaagaaaacagccatatgattacatgaaaattgaataccttctcctgaatgatttttaggtagacaatgaaattaaggcagaaatcaagaagttacttgaaactgctgagaacagagatacaaaataccggaatctatggaatccgactaaggcagtattaagagggaaatgtatagcactgaatgcccatatcacaagttagaaagatctcaagttaacttacaacttaacatcacaactaaaagaactaggaaaccaagagcaaacaaatcccaaagctagcagtagacaagaaataaccaaaatcagagctgaattgaaggagattgagataagaaaaatcattcaaaacataaatccaggagctggttttttgaaaaaaaaaattaataaaatacatagatcactagctagactaataaagaagaaaagagaatattcatataaacacaaaatattcaaataaacacaatcagaaatgataaggggcgattgcaactgaccccacagaaatataaccatcggaggatattatgaatacttccgtgcacataaactagaacatctagaagcaatggataaattcctcaacacagctaccctcccaagagtgaaccaggaagaaactggatctctaaacagacaatatcaagcttggaaattgagacagtaataaatagcttaccaaccaataatgtccaggaccagacgtattcacatctgaattctcccagatgtatgaagaagagctggtaccatttctactgaaactatttcaaaagttgatgagcaactcctccctaactcatcctgtgaggctagcatcaccctgataccaaaacctggcagagataaaacaaaaaaagaaaacctcaggtcactatgcttggtggacattgatacaaaagtcctcaacaaaatactggcaaaataaatccagcggcacatcaaaaagcttacccacccccatcaagtaggctttatccctgggctgcaaggtcggttcaacatatgcaaatcaataaatgtcattcatcacataagcagagctaaagacaaaaaccacatgattatctcaatagatgcagaaaaggcatttgatacaattcataccttcgtgtttaaaactcatagcaaactaggtattgaaggaacatacttcaaaatgagagtcttctatgacaaacccacagccaacatcatactgaatgagcaaaagctggaagcattccccttaaaaattggcacaaaacaaggatgccctctctcaccactcctattcaacatagtattggaagtactggccagggcaaataggccagagaaagaaataaagggcatccaaataggaagagaggaagtcagactatccctgtttgcagatgaaatgatccaatttctagaaaaccacatagtctcagccaaaagcttcttaagctgataaacaacttcagcagagtctcagaatacaacatgagtgtgcaaaaatcgctaggattcctatacatcaacagcagtcaatccaagagccaaatgaggaacatactcccattcacaatggccacaaaaagaataaaatacctaagaatacagctaactagggaagcaaaatatctctacaagaaaaactacaaaacactgcttaaagaaatcagaagtgacacaaatggaaaaacatttcatgctcatgaacaagaagaatcaatgtcattaaaaatggccatacttcccaaagcaatttatagattcagtgctattcctattaaacctccattgagattctttgtagaactaggaaaaaaaaaaaactatcttaaagttcatctggaaccaaaaaagagactgaatagccaaagcaattttaagcaaaaagagcaaagctggaggtatcccattacttgacttcaaactatattacagggctacaataatcaaaacagcatggtattagtacaaaaaaagacacatagcctaatggaacagaatagagaacccagatataaggccatatacctacaactatctgatgttcaacaaacctgacaaaagcaagcaatggggaaaggattcctattaaataaatagtgttgggataattggctagccgtatgcagaaggttgaaactggaccgtttccttacaccataaacaaaaatggattaaagactgtaatgtaaagcacaaaagtataaaacccctggaagacaacctaggcaataccatgcaggacaatggcacgggcaaagatttcatgatgaagacaccgaaagcgattgcaacaaaagcaaaaattgataaatgcgatctgattaaagagcttcagtacagcaaaagaagctatcaacagagtaaacagagaacctaaagaatgggagaaaatctttgcaaactttgcatccaacaaaggtctaatatctagtatctatacggaacttaaatttccaaagaaaaaaacaaaacaacctcattaaaaactgggcaaaggatataaacagatacttttcaaaagaagatatacatatggtcaacagtcatatgaaaaaaagctcaacatcactgattattagagaaatgcaaatcagaaccacaatgagatacccatctcagtcagaaaggttattattaaaaagtcaaaaaataacagatgttggtgaggttgtggagaaaagagaacacttatacactgttggtggcagtgtaaattgcttgaaccattgtggaagacagcgtggtgattccttgaagacctaacagcagaaataccattcaagccagcaatctcattgctgggtatatacccaaaggaatatattaataaaccattttattataaagacacatacgtatgttcattgcagcactattcacaacagcaaagacagggaatcaagctaaacgcctgtcactggataaagaaaatgtggtacatacacaccatggaatactatgcagccataaaaaagaacgagatcatatcctttgcagggacatggatggagctggaggccattatccttagcaaattaatgcaggaacagaaagcaacaaccacatgttctcccttataagtgggagctaaatgatgagaacacatggatacatacaggggaacaacacaaactctggggtctattggagggtgaaggtgggaggaaggaaaggatcaggaaaaataactaatggatactaggcttaatatctggttgatgaaataatctgtacaacagatccccatgacacaagtttacctatgtagcaaatatgcacatgtacccctgaacttaaaagttaaaaagataacacaatatcaaaattttatgcaatacctacaaatttaataaaagttgtacaaagaattactgacagaaatttcaagacctaagcaaacaaaagaatcatattcactgaccaagaataccacttttactgctgtgagtagaaaatattgtgctaagccaaaaaaaaaaaaataactgagcatttttctttaagctctataccagcatgtgctcacatcagaatatttattaaacagtcatccttctatgaccttgaatttctcttaattacaatttaggagtgcataaattgacttaagtgtagcttttggacagcattgaaagtttcagatacagatggatacagatggaactacaaggcagccctgtgagggataattagaaaaagtataatattaagagttaggcatttgtaaagcaggtaacctgtttgacagaaaaagaattaaggttatttacaacaaagactccggaaaggtaaaggaagataggagagagtaaagcccttagtgctgatctatgccaggtgtgcgagaccctagttaggtatcaaaatagcctgtacagttctgtttttgttgtaatttggttttgttttgttttaatacatttgtcctggtctaaagacttgcacaatttctgggagtggccttctgtatagcagttattcatacaggtctctgttggttctgttagagacaaagttgagttactgtggcctggctgtgcaaatactcttgttttccttttctaccaactttaaaaacaacactaaaataaaaacaaaatgtgtcatgtgaagcaactcatgtatgttgctatctcttggatccggaaatatactgacaaaattgaaatggaagaccagagacagaaaaaaacaaaaaagcaatttctcaccatgcatattatttgaaacaaaagaaatttaagttactgacatcttgtttgaacatcttgtttggagatttctaaaatcaagtaataataagtaacagtaaatggtactgtgcccattattatacttttaagctgtgttaaatgttaatgatattgtctttagcaatttttattgtttttagtgaaagaaaaatatattcacatcagagcatggttaccattcatattcttcctttaaagtcatatttttcatcataaattcttattaccttggtatatttgggactgctatggttggggctatttcagataacaaataattgcaaagaagtatttacttttcattgaaatattctttaattttgttttatgacaggattgaggtatgccctcaaacattatttcagtgattattgtagataagtattcgaatctttcatctgttggatatctggataaatcaaatggcctggccatggcaaaccacaaaatccagtttcgtagagctcatttgtttcaatgaaagattttaattaatcatattggttgcatcacaatgattttgaagttactttgatattaaataaaaaagaattcttatataagcaatggtaataaagtactaaagtattaataaagtattgagaatttgaaattgactagagaattcaaaaatgagaagagacaagtcaaggtaaattccctcatattcacatctacaccttatgggttacaaacatttgaattctgaaagataatgctggcacgactgtgatggtcaatgggtttatatcaaataaactatattgtagtttataaaatggttttctcttactatagccaattaaaatcttaaaaatagagtgtgtaatgtagtacagattttaagttgcctttatatggcttatgcttcttgttatatttgtgttttggggggaattcttggcaagagattaggtccacatctgattttatgaaatgaatcaacaatgacagtaaagtaataaagtcaacataatgatttaattgtctatgattcacataagtcacttaacaattatatttgtttagtggtatgtttatcataaagttaatatgtttccagattgttcaagttttatattgttatatttttcaaatttcattttatgaataatgataatttatattccctcaaacttccatgtattaccatagttgatcttttctgttcattctctgttttgaaagaaatctgactttttactttcaaacatctagttttcattatcttggagctaattcaatcgctgtgatacctggaaaaaattacattttttatcttttagtttgtaaggagacttttgaacctgaaacagaaactgaatatttttgagattcactagatggattggttttcttaatatgcatttggtatagtaataataacgtgttatctttcaggtataattttcaattcatatgaatatgaacaatttatattgaaatgctgtggcgtttttatttgtttagttcttagaaagggtagctgttctatgggtttacagagacaagatttttatacataattggagatactagatggaagtagtttggctaaaaaggaaaaaaaattctatttgattgaagatggagggctgagcatacatgatgacttcttatccttcctgacacctcacctcatagaggcatatacataaaggaatagatccatgcagcaaagaaaatcagagagacttactagcacttggtatgttttcaagaaattactaggagaaggaaaaatgggaatgagctaactgatggaacaagcagtgcagaggaggagatgggagggaactgatcagcctgcctgaaccttggagagtctctcttctgagaatctgcaaggatgaagatacagagctcaaaacaggagactcaattaaaggaccatatctgcaactgggacaattggctcacctacttcacttttacaacccagattagaaaccagtctgatttcagttcttctgagcaatgaaccatatgggaaagggtgacgtttctgttgtgcctcttggcatgccactactaagcctacattattctggcttgggttggggggtgcagttttcctaccagttcctgccttaagtgaaattcctgcctaaagtgaagcttgcccgtatccaaagctacccatgtgcacagagctcctagttaatgctaccaagtaggcaagaagataggtgcaacctgtttttattattatgcttgttcattgttttctgaagctgtcatttcaaatgcttgattttt

SEQ ID NO: 219 - DNA, 13419 bp, Homo sapiens
actatcagtgcctttaatcatgaaaaagacaagtagaaggaattagttctctcacccagggacatcagtgtgtatgtataccagtgggaaccagacatcgtgtctaggtaaaatcacttatcacactgcagctaattttttcacctggtaattttagccaaactaggtcatgttataaatgtcagcaaggcaaaagagagaataaaatgtcatcagaataatgcacatacatttcaatggaggttaaaatcttttataggaaacaggattatgaggtaggagatttttttcattgcagcagtgaatgtgaatacagttactatgattcttaaggtattcactttggcctcattcctgctttctttaaattagaaaaaatatctcaagtttgcttacaggtaagagttttaagccaaataaataacagttattgtagtgatttggttgaaaaataaacttctaattcccctttaaaaactgagaagaaatgaaatatagtgcaacgtcagccacaaaatcattattttgatagctaacatcatttgtattctaggctagaattttaaaatttaaagttcaaaaaataaaattttattcacattgttgattttgcccaatgacacaagctatatgttaatattaaattaatatagacaaattaaagaaagtaccacatttatcactttcatatgtagtaatttttatttcaataaccagaattgtaggtttcaaaaaatgtttgaaaatttgctttaattaatagttttgacaaagaacctttaatagaccgctgcttttcttttcaaagtttcagttaaacctgaagaaataatatggtcctgctgtgatttttgaatgaatgcttttgtggttgcataaattgtgttttttcatgaatattaggattgtaaatgaaaattaagtctggattctgatccttttcctttcaagcttattaaaataagatcttttaggatcactgtgactctctccttgttagttttatgtcataacttagccctgattataaacaaactttaactgtttcttaattcagttttttcttttgtcatgagcaaagaaaaattactgaaataaataagcattgagacatattcttgtagttgaaaacttagtgtgggaatcatatttttgactcccagctcaggatagtattaggtagggtagattattttatcttcttgtaaaatagtgtaaaataaatatttgcctatagacattacagtttagagtagagaagtttcacattagaaagatgctgattcgtctttacatttaggcataaaagagggagtacatagagagcatttataatttatctactttaaacataattattttttattatttccctttgcactatttttaatcctactcatagaatgaaagatgaggcattgaacttgtatctaagattgatgatttgttttgagtctggggcagacagacacagtaatggcttagtctgatacaggcattttgggttcagtctctagggacaggtattcatatgtaataaaaccacttgaactggcattgattgccattgttgataatcctagcaggatcaacattgattgagtaaataaaaagatcgaatttaccttcttctggcaaggcaggcagagaagcaggacaaagcataaagacttgacagcactgtagcattacctctattcaactgtgcttcagagaaaagaagtggcaatgattaagggtactgttcaattcagcaagcaattattgagcagttctgtagcgcaacactgttagctgctaaaggactcaaaaggagaagacagtatgattttgcactaaagtagtttatcatctaaattggaagacaaacggttcatatgtgaaacagctagaaaacaaattatgacagtatataattgagtgtacagttgttcatgcaacagaatacaagcacaatttatttgtccagcaagtgaaaagatatatctttataatgtttataatgttaaattttgtgtggcaacataaagtaacatagcctgagttaattcaggtctttggttatttaagatgaaaaaacccccagcaatttaaatggtatttatttaaaatatcctttattttatttatcgtcctttatttagaccacctaaaaacactagatatatgattattcatacctgagcccccccaaaaaaaaatcaagactagcttactccctgttaatgattcaatcaattgagtataaactttattaggttttgttcactattgattctttgcctcatatatcataaaggttcattctgtctattttgcagtattttccaatgtctaggtattctgaattatgttcactaaaaagtaggtctcaaagagcatcgtaatctccttagctttgtataaggaagccatgtaacaaagcagccttactacgtttctgtttttgcttttgttttatttttatctccattacttgttaagtggtaatggtgtagtagcatcttaaaataccatactattaagattgagccggggaaccttctcctattctttgctcttcagatatttctctactgtaaccccatagctcttgaacatctcatgacatatatcattgtattttaatttaataaattcatttttctatgcactagactggcttctttgcattataaccaggacttcacatagatgctggtacctcatagatttctaataaatacctgctgaattaaggaaacacaaatttatgttctacatcacgatgttagtgaaaatttgttgctgtgtttatttctcacaataaataaacatggggtgcctcctgtagtagtgtcctatgggaatcaattattgatacccagtgatgtagacaagttgttttaaaaaagaaaagattgaaggaaagcagtctcctcttttaccagcccccacctcaactatataattttaagaaaattgatatcaaaagctgtgatatccgtttctctttaccatccaaagttcttgaagttgccttgacaagcagagattccttgaatcagtccaaatacatgatatatagataaataatacgtgtgtgtgtgtagacatctttagtagaaacagcttttcagatactgatttcatactgtcttcctcctggctttccattgacttactgatttcagatacagtttcaaattgcatcttaattgtggggagtggggatagtagctagcctctggctcctcttttttaaggttatttctgagactgccttggagtggttcaaaccagaataaatgcagtttactgcctatcactccatactcttaagatggttttgccagcttttagagcctctcagatgttctaaaataaggtcaagctgattctacatcctattggtggtaggtgttagtgatgtcaatttggcacaatgtttttgacttgagatagaatcattaatccagggatatcttgttaataaatttaccgactactcacttggaatttttgatgtagcagtttttaataatatagctttttcatgtcaacaagagtacattctgactgattctatttataaaagtatgcaatactaatgtttaatattagaacagttagcagtagttaactttggagaacaaaaatggtagaggtaaggggtcagtaagaggacttctgaggatgcaggtaatgtatttattcagcgagtcgtggttatatgggtgtgtttattttgtagtaactcattgagctgtatgattgctatacttcactaaaatctatggagatcaaaggctactttggcagctttagtctaatgacaaacttattattttcttaaacaatgggcaaaattttcttctgactttcagattcctacagtctaaagggaaagataaaactattttagtatgatagctaaaatgcttttgctcttttaaaattctcattataaagtgtattgtttattttaacttttatatgactgttattggctacttaaaagtctttaaagaaattaattgggaaataacagttgaacatgaatatgggagtacttacttcaagacaatccagaaaaaaaaacaacagaatataaaatgtaatgtttaacaaaaaacaaatgtcattttgtatttaaagaacagtttaaggtatgtttaaaacaactacttctgaactgaatgatactacttctcaccccctccatggcaaaggggtcatctaaattagttgtagtcagctgcaccaagctgaagagccactttacactgaactgaattttgtatggaagctggaaagaaccacagactttactaccacattctaattggcaggaaccctgcttctgatgctaaacagcatgtcaggattgcatactgtatcaatttcagaagtccaagttacatttgggtttattgtttatccagccacaagtaagctgccttctgtaacttacccattggcttactgggttatgattttctaattagaaatggaggactttgagatgttaaaagtgggggcccaataatgagtattgcactgcagatacacagactgaatatcactgtcctaaaaaaaaaaaggcttttaaattgaaatatcaaaatcatgattaaaatcgaaaggtaaacaagcaagataggataaattcaatccatggtgttggtaccagtactcttcacgtgaaaaggacctcggcataagtgttcagaaataacaaagatcaaccagcttggccaacatggagaaaccccatctctactaaaaatacaaaaattagctggacgtggtagcgggtgcctgtaatcccagctactctggaggctgagacaagagaattgcttaaaccccaggggggcagaggttgcagtgagccaggatcacaccactgcactccagcctgggcaacagagcaagactccgtctcaaaaaattagcaaaaataacaaaaatcaataagctgaaaaatgttataaaatttgacgttgaataattcattagacatgaaattacagagtgcttacatttgttgggtactcttttaattgctttacatatattaacttgttaaattctcaagcaacctatgagatacaggacaagacaaagagaagttaagtacatgtagaaggtcacacaaatgacatttaaatccaggcagtctgattgtaattctatgctcttacccttaaaaggattcgtcaattccggctaaatggtgtgcctgaataaaatgtggagcacggtagcatttataatatttattcattcaacaaatatttattgaacgcttacgattgggccaggcactatgctaggtatttatggttataatattcccccacttatttttggggttttacttttcatagttacctttggttaactgtggtctgaaaataggtgagtacagtacaataagataatgtatgtgtgagagagaaagactacattctcatgactcttattacagtatatagttataattattctattttattattagttattgttaatcttttacagtgcttaatatacaaattaaattttatcataggtatgcataataggaaaaaacatagtatatataagggtcagtgctatcagcagtttcaggcatcctttggaggacttgaaatatatctcccacagataagggggaactatacataacagtttatgaaagtccttgacccttgtgaagtctgtattctagtagaggtctacagacaataaacaaaaaagtaaaacaactaggttgtctaataaaatatttacatagaagctatgaaggggactgtaatttcataaggtggtcaaggaagacctcactgataaggtgacacttgagtaaagatttgaaagatgtgagaggataaaccacgaggaatgttctggaagcagaacattccaggtaaagaaatcagcaaggacaaagtccctgagaagaaagtgagcttggtatcttcatgaacaaggagagagttttaatgaagcacagtaagcaagagggagattggaagaggagaggtgagaggggtgtggtaggacagatgatgtaaagccattgttaggattttagctctcgttttcagatgggaagctatttgaggaatttgcatagaaaatcaaacctcaaaatgttgagagaagggttctagaagaatccttgataactggaaaggtgaagtttttacattaacagaagaggtaaagagtaataatcaaaaataggaagatcttcagtcagtgatgctaatgtgtctgaagagtcagggtccccagtaggggaaggaagaggaagaaagtgaaaggaggctaaaattttcactggcattgtaggtagaaagactagggtttgagtggacatctgctatggaagtcaggtgacagtggaggccaaagtaacaaaagcaggcagggaaattctcagcagcatcagagtaatacaatgaaattcctcatagaaatactatcaaggaaagacagagaaagccattggacacctatgtcaatcaactagggcagctttgctaacgaacacactcttaaatctggcaatcgaaagctgcctgtttaaaaacaaaaaagtaatgaatagcaatgaaaagaaaaaaatttcaattttagaataattattagcacaaggtcacatggacaggaacaattacccattgtttacataaattctcatggtagcaataatgtaatgcatatggctttgaagatgggtaaaattattactttaatacagtaaaacaggtaaatcatgaatgatgtagactgcttgtgccagtatatttgaagtaaagtaaaattcagtgttcaaatggagaaaccattgaagtgtccagtaatgatgcatttaaataaggtgatttggctgcaactgcattcatctgtaaataatttacacacagatcgagttaggaacttccgaaaaaatagtactcgttctaaaaacatccaattggataatttcacttataagggtaaagagtactgattttaaaaggttctcagagtctgttttgtgaagagatcccttaaagtataatggtggcggagcacagggaagagctcacatgcagccgcaggagagctagggaaaaagggtgacagctctgctaagccgccacttagaaaagagttggataagagcagtctcttcagagtctgacacctttcattttacggaaaaccttcacctagtctgtctatctcttaccagtgaacttcttcaaatgtaaaggtgtttgtaaaaggacataaaaatcaatcatttgtataatataatttcagatctgtgccttttatatatatacttttaccacttattttttccatctgtgaaatgtgctgacacctactttaacaaactgatacaattgagaagagagagtgtgggctgctaataagaagctctcagtcaaaacatagtcaaaaacagagaacagattgataatgaatacttaattctttttaggagtgtttttggtcctacaggattcagaattataaaagctgtaattccctttggctgcaaattgtaggcatgttgcttgcttgttacatttcgagttccaagttgaatcagttgctttcttgaacagttgaaaagctgtcatttaagcatttcaggtatttcattttcctgttacaatcctgggttagatttgctgttacttagctctcacctcttcatctattacagttttctccctcatttaattggagtatatcctcaaagatcttccacagaaaaggcatactggagatacaatttcagagttcttgaaggtctgaattatctgtttgctttcatatttaatagatagtttgggtatatagaattctgttttcaaaatcattctcctatagaaccttgaagacatttcctccattgtgtcctggaatttagggttgctgatgagaaatagaattccaatttgattcacattcttgtgttggtaacatctttttccctccttggaatctcttaagggttttcttctttatcttcgatggataaaacttcaagagaatatatttggattcaagtattttattcattcagttcgcttgatacttgctcagcccttccatcttaaaatcaatagttttcttcaagtctggtggtttttaaaaattacttgtctgattttctttctatagcatacatacattatttgtgcccacctgttatctttggttatctttgaacactcttttatatgttttatttgcggcattatgttacttagaaataagaacatcatatagtttgttagaaaaggatacatgttattgtaacagaagaagtagagcagaggaggaaatgtagataaccttgggtatggaagcatccaagatgtcttccagaggataagtaaacttggtacaaccagacaatggaatattattcagtgctaaaaagaaatgattcggctggacccagtggctcacacctgtaatcccagcactttgggaagctgaggtgggtggatcacctgagcacaggagttcaagaccaacctggccaacatggtgaaactctgtctctactaaaagtacaaaaattagctggtcatggtggcaggcacctgtaatcccagctactagggagactgaggcactagaatagcttgatcccaggaggcggaggttgcggtgtgccgagatcacactactgcactctagcctgggtgacaagagcaagactccgtctcaaaaaaaaaaaaaaaaaaaagaagtgatccgttgggccgtgaaaggacatggagaccccttaaatacacattactaactcaagccaatgtgaaaagactctatactgcatgattccaactatatgacattctagaagagacaaaactgtgaagagagtaaaaaagatcaggggttgggggtgggagatgagtagatggaacacagatgatttttagggctccagtaaataccatgtatgatactataatttattcaaactcacagaatttacaacaccaagagtgaaccctaatgtaaactatggacgttggttgattatgatctgtcagtataggttcattgactgtaacaaatgtactactctggtgggggatactgataatagtaggggttatatgggaaatttttatatcttcctctcaattttgctgcgaaactaaagccgatctaaaatagatttttttaaaaagtagagcagagtaaaggggttaatgtattggggtgggggtatgcaaattgcaattattgaatagaatgatcaaggtaggcctcattgagaagctgacgtgagcactgagcaaagactgtggctatctgaatgaagaatgttacgggcagaggatataactagtacaaggatcctaaagcagaatgtctctgatatgtttgatgaacagcaagcaggttaatgtggctcaagtgaattgagtgagggagagagaatggtgggaaataagatcagagaggtaaattgaaatgggctgcgtcactagtctagactttgtaggctagtgtaaagatttcttagtgtgacagagatgggaagtgtttacagagtagaatagtaatggttatatttgagtatttttctctttggtagttttattaaaacagatgtaacattgcagttttacaaatcacatgattttcaatttagttctatcataagttcataaacttgaaaaaaaatactacatcaagcttttattttaaaatgtagataaacgttacagaaaaaaaattgccaagcgcaatggcacatgctatatagtccagctacttgggaggctgaggtgggaggatcactggagcgcaaaagtttgaggctagcctgggcaacgtattgagaccctgcttctagaaaaaaaagaggcaagatttttaagctgaagtactcttaggaaatatttcacatgagcaggtattatctttaatctgctttttattatcatggttaaattatgagcaaagctcataaaatgcaataaatgcattttgtatttcttgcaagttagcagtggtgttaaatcttaaatctctgatctgtactaatatcatcaactcctactgagaattagaataacagtagaaactttgggaaagattttaaatgacaacaaagctaaagggtcagaatgtcgtcgtttcaaagcaattttcttagttgtaataaaggtaaatttaataaaagtaaaagcaatctgctcccagaatgttacagtattttgttttgaataaatttatattatctggaaatcaatatggctcatgttgcacaaaaaacaaggtctgaaaatagtaatgccctagagttccagtaggaggccatcgccttgaactgtttagaccaatatgaaaggctacttcctggaagaaacaatgcttctcagcaagatatttcttaaaataccattttcagaattatttgtagccactataataaaactatcagtaaattgtcagattgttcttggcattggtgacagaaaaactgcacatatttactggactgcatgacaattaagaacagagtttttcatgattaatgggttaaaaggcaagagttttgaatgaacttaaattgggcaattctcaaatctttgatgattttattatatgtcatcctgaccacttttagctggtttaatgtaattttgaaatgtttccctaaatgttacatctgttaatagttagaaaccagcttaaattcccattaagttttattcaacaaacctaaagcttctgttctgagaacctcataagtaagtaccctctgtgccatagaaggactaacagtatacttcaacattttacaattggttttgaaaattaaaaaatatgtaggctccccaggagttcatattcaatttaacaacatcaattctacttaagacataaaaatctatttctactggcaacaagatgaaaatctccagctcatactccttatatggggtaaacacccagggaatgattccagcaaagcacagaaccaggtttgtgagggagagactgggctttgacatagtaccactggataatacatacatcagtaattgtttctgtcacttacaaatatgtatctgtttaatgtcttcagttgtttagacgaacgatttggatgatcctaaatttctttgaaacttttacatttagagttccaaaaatttgtttttctccaagattaaagcaattctagcatagtagcagcatgctgcatcaacaagttgatttttttttaaagtgtatgtcttctattgaagagctcgatgaagttcttaactgttgtctctttaattaaacagagaacagcaaagcttgtttttttgccaatcgcaaatttatactcaatttaaaccatggcttttaacaaaattcctatactaaaataactcttcacacaagaatcttagtggattttttataggttcttggttaaccagcaaaactcaacaaaatttgttggcattagtaacaaatactttttaaatatgcttctatttctcccatcagaactttgatttctcttcaaagaagcctcatcatagacttactcacacatttgtgagagttattagaattgccataatcaatggatactgaagaaaagggaagatttgagggttggtttttgtttttaatttttaaaaaactcgtatcatgattctggagctaaaagcagctcacatgggccttatatgagctttgcctctctttgagcagtacattttaaaagtcaggaagaaaataaaatctgactcttgtagcatttagctttgtattggagtggcctttgcaggtaatgccaacttccacgacatttagaagattcataaagtgctggtcaaaataatggaaaaaatagcagctgtcatttgatcagaatctgtgtgcaaaccaattaaaagccctgtcataactatttaagcatgtaaggtgatttatgattacctttcataaattaatgaattctaccaataagagcagggtgctacattgggtgctcctgttctcgcagagtttacagctacacattacatgaggactgctccaggtttgctgtgtttaaatgattgacaaggcagaaactttgtcttttcttcaactgattggcactatctacttataacttataacttagcttatttttcactcccccccaaggagagtagagtccagaatggccggtggtagtctcagagtagaagagttgaggtgtcataagataacgacacccttgaatttatttctcctatactttgctttataaaagtgagcacaaggacagacaggcagaaaatagtagatcactatgtgaggctagagagagtcctctttcaggttcaacaaaggaaagacagaagaaaagtgaataaggtacataaatataagaacataagtgtagacaggtagatgatgaaaaatgggagaaatggaagacgtaacaaaaaagaaaaaagatgaagaaaaatatgggaagagaaaggtaaggtgagatgaggagggcaaaagaaacagaatggagaagagagaaaagaatggaggcaaaggaaagaagggagaatacagcaatctcctcctgaaatctgcctgtcccaagcataaagattaattgtaatattttaattacaaattagcttttcctgagaaaacttcataagcacataattcttataaaattgtgttacctcaaatatttaaaatgctttctagtcaaatatttagggggtcatcattctccaaaactagctagccttatgcagctggtaggagttcttcacagctgttctttaagccatgttgcatgagaacttcatagagaacctgagaagttccattttaagagtttctcctgcttcggtatcctaggcaagaaatcaggagaaaggaatgagaaggaagaatcactagtgtcaagtgacacatgaaactccagtaaatctgggtattacttaggtcaactagagtaattcaacataaaggtagaatagttgttaagattttaaaagccaagtggtgatttcgaacttgtagctattgttctaatatgatgggtaatcacttcctgcaatggtgaactatttataaactgctggctcctcaaaatgtaaataaagaaaaattattccaggctacaagattaattttcctctatgtctttaatctgaggtagatccattttttgttaaaacacacttgttttatttatttagtcaaattcttcacattaagaaggaggaatctgagacccagtaagattaagtgactagtttatggtccttgggtagaacaggaatgaagcagaggtttccattcctaggtcacttcagaactactaattgaggttcatcagaaaaaagacataagccaaagaaattagaacatgaagttgagtatcatctttagtaa

SEQ ID NO: 220 - DNA, 20648 bp, Homo sapiens
aggtgggaaacataacagattatcagagaagactgctctggataaaaattgttttgtgaaacctttgtgtatgtgtgtcagttcgcagcataaaaagtattcttgctgtgggacatagtcgaaaaaactttaatgctgctgtttttagagagcttctagtaaaaatttagctggtaaatttacattttcttttcctattttgaggagttaatgtagtaattttgtctaatttgagatgtgcttagaattttggtttacagagtaattgtaagaatttaagattatattgaagttataatattttgaggtgacattttagtaacattctcaggtaaaaggtaatgtaagtgagatgcctaactactgtgttaacagttttggcatgggttgaaaaccattataaatattagtggcttattttcctgtgttttatattattttgatcatatttaaacctaggacattaaagtgtaaggaccctcagatttaaatttgaatatgaaataataaagaaattacattaatataattcattgatatgatgtacacaggatagttttattttaaatagaagcaaatataattagctaacttaaggcaaaactctatactgggttttatttcacatgtaactaaaatattggtgattgtcttatttgcttagttatgagtctcaggaataattaaatggtatgagatttttcatctttgtatagtaactgtatcttgtttatgtcagcaatgcctactataggtctggcaaataatataagaatatattctaaacaatgtaaggaattatttattccctttgcttttaggacattgatatttctgaagtatacgtgccacttattttatggcgtatccctcaatttttatttttctgttgttaattcatgatcagatttagattgtgattttttggttagaatactgtgtaagtgacgttgtgacttttgcagaatatcacacctacaggtgcttgatgttcattagccactttttgataatgttaattttgatcccttgggtaaggtgaggttctccactgtatcactactcttttcttttataaataaagagcagtcgtgggtagatactttgtgactatgtaaacatacaattccacgtgagactttctccactttgattcagtatctactgatgattcttacttgattgaacttcttgtaacttttgattttgatataatttatataattttaaacttacagagaagttgccataatgatgtaaggaagccccatatattctttatcctgattcaccaattgtttacatttgttttacgtttttaatctgtaaaatgggggtaataagcgttacctgtctcacagggttgttagttttctttgtcttcttttttgtatatatagtatagtatatatatgctatatactatagtattttatatatattagtatatatacactatatactatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactatgtaatatacattagtgtatatatatactatatactatgtgatatacagtatatatatatactatatactatataatatacattagtatatatatactatatactatataatatatattagtatatatagtatagtatatatactgtgctatgtagtatagtattatatagctattaagtattagtttgtaataatagttatcctttctatattttctattcatttaagctttctgaatactgattattctctgtgaagctgtgtgtgtgggtgtttgcatgcacaaacacatatgaggtcagcaattttatttactttttttattactctgtcatatggccatggaacaaatatttttcaatgacaaagtttaatagaaaaggctctggaaattaagaaagccaatccatgaatacttttagtcatgactcttttaaaaattactttccttgtgcatactctttaatttatttcaattcaattctacagatagatgtagaatgtgcttactgtatgcgggacattattttaagtgctccgggtatagcactgataaaaagggcaaaatcctttgttctcaaggagtttagaatcttaggtggtagtcagcaagcaaataaatactatatgttatgatagatggcaaaaagccctaagaaaataaagtgaggcaagtagtgacacagttcacttattagttttctgttatccggggactgagaatacagtttgttaatttattgaccctgcttctccgtcttctggacgtttgttatgtcagtcattcttactgttagttgaggccaaagaaactgtaatctagaagttatttagtcctctacttagggagtgggtagtgaatgagtctttcaaaatttgatgcaattatccaaaattagtgaatgtgtatgcgtttttctgagacaagtttctatacttttcattcagttatcaaatagtctgtgacccaaaatatttaagtggcgactctaatttgtcctttcttctagccacatggctaaggagttttgtgaatgagtaacacagtcttgattaacatgaggtttgcaggctagcctttgtgtacctatctctagttagtaacttttaaaattagagttgtatccttttgtcagatggctttctaataattttctaaaatgaacataataagtataacattgtaaatatttaaaatatgcaattttgtttgtagttttaaaatcaaaatacttgatagtttcttgtgtgatgatatatattttgagtagtattttccaaagacaatttataatatcaacaaagaaggctaactcatggcaatattacaaatatacacgtatctagttggggaaagaatatactgattggacagaacacttaattggagaaattgggaaaggaggtgccactaactcaatatttgacaatgtatcatttaaccctttacaacttagtgaggcaggtcttattgtgtccattttgcagatgagaatatcgaggcccaaagaggtgaatagaatatgtaacttgcttaaggtcaattagtatggaacttcacagcccacactcagctgctactttagcaaaccaaatgaaagctagggtaatgtttactcattataaaaaggatttctggacatgctttggcctgcagataatattgtatgtgtgacaggtgggaggggtatgtgtgtgtgtgtgtatgtgtgtatgtatgtatgtatgtatgtatgtgtatgtgaagaaccaaccaaatattagctctataggttgcagtcctgcctcctaccaaagccatagccaagtggaaatacaactttttttcttcctctttcatacattcattttcatgtgaatacttctccttgaaagtttgtatatgttatgtgattgatcacttgtctgagaggaatctttagtgttgactctgtcagaggctgttgtaggtcacaaggatataaaggtgaataagactccagctgtctcctaatggagattgcactctactctgaggagatagacatgtagacaaattattgcaatacactgatctaaatgttaatagagaaagatgcagagtgctgagggaacagagtagcagactacagagggaagggaaaggaaaaaataacagaggaggtgacactggagtcaaagaagaggcatgtgaaacagcatagtatgttttgggaatcttatttgtttcactgtggctaaattatagataattagtaatatgttttagaacgtaggagtggaaaggttgttatcccatcctgaggggttttgtatatagagtttggattttattttgtaggtagtaaggagctattggagaattttaagaagggaagtgggatgatgggacgaggttctataggaggcaggtagcccagttagaagactattgtgatagtctgggaatatgtggatgatgagaatctgaaatgagtcatgaattttggaaaatatttgaaaaatatttagaagatactgtagaacaaattaggtgaccaaaatgccttatatttataatactttatagtttccaaaatcctttaggtgtgcatgttattggatattatcagtaacccagaaaagtaggtagttcagatggatttatttccattttatatgaggaaattgagatcttgaaagattgtggcttagccacggtcacatagctggtgatagtttaagcatgaaccaaatcataaacttcaaatatagggttctttttaatttgtctgcatcatctctatgcagtgcctaagcatacattagttaatatcaaggcctgatcacagtggggtgtgagttttaatttattcacttgatatctctcttcattagttatgttaagtgcctaatggagagggataggatcaattaaataaggtaaatgcaacattttacaggtctatataaatacctagaaagtgcttttcaattaagacggcatgtatgccagtgcttttttatatatgagaatggttatgacatttattcctattttattggagagtctattgcatgggacttgataatagtggcaggctggtatcagagactatgcttgctgtaatcagtgttaaagatcagtatgtaaagaatccttacttaacatgtaccatgaaattgattttttattagttattatagagatattatagattatatctctacaacatcttccttctttttacccataacctctaaaaggcttagtgccagaaggaacagaactgtatctttattttctcatcacatcctctctcaaatagataatacttccattgctgtctttccaacttggctttgagtcactgctgtgattctagctgttgaacagtctttcaaattaagtgattagtattctagtcaaggaaaaattgtgagcctgccattcttacccagtattgctaaggtagttttactaaatctattattagggtcatgttctcagaggcatatgacaattgcatttcacaaaacttccctaaatattgatacttgagatttacaggaaattaaatctaaaaccttacacttctgaagctggaggcaccatagagctgtgaagttcagtataaagtcacatctgtgctcaatactttataagaaaagttactctgccttagtcttcctttactatttttgtcttacttgattaaaattttgctgttgtattaactaataaattcaaaggaaatgttctgattagtttctgtcataactgggaacgatagtaagagtaccttggaaagtatgatagtctgttgcgtaacacttgctgggtagtagatatcaattctctgcctgtttcaatctcattgtgtctaaaggtgtgaacctcttaccatctggatactttagtttccctctaaattaaaaagaaaaaaagcaaatcttacctgtatagtacctacgcaaagattttggaagatagtgggaagtcattaaagtgcttttcaccaatttatgcaatttactagttgaaatttgtaactatttaaaaatcattagttttaaaaaatactattttaaaatagtaatttactatttaatatttaaaaaccattggctcttttaatatatttcattgcttggtattagaattttttatttttagaatagagtatatttaaagatgacttttgctgttaaatttgacaggcgtggcaggaggccaatctaataagcccaaagggagaattcgcagagtatgcaggttaaaagagccctggaactgactttctgtgaagcctaggctatccatatacattcctgctgagtggagatttgcttaaagttgactgttttcttccttctgtaccatctgattccaatctgcacctgtcttttatagctagagaccgttggatggcagcttaaccttcagatggctcactctgctcaagcaaaactaaaatctcctcaagctgtgttacaactcggagtgaacaatgaagattcaaaggtaagaaatggtatcccattaaaaggatgtattttgtttgttaggacttaaactttttattcttagcagtctttgctctctggatttagaatttaaacataattcagttaaacagttattaataagtggatcttttttgacagaaatagcttatcttgcaaggtgcctttcttacaaaaacatttcataatgtcttcttttaaattctgcagtgaaaaaaaattgttgaagaccatataaaattatgattttaatgttttaggtatttgcagatattcctgagtgtttcatgttttaagctgaatatatgtggtagagagaatattgtttgttgtccagctagagcctggaacaataaatatgatggtgacctgaattgtgtttttgtgtgtgtagtagtatagtatgcctgcatgtgtttaaatcccagcttttgagaaatacaatttatttattttttttgagacggtgtcttgctgtcgcccaggttggagtgcagtggcgcgatctcggctcactgcaggctccgccccctggggttcacgccattctcctgcctcagcctcccgagtagctgggactacaggcgcctgccaccttgtccggctaattttttgtatttttagtagagatggggtttcaccgtgttagccaggatggtctcgatcccctgaccttgtgatccacccccctcagcctcccaaagtgctgggattacaggcgtgagccaccgcgcccggcctacaattttttttataccacaggattttactttattattaatttcagaacaacttgaacgtgattattaaagatcaaagcattgctatgaaatactttttgttactgcggcatatagggaaatatatctttcagatatgataagagctttttatcatattttatactgtaatggattatcttttaaggtagaaaagggggagtgactttttcctcctaagtagataagactatctcatcttaagacaaaatagaattgagaatgaggtattagagaagatctgaggcaggagattacagtgactgaatgataatagaataatggaagaaatgttattatttataacaggaattgaaggatgggaatattattacttttttgttaaaactttcgctattcattctattatgcaggtttctggcttctttaagaagtatctagcccagattatatgactataaaattctgtggaattgacttgagtcttacatataatgtattagtttattacagtgtttcaaaagtatcattttatttcacacattttcactggaacgtaatatgaacttagtggttagagtcaagctattagagtatgtctggtggtttccctttatgtgcagtttcactttccatagtttcagttacccgcggtcaactgccgtttgaaataggtgagtacagtacagtaagatgagagaaagagaccacgtccacataactttattacactatgttgttgtagttgttctattttattattattgttgttaatctcttacagtgcctaatttataaattaaactttatcataggtttgtatatatgggaaaaaacagtatatattgggtttagtactatccatggtttcaggcctccactgggagttttggaatgcatccccccacagtgggcagggggactactgtgtgctctgcagtttagtgtagtgtaacctcaggcaaattacttaatctttgattctcagtttctttatctgtaaaatataggtaatagtatctatctacacaatttttatgaagactaaatacctagtatatgtaaagtgtttagtccagtgcccagtattacagcgtgtgctcaataaatgctggctactaccatcatcatcaataaaacttttttgtttttggctaaaataaagaaatcaatccatttgttttaattcagagctctcactaaatttatttcctgatgaagttattacctcttcccttgttccttgcattccctctcccttttttcttgattatatttttcacatgtatccttactggaaattaggaggggaaaaagagcctgaaaagtcccttttgtttcttctgtgaactgagtaagttattcctttaggtgtaggatgatgatctggaactcactagcatagactggagctattccatgagtgaaaatacatacatacatgcacattccaagtagctatatacttcctttgttttatttttcgtgactacctaatgttaagtctgcgtagctaaaagcattttgtatgttggaagtgtactattttgaccacatacattggatatgctttaagcatcatgagttcagcaatgcttgtctttgggattctcaagtccttctagcttctttgttacatcttcaaagtatgcctatgtgtctgttatatttttaggcagtaggaataaaagagtaatgcttctagtaagacagccatgttaataagacattcagattattcaggaagatgtgaatatctagatgtgaaatctaactcatttgaaatatgagcttgagtacatttatgtttttctgtgtttgtattttgagattttggatagatgcatatatgcacattgattaatcttataacttgcagagctagagcaccattttcattaacaaatatgctgaggaagaagaggagaagcacacatacataaaagatatttctctttcatcttgtatgtagacttaagtgacttctttgtattgtctttctcttctatggcattgtacacattttgtgcctgtgtcttatatctcctaaacaatagacagacacataatgaggtatagagctaccatcacctaggcagaagcatgccatctccaagtgttatggtgtgccctagctgtaaaggaacagttaactactatacctcttttcctcaatgaactgctgcctggaattactgctctttctcttgtttaccttctccttgattttatgatttggtattctattctttgtactcttcatcttattccttatgttaatttttatgtgactcctgttattaaggaccacaaactacttttctttcaaatatttacaaatatgaaatgagaattcttcacaggttggaatattaagtaaaaaggaatgagggtatagagcatgttttaaaaaacaagtttattaaaggaaaggaaagcttttacaaaaagggagattaaaagttaccactgcttagtttatgatataaagtatcttaaagtacaaaactgtcatacttatgaagttggtgttggtttaaaacaggaagcattgggtacagttctcataaatgtgtattttatagggtagttatcctgaaaatatacatatattaaactactgggaggattagaatcactgtaaattgtgagggattattttggttgtatttacttttgagctgttgtactgaaaacttactgtaattcactgaagagtacggtttataaggagctccttatcttctttttcacttctaacatacaaatgaaaaatgcagcctgcagtgaagttttaattgctatcacactggataacactgtttgactgtggtctcctttcttagaacacttctgtctcgaggctttcctgttttgctattaattttatcacaaaaactaggtgattgtagctttcctgcagtattttgatatgtattctagttgtttttggttaattgtcttagtgtttgtctactgtgtttagcaaagtgagattattttcctgttccacagatacctcaaatcgagttttctgacttaaagtttttttcgttagggggcagtagagtgctttgcttacctagccttttctggcattcacagtgttatttgaaataacattcaaaataatttgtgaagtcagtagttgaaggaaatgctaagtgtttacatttcaaatctttatagaacaatagagttctcttatttatttccataaacaaaattaatgcttattaatcatatacatatagaacaaataaatgaaatcatcatgatttggcttttgaaatttgtatatgatcatttgccaaaatgaaatatattaaaagctttctacattattgacttttttgttacattctgtcacttgtattaatttcttcatgagaaaaaagaataaaatagtccataagataattgaatggctctattaggttatgatgtaactagttctaggcccattgtagtcagctgaaaattctttatttctagagagtaatgtcatttgtaacaaatgttgataattttgactgacaccaacactttaactttgaatatcttaaaatacttaaattttgctattaatcttagtacatttttttccccagtaaatttcctgttaaagacaaacctgttttgttaatacagggattccaaattttatttgtgcatcttttgaggaaggatccttgtgtttcatttttttttcttttacagtaactgtggtaaaatcaccctgacagtagaatttttatttatcttaatgttaaattagattataatcagattgcagaaagtactttatgtagaagtaattatgattttgaatgaatttggggcttctaatactagttttctgacttagagctcttcattcttatttccaaaatatatgacaaattctgtttagtgtgagaaaatgggcaaaagttcttttttaaagtgtttactctgtgctacacatagtatcacttctttttgtggttaaaacctctcttccaggcatgatttcttattattcttattttattgataaatggagacacggaagcacagagaagttaaataatattcccatgttatacagatagtaaacagtagacctaggatttgaatccaggcaattttatttgagttccagtttatcagtaggatgctgtatcaccttgttaatttaataacttagcagttgaaattgtaatatgtgtatatgtttcaaggtgttgaaagctgttgtaaaatgtaaggttgttcataggattatcgttacatggactctagatttaatttttctttcccctttatttgactaagttgaaacaattttacatttttagtcaattagaaacaccatttattcttatgtagtaagtaaagtataaatgatgtcagttcaacagaggctgccttttattaacaaatattattgtaagggctacatgacatcaatgatgttgatgtgagcaaataactgcatcagttaaaaagaaaagatgtcctcagatctatttaggatagatttctcagagaaaaatatgtatgctattcaaatcatgaattcttgttatagaaatttaaatcttttcatcttaaaggtggtgttagtattgactgatttggaatgaccttcacattttttagctacttatgtgagttcgtctgcattttccttttttttttcattgaagtatcacgtatcatatctttattagaataaatcacactaaagcatactttctcacccttaattacacatacaaatgagataattcaactgataggacataattcaaatataaataaaatcattctctcacatatttaacattgttgagtggattttaaattgtatatatttaaggtatacggcatgctgttttgatataaatatacatagtaaaatgattgctactattaagaaaattaacccacccatcacctgccattattaccttttttgtgtttgtggttaaagcacgtaaaatctattttcctagcaaaatttcagtttacgatacaatatcattaattatagtcctgatgctgtacatcagatctccagacttatttatcctacataactgcaagtttatatgctttaacctgcttctccccattttttccctttccttgtctctgataatctctgttctaataggcatttttaaaaaattccacatataagtgagatcatgcagtatttttctttctacgtctggcttatttcacttaccataatgtcctccagattcatccatgttgttgcaaatggcactatatcctttttcaaggctgactcatactactatgtgtgtgtgtgtgtgtgtgtgtgtatgtgtctgtctgtatatatgtctatgcgtatatatatgtacacatatggacacatacacataccacaatttatccattgatagatagttacgttgtttccatatcttggctgttatgaataatgctgcaacaaacatgggggtgcagatatctctttaacatactggattcatcttctttgaatatataccaagcaggagattcctggtagttctaatttgaatttttggaggaaccttcaaactgttgtccttaatggctataccaatttacatttccaccatcagtgtacggggttcccttttctccacattctcaccagcgtttgttgtctcttgtctttttgataatagtcattctaacagttgtgagataatatttcattttggttttgtttgcatttccctaatggttagtgatatggaacatcttttcatgtatctgttggccatttttatgtcttctttggagaaatttctatttaggttctttgccccttttaaaatcaattaatcttagtacattattattattttgctattgaattgtgtgagttccttatacatgttgtatattaaccccttatcagatatgtggtttgcaaatttttcttccagtctgtaggctgtgttttttgttgatggtttccttttctgtacaggagcttttagtttgatgtagttctacttgtttattttttgcttttgttcctcaagcttttggtgtgataattcaaaatatcagactaggatgaacatcaaggagctttttctctgtgctttcttctaggagttttatggtttcagatcttatgtttaggtcttttatctcttttgagtttgatttttgtgtatggtgtaaaggtccaatttcattgttttcacatggatattcagttttcccagcaccatttattaaagagacaattctttcgttattgcatcttctcggtagccttgagaaaaattaattgaacatgtatgcttgggttatttctgggctctctatagtattccttttgtctgtgtatctggctttatgccagtaccatactattttggttactataactttataatgtaatttaaaattaggaagtgtgatacatctaactttgttttactttctcaagattattttggttattccatgcgaattttagaattttttttctctatttctgtgaaaaaatgccattggaattttgatggaattgcattgaatccatatattgctatgggtagtatggacattttaacaatgttaattcttccaattcatgaacgtgggatatcttgctatttaattatgtcatcttcaatttctttaatcagtgtgttatagttttcagagctttcacttctttagctatatttatttataggcattttattctttttgctctcctagcaatggtatagtagcggggggctgggaagaggggtggtggctgggaaagtgggagcacataaataagattgttttcttgatttctttttaagctaggtcattatttttgtgaagaaatgcatctgatttttgtatggtgattttgtaaggtgtatgctactttactgaatttatttgttcatttaacttttttgtggcgttttaagggttctttttctttaaatgtaggataatgtcatctgcaaacaggaataattttattgtcctctctcaagtgaaatgattttttaatattgcctgcctttttttaaaaatcatgattcatttttctgttaccaaagctgtatgtgcttactgtagaaaacttagaaattatagaaacgtgaaaggaaaaactgttaaacttaccacaaagatgcaggtaatccatttgttttattttatttagtgtttattcaacataaactttttctccagtctgattataggacttgtttaattttatattctaccttttttcacttaatgctgtaacaaatcattttttatatcatttcaaactcatcattaatatattctaaatgactgcattatgttatggctatgacagacatattaggatttcttaataattcttaccctgtcaaatactgggtttgtttctagtattttcctgttacattgtaataaacatctttgtgaatatatacttagatgctcagtaaacctttatgcattatgaatgaattagagaagccttcttaggatttagggttattcctcaagaggatgattactaggtgaaagggtataaaccaaaataaaacaaaacatcttatttagtttgataaatggctttctgaaatcattttggggaatatacacagaaacgcaaacgttgcattcagaagatttcttagcttctagagaaagatataacactatttcaaaaataggttctttaataactaggtaattaattactttggattttaggaggccagtaaaaagcccagatatttttgtaatattatagcgccccctcttttaaacttttgtattactttagtgcacaaattaaacaagcttttgttatgtgtattttgttttattatagaacatgtagaaggaatctgatcaaatactcaagcagttagagaaaatagaaataactcttatgtgttagataattgccaagatactttgaaaacaaagcctgcttctttggaatcaaatttatttaaatatttttaaggctttgtgactctggtttcctgattctttgttttgtatcctttttcattgtgatcaatttctcaatgaaattatccttcaaggttttacgttttctaaataacagcaatacagaaatgttttccctcaatttaatgtgtgtttttggtttttttttttttttttggttttgtggtcaacatgactttttaaaagacaatattatgtagtcaggtatattgatacaaatcatatgtatataatttctgcataacgcaatgcaaacttcctccatatatgtgggtgtgtgtgtaagattttttcatatttcaggctgtcaagtggaaagtctacatttatccataataagattttataagctaacaaaaatactgtttcagatgctacttacctttgaagagtgaaaatacacaatattaatacaccattagaggttagtatttatgtggagaaaatgataatagagacttggaggagaaaatctctgttaaaaatactccaaacattttaggcaatttagaattaaaatattgttttactaaaattcttttaaaaattttgtgggattccatagtaaagaaacaaatactgtcttcacttgtcttttctagcttctgaatcgtgtagtctctgaaacccagaggcagttgataaatacagaatttttaaaacagaatatgtttagaagtacctttaaatttcattagataccttttcatgtattagaaatgacagtaatgtaaatgaataatataaatattttgacataaaagtattaacaatgaattagacatctggacaagtaaaatgctcaattcaataaagtaaatatgcactaactttttaaacatcttgaattcagttccagaaatagtttttaagcatttactacatgtgagttactaggcaaggtattcgtgatataggcaggttttattttctgtcatggagcttatgggctagcaggaaatacatatgttaagccagtaaatataagtttgatgactagtacaaaggaggaagtacatggaaaccaatagcaaggaattagaaactgtgacaggcagagaagttttcagatggaggaaaaagcacctgaaagacgacaggtttattttttgagcatttcaaatatggaggtacctgagatatccaggtggagattgtcaggtttgtagtctgagacatgggagcaaattgtaaactagaaattgaggtttggaaatcattgagtttataatttcagtcatgagaatggaagagatcacttagaggatatattagaactaacatttaaatgacaagtagaattgaaggagcttatgacagtgattgggaaggaacagccaaataccaaaggaagagagcatttcttaggggtgaatcatgtcacatgttgctactaagtaaagttagagggaagcagggtcagagagagaagataataattctcacagccatgaagtaggtgctagtattttcctattaactagatgaagaaacccagactcagtggttaagtatctttctctaaattggatactagaaagtgatggtgctataatttgaacccaggtctgtctgactccatagtctgagcttataatcactacatagtgttaaaaaatgaatttagtgacatggagatcattggtgatcagtttgtgggacaggagaaggaaatatttcaagatggagggcagtattggatgctatttgagaggtcagaaaagagaagaatggacatgtgactgttggattttgtaaaatggacttctctgataacctagacaattatgatttcaataacaattgagaggagaagaaagaaacctaattgggataaactgacgaaagaatatgaggtgagagtggaagtagtgatacaggtaactttcggaaataggacagtttatgtaggggaatgtggattcagtaaatggagatactagaggaggtttgtatgcagatgccacagatccattgggggagaaaatgatgcagaatggagagggatatattaatacatttcttgagaaagtgagatgtgagattcagagcacaaacggaaaggtaggattcaatcagagtgggaacatttcacttgtcttcatagagaagagtatgggtcaggtgagtggttttgatggtggaaagagaaagttgcaatgatctgattgcttctgttttctcaatgctgctgtcatgaggttgggagaatggggcggttctagtaggtttgagaacagaggacaaagtgtgaaatggttattttggatattggacaattgaacaaactgggtattttagggtatttttactattactacacagtgctgattgcccaattgtgatttgtgatcacgactttgagaggagaactgttggcaggttgtgtagttttcttcatctatttttaattgctcaggtgcacatgtggagtaggtggataattgggtttaatcatgcttttatctttgccgggtgttgtcagtggagggtgaaaaggacaaagggtttgtctgtgtctatgaaagagtaaattttagtaactgaccctggagtctaaattgggccaggtggaaagtgaggatattgtgtatgtgtgttcggggcagggtggtaagtgatgagagggagaaactatctagaaatatgctggaacctagccatactctctgatgtggttaggctttgtgtctgcacccagatctcatcttgaattgcaatcctcacaatccccacaatccccacgtgtcaagggagagaccaggtggaggtagttgaatcatgagggtggttcccccatgctgttctcctgatagtgagtgagttctcacgagatgtgattgttttataaggggctcttacccctttgctcagcacttctccttcctgccaacttaagaagaaggtgtcttgcttcctcttcgccttctgccatgattgtaagtttcttgaggccttcccagccatgctgaactaaactgtgagtcaattaaacctctttcttttataaattaccctttcttgggcagttcttaatagcagtatgaaaatgcagtaatacagctttcctagaggtttatagaggagcctcaaatagatgcattattttccaggatcactcagtgacttttaatttgagtcttgagatgtctgtggcttgacctggtgtacagtttatctgttaagacaaagaagtggatacatgtaaaacttgaaagctggtcttttgcgaacctttaccctgcatcaccttggaaacaagtggtctaattatatgaagatttattctgtatcctaggagttcccaatgtgtgtccagtggctactcgttgatctcttgcttccttggttgataatatacccagcatctgctggagatagtagagtattaatttcataatgagcccattaccccagtgatactatatccagaaatcaattaaaatgtgagaattttgtatgttgtttgaattatattagcttttgaacatcagtggtgatttttggaattgtttttctgaatctggtattcttattttgagggtattattgtaaattttacttcaagacagagtaaagatgtctagattaagttttcttatgagtaatttgcattattggatactgaatccagtcccaattattttggcaataaaaggagttgacaaacacttctttcctggcatagtttaaataagattttaagcatgtttacggtgttagttactatgtgaatacttaaatatgtctttaatggattgtggggattttagtcttttcagattttttctttcctttatatgagaattatttagaggaagttaaacttatatgaagaggaagaatacttgtaactatatatttctcagaagaaattattgggcacttttggctgttttgatggtattgggagaagggaagattattctattaagttttcatataaaatctctttatttttgtttttcaaagtttctcagctgtccttaatacttatgatccaaagctgcaacctttcagaaatgccatgtccatattttaaaaaactaaaatgctttaaggatttaatcagatcctcgagtcttatatcacaggacttatttggaaatgtggccatcccgagatagctaatgatgatgagtctggtttgggtgttttctttttgcatatttagcatcaacccagcaccatcggttctgtgtttttggtgtgtatctggatgatgtatttgagaatctgctgaagacagctgttcggttagtgcacaaggaacagtcaattttagttactttatcatatgctggagattgatattcataaagcagtgggaatataccgtaactagggtcattgatgaacaaagggatagaaatggggttgatgaagcagtattattctttatctcacgaattatcctaacctttgctaccagcacaaagaagagacagataggattaatataatcgaatttttacaaactcattttaacttgcttgtttcgtaaatgtttgattcctaagtataatcaatgaatagcaaattatacagtattttaaaaaatatatcatattttaagcttttaaaaattggttgactatctgaaattgacataaattttgcttatagtcagtaactgctattatgacatcagtgaaactgtatgttgtgattgttgcggctggttaaccaaaacatgtatttcacaaatgacatgtaatgggtgaagatgaaatgtaatggaaaatgaatgtgtagaaagaaattcttgtttatttcatgtttaaagaaccttgattttgtcttttaaaaaattattttatactttttaaaaattacacaagtaatttacattgaggaaaaataaaaaaatgtaagaaaataaaattcacctagaatcctacctagaggtaatcactttgagtgacgtatttaattggcatatatctttccaagtctgtccattgtaaactagttgtctttccccataaagcattatattgtaaacaacatcttttattgtcagtacatgagcttctactcagcaacatcattttaaatgactacataggattctgttgtttgtatgttccatttcttatttctttttttggtaaatataatttatttattcaaatagtccttcagcagtacatttgcctttaaagccatatttaaaatactatatactaacatgttgactaaagtgatcaagaagattttagaaattctattcatgtaaattctgttggaattctagtaattgctaaaatattagatttttattgctgagagacttcctttttcagggattaacatgtttagacatatagtttagaatgtcttttaaaactatatgtgtgtttgttaattcatgaggtttctaaaccatgagattttgctccttccctttcttcctctctttctctttccccctcttggcttcttctttatgatagagtagatacgaagtttctttcagacataaagaagttctaccctatccattataaaggggtaattttacccatatttaatgtgctgctacctccttggtgagagcagtaccataaatatcccaggataacacctttgttgttgtcaacagtaaaatgaccagaattgtctaggtacaacttcatttatggaatcagcaaaggctg

SEQ ID NO: 221 - DNA, 76800 bp, Homo sapiens
aaaaaaaaaagtaatagccaaatctgttaactctgtgattcctgctttggttaatgtagattattatcacatgatattaaagagtcaggattatggagttaatgttttactggtgcttttttttttaaaaaaagaaaaatgtttattatttaaggctgtgtgcagtatgtgcttatattcaaacatcccttatgctgttagtcacagaaatactaactatgtgtatatgaatggcttttcacagtctatataatgattggaaaaataactaatatagtatattctaaatgatgaatctttatcttcctatataaaggacatcatattactaattttcaaatttatcagtaagacactgaacaaagcctaaaaattaatggatattgttttaatgtgatgtatgatttactaaattaagcttaggagcatttctgtcgatgtattcctatctttcagtatgtgcttacatacaaataacaactttgtaagtattttctttttacagattttcagtaatttatatcagaagtatataatcaagaaactttagtgtttctgtccgttaaatatttaaaatattttattctaaagtaaacccttttggcattttttaatgtggggttgcctcatcaaattttgcatagcctacattacaatcatagaatcttgagttttggaagagactgtaaagttcatttcattcattcagcatccatttggtggtagtgtgctttgaagacttactaagaaattaacacctaggataacattttttactttgcaaaatgtcattgtattaatattttacgcaaacaatacatgaaattacagtactttttttctgtttcttgccaaattgtaagtagagttgaaaacagaattattttttggagatatgatcttgccctgttgcccaggctggaatgcagtggtgtgatcttggctcactgcaacctctacctcctgggctcaagtgattcacccacctcagcttcctgagtagctgggacttgagtgccaccaagcctggctaatttttattttattttattttttgtagagacaggttctcactatgttgcccaggctggtctcaaactgagcacaagtgatccatccccctcggcctccctacgttctgggattacaggtgtgagccaccgtgcctggccccagatttttattgtctttgaaacagaaaattcatgaaaggattctgccattttattcacctttctgacactgcagtaaagtgcagattaaagtatagttccctgtgaaatagccagttaccctttgagtagactccagttcacataaagaagtacagggagattacatgacttgcctaggttatatattgagtcagtaggagaagtagaaatactaagtgcagattcacagttcagtttagcccagaactatggatgctttccttatggttattacctggaaggctttacaatcactgatgtaccctccctgctgtctcctctcacttacacatatgcagtcttgattattttgataatttttctacatttatacacacttcacacataatttttgtttttttaaacctcagtttatagccttaagttatactcaggaatgtacattgtactcttaagcagaaagaccttaatattagttacagctgaagagtgagcttaatttctaagtacattttggtttttccctttttgtatgccttttataggtgttcacctttagcagccagtctcttgactttgcctaatactataaagaatagcaaacattgtattgacataattggttgttatggaagtcatttttaatagaatgaccataccttatttattaaaaaataataaactttatttttcagagcagtgttaggttcacagtaaaactgataggaaggtatagagatcccccgtatattcccttcccctatgcatgcatagcctatccaattatcagtatcccctattagagtgatatgtttgtcacaatagatgaacctatatgattatcactcaagaccctagttaatattagggttcacttttggtgtcatacatttcatggatttggacaagtgtataatgacagtacatccaccactgtagtatcatataccataatttctactacacggaaaatcctctacagtcctgttttacattttcagaagtgtcatatacctggaatcatacagtatgaagtcttctcaggttttcttctttcacttattagtatgcatttaaattctccatgtcttttcatgcatcgatagctcatttatttttagtactaaataatctcttgtctgaaggtaccacagtttatttattcatttacctactgaaagacatcttgattgctttccagttttgctaagtataaataaagctgctgtaccatccatgtgcaaatttttgtatgcacgtaagtcttcaactcctttggataaataccaaggaacatgtttggtggattgtatggtaacagcatgtttagttttgtgagaaattgccaaactgtctttcatggtggttgtatctttttgcatttccactaacaatgaaatgagggttcttgttgctccttatcctcaccatcatttggtggtgtcagtgttctagattttggccattttagtaagtgtgtagtagtttctcatttttgttttaatttggatttctctactgacatacggtgtggagcatctttttatatatttatttggcatctgtgtaacttctttgatgaggtttctgtttaggtttttggctcacttttaagctgtgttttcttattgttgagttttaagagttcttcatatattttggataacattcctttatatcagacatgtgatttgcagatattctctcccagtcatctttagcttgtctttttattctcttaacagtgtcttccccagtatagattttttgtttttaatttaatgaagtccagcttgtcacttctttcttttatggactgtagctttgatattgtatctaaaaagtctgtttgttcaaaatagtaatgatttggatctgttagatcaattaagaatgaaacaaagttattttaccattatgtattctttccctaatgctccctctttatgtagatctgagtttctgacctgtctcctttaacatcttttaaagaactttaaaaaacatttcttgtgaggcaggtccactagcctaaaattttcttgatttttatttgcctgagaagatatttatttctccttcagttttaaaataaacagggtctcgctatgttgcccaggttggtcttcaactcctgggctcaagcaatcctccagagtatctgggattacaggtatgtagcaccatgcctggctttcttcttcacttttaaagggtgatttcaaagggcacagaattttaggttgttgggttttttcctcaacactaaatattttactctactctttttgtattttcaatttttgtggatacatactaggtgtatatattaatggggtacttgtgatgttttgatacaggcatacaatgtgtaataatcacatcatgaagaatggggtatccatcccctcaagcatttatcccttgtgttacaaataaattatattattttagttattttaaaatgcacaattaaattattattaactgtggtctccttgtgccatcaaacagtaggtcttattcgttttttctactatatatacttttttgtacccatcactccaccctttttgcttgtactgtttctgaggaaaaattggatgtaattatctttgctcctctgtaagtaaggtgtttttttcaccactttggcatctttcaggatttgtctttatcttcgattttctgtaatttgaagatggtatccttaagtgtagtttctttggcatttatctcttttggtgctctgtgagcttcctggatctatggtttcgtatctgacattaatctgaggacatttttagtcactattgctttacatttttttcctgttcttttctctttcttcttctacaatttttatcacacatacgttataccttttgtagttgtgccacatttcctcctgggttttttgttttgttttgttttgtttttgtctttgcttttcagttttgaagttttctgttgagatattttcaagctcagaggttctttcctgagttttgtccattcaacggcattcttgatttctgttacagtggtttttttggtctctagcatttcttttggttatttcttagatctctcttcttgtacttcccatctgttattgctgtcttcttatcccttagagcccttagcatattaatcacagttgttttaaattcctgatcttatgattccaacatccctgccatagctgtgtttggttctgatgcttgttctgtcctcttcaaactctgtgtttttatgttgggagaagagaagtgttctgttgtcctatgattaggtatcacttttttagtaagcctgtgcctcttgactgtgaatttcacaagtgcttctcagtttttttatccttctccagttggacagatggctagagtgagctggagttgggtattttctttctcccacctggaaggctagtgccaactggagttggatattttccttcctgtaagtcagttaggctctgatagaactccaacaggttaagctctgtttaaatagtttcctctatgggcagaccttggtaagaagcacagagtgatccggcatattttaaaaatggcgtgtcctttcctttgctggaagcatgagtggatttttctccagtattcactgtgagaaccagatcaagtttctggaggttaaactcaacagaagtgaggagcctccttatggctgggtgcccctgcatttttcagtttttacagttgtccacactgactccagcaattaattgctgtttaagttttcttacactggcactagctcccatggaggtttctacttctgggtttctactccaataagttacaattctctgtatttacatctgtctctccaatctggggggcaatggtttaccctatgacttgacttctcttatggatccgagaagaatcgttgatttttcagtttgttgagatttgtatttgttgttaggatgaaatggtgacttccaagcttcttacatgccagaccagaaaccagaaatcccagcttaatgtcacagactgacatggactgcactgcagcattaaagagaataagaagttgtcgttgggtttcaagtctgtgaaacaaagtaaggtttttaatttatccaaagttacacaccctgcaagtgacacaggtgggaatagaatctaaatatttggactcccaattaaattatctttctttttattttattttattattattatactttaagttttagggtacatgtgcacaatgtgcaggttagttacatatgtatacatgtgccatgctggtgtgctgcacccattaactcgtcatctagcattaggtatatctcctaatgctatctctccccctccccccaccccacaacagtccccagagtgtgatgttccccttcctgtgtccatgtgttctcattgttcaattcccacctatgaatgagaacatgcagtgtttgtttttttgtcctcgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatggaatggctgggtcaaatggtatttctagttctagatccctgaggaatcgccacacagacttccacaatggttgaactagtttacagtcccaccaacagtgtaaaagtgttcctatttctccacatcctctccagcacctgttgtttcctgactttttaatgattgccattctaagtggtgtgagatggtatctcattgtggttttgatttgcatttgtctgatggccagtgatgatgagcattttttcatgtgtcttttggctgcatcagtgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggtttcctgttcactccgatggtagtttcttttgctgtgcagaagctctttggtttaattaaatcccatttgtcaattttggcttttgttgccattgcttttggtgttttagacatgaaggccttgcccatgcctatgtcctgaatggtattgcctaggttttcttctagggtttttatggttttaggtctaacatttaagtcttgaatccatcttgaattgatttttgtataaggtgtaaggaagggatccagtttcagctttctacatatggctagccagttttcccagcaccatttattaaatagggaatcctttccctatgaatgaaatgaagcgagaaggaaagtttagagaaaaaagaataaaaagaaacgcagaaaacctccaagaaatatgggactatgtgaaaagaccaaatctacgtctgattagtgtacctgaaagtgacagggagaatggaaccaagttggaaaacactctgcaggatattgtccaggagaacttccccaatctagcaaggcaggccaacattcagattcaggaaatacagagaacgccacaaagatactccttgagaagagcaactccgagacacataattgtcacattcaccaaagttgcaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccaaccaaactaagcttcatgagtgaaggagaaataaaatactttacagacaagcaaatgctgagagattttgtcaccaccaggcctgccctaaaagagctcctgaaggaagcactaaacatggaaaggcacaactggtaccagccacagcaaaatcatgccaaaatgtaaagaccatcgagactaggaagaaactgcatcaactaaggagcacaataaccagctaacatcataatgacaggatcaaattcacacataacaatattaactttaaatgtaaatggactaaatgctccaattaaaagacacaggctggcaaattggataaagagtcaagacccatcagtgtgctgtattcaggaaacccatctcacgtgcagagacacacataggctcaaaataaaaggatggaggaagatctcccaagcaaatggaaaacaaaaaaaggcaggggttgcatcctagtctctgataaaacagactttaaaccaacaaagatcaaaagagacaaagaaggccattacatcatggtaaagggatcaattcaacaagaagagctatctatcctaaatatatatgcacccaatacaggagcacccggattcataaagcaagtcctaagtgacctacaaggagacttagactcccacacaataataatggaagactttaaattatctttctatttcactaaattccacttttctgaaaggtgatatgaatggttcatatagggaaatattacagtgaggcttgttattgtttgtaataccatattcatttagatgttttctccatcctcctttttttttctttttttaccttctttataattttccttttagttctggttcctgatggtactgaatattaagaagattatctgccatttttgaggaggaaatatctaatagtataatctttttcctctatgttacaggcagaagtataactgcagcagcaatctgcctttcccctttatttgaatttacagaatatgttaaaatcaataataagatgcaaataaaaaatcactcattgacacttaatatgctgaatacaaattcagcaccataattaaattgcaaagtttaacattatactccattttgatattaatatttgatcttgcaatgaatgtctgcttgtcaaccttttatttactgtggaggtcgtggtatacggtattaaagaagacattcaactagagctcaatttttctgatgagctcccaggttcccatcgcaattttagacaacacatgctgttttactggaagagtatctaaaggatatagtctgatcactctctacctcccatggtaaaccttctgtttgttttttgaatttggtagttaaaggtgcatgataaaacttgccatctctgttagatgctgctaaatgagactagtaaaatgactgccaagctccagccgctctttattttattgctttaaacatagatttcctagatggtcatgatctggtttgtccaaatccaccttaactcttaaagcaataataaatataaattttaaattctaaatgaaagagaggaaggggtctcttcataagtgaaaacattccttaaacaaatgaaagcaaacagaatttttttcatggacctgtattttcatttttctgaccattatacgattttcctagcaatataaaagaattctgcagtccctccctatttagttgttggaagagaaaaatacattaaatcttaattagtatactacctatagtagcatctggtgttactgaatttttaccatcttctgaaagcagtaatcattctttacctggaggaaaagattccagtaatctgttttattaggaaacttttctagccttcctttcagttacgggatttattgaaaactacctcatatacatatgcacatatacccatatatgcatatgtatatatacatgtgtgaatacatatatggctatagatctgtgtgtatgtacacatatagacacgtgtgtatgtttttgtgtgtatatgtttttatgtgtatctgtatgttcctttctaaatagcattctatttcataccttggaaaaatataaaattaaaaaatgaggtcaagatggcgccttttaagaaataagttgttataacagttcctttcagcttcacatcataagtgttaagaacacttgagtatttttaatgtaaacatattttagcatctatttgatttttactttattttcttgatactttcagatatatatttgctttacattattctcagggtttcttatttcccgaaaacactttgaatcatttccactgattctttttcctcccttgttagtttacatgtatcatttgtatgatagtgtctggaagtaaaagggcacttgagaaacaaagttgaataaaatttcatcatacttaattctgaaaattgttttctgaaattattagctcactgctgaaatatcttcagatcaaacgttcagaacatcagctcccaaggagcttcatatttagtttatggtggggtatgattgtgtatttcacaaaattcatgaaggaaatttgtacaaatttattatggattttaggccagcggaactgtttaaacttcctactctatttgttccattgagtagccttagagttgaaacagcagtttccatttttctcatgggtagatcaacccatatgcacatttatcattgatttctagcactggaaaagcatagacattggagacggtggtcgggcacggtggctcatgcttgtaatcccagcactttgggaggccaaggtgggcagatcacctgaggtcaggagttcaagaccagcctggctaacatggtgaaacccagtttccactaaaaatacaaaaaattaactgggtgtggtggtgcacgcctgtaatcccagctacttgggaggctgaggcaggagaattgcttgaatccgggaggcagagattgcagagagccaagatagtgccattgtactccagcttgggcaacaagagtgaaactccatctcaaaaaaagaaaaaaagaaaagaaaaaaattggagacagctgttcacgtatttaaaggagggagaatattcttggagaatataattggtgaaataaaaatacaattcatatgtactctatggaagataaactgcaataagcaaacctctttggcagattttaaaatcagaaatatattccagccagtgtgggatattcaatctaatttcctttgagaacctgattctgttggattggtaggcattaggaagcaacagctcttctctctccatctcctcaaaaaattgtaaacggaaatgttgtatgaaaaaaacttcaaagatacattctaatttttttcttttgctattttaataggcttttttattttttaagaactgaggttagtgaacatgtgagagaatctgaagtacttttcatatgtttttgtccttgaactgagttatttgaatctggcaaatttctctattaataattacaattattatatcactatgtcagtatgtgtgttatattcaatctagaatatttgctctttttactcccatggttttgaaataagcatataggcatttaatttttaggagttataaatgtccaatagctatgttttatatcaatatgaactgcattgtgttttattactaatagtttagataaatctgtatatccaaattgtgaaccactgaaatgaataattccctttcttagagaaggacatgaatatagtgagagatctgttactttctggattcttctttttggtccttcaagaagttgtacaaagataatatcgatgttctcttttattcatcagtttctctcaactggtttcagaacattgcagtatcagagaggggaaaaaaataagtatttcagatttttttttcttgagacaaagtctcactctgtcacccaagctggagtgcagtggcatgatctgggctcactgcagcctccgcctcctgggttcaagcgattcttatgcctcagcctcccaagtagctgggaccccaggcatgcatcaccacacccagctaatttctgtgtttttagtagagatgaggtttcaccacgttggccaggctagtctctaactcccagtgatccacctgcctcagccccacaaagtgctgggattacaggtgtgagccaccatgccctgccaaaaatcagtattttctctgtatcacactcccaacctttaacattgcctcccattctttcttttggctgttatttaatgagagactactatgggtaggacattgtgttaatctctgggaataagagaccttcatattcctgctattatggagttgcggtttagtagagatggtaggtaagaacatgggctcctgaattgcaatgcctgggttctgttcttggttgtggttgtactgcttactagaaaagttgaagaaatcacttcattatttgtttgagtttccttcttgctgaaataaatataactctatcttaaataagataatgtatgggttaaacaatgcatgtaaaacatttggcactgatgttagaaaagggaacatacaggttagtatctctaaccatgttgtaaaagtgatttgaccagctgtattcagttataaacattttattgcacttttggagccttttccaagtcctgtgtaacctttggaataccctctgttcacctccccccaccaaaaaggctcctgtaagtccatcacttcttggaagcttcctcatttaacatcccctgtctagccattcctatacatgaagcagacacgactccttggtatgcactgtgcagtaatgaacagttattccctccttgtacatgttgctaatgtggattatttatttgaattctgactctttgggatccctttgtttataattttaagttcttagaaggatagggaccacagtaatctaccttggtctatgtgacacttgcacctttagtattcaataattgaaacacataaaagtgatttcagtggaggtgagcacaagcttccttttttcactgtgtgaatagacatagaggtgaccacacgtttttttcttgtcttgctttttcactaagctttctctgtgattgagaacaaacagggaagtctgaacggttccctgttattttatcttttggatgtagaggcatacatacaaatttctgttgaatgctttgtaagggttacctcatttattcttaaacttttacacagttactgctgtgtatttatgggatgcaggtactgtttatccattgtaattatagttcgtttgttagaccaaacattgggaaaatcttttgttgtgaatggtgattttctaaatttttacttttgttttttatttgccagattctgtctctcttttctttgttcttggtgtactaatctgattcctcttccatggctattccactttttccaagtcttaccctaaagccttttaaagcgatacgtttagatcaactttttttttctttttgtttgtagtttgcacattatatgctgtactttgactaatttaataattttttcttataattccatgtggaaattttaattttagttttgttttcccctgacctttataaaaacaagagattaagtgtaatattttctacttactgcttcaggctttgtaaatttggcacttaatggtttcattgttttagaacagaaaagattatcttaactgaccactaacaacatagttgccagtttggcgcaccaaatctgtagttaatactgatttcaaaatagtgtttcttggcaaatcacaaccaaaagcttagaatattctgtatgacttttagttctaaagtaccttgcaagtattactgttaatctcattttgtagcagaaataatagaccaggagcattaaaaggacgtatttgtttattcatatggctagtatgtgtggtactactgaactgaacccatgcttctgcctagttaaatggtctcaaaacactaagaaaaaaagccaacgtataaaattcaatagcggttagtagcaaggaatgagtgttatctgaagtcatagcgtgcttgttaaagtattttcaattaactttctccacgcgtctcttaaatatatgtttttgtatatatttacagtttttttggacagatctatttggcagtcttctttaagatattgtcagctactcattcacaagaatggtgacatcttaattttaaaaaacattttatatagttactctctttattctggtgcaataataatactacacactgggtaaattgtaaagaatagagatttatttgacccatagttctgaaggctgagaaatctgagagcaggatgctggcatctggtaagggccttcttgctgcatcattatgtggcagaaggcatcacatgaagaggagttgtgcttagaagacagagaaaaaatcggggccaaacttattctttttataactacctacttccttgataactaactcactcctgcaataacagtcttaatccattcacaagggtggtatccacctgacctaatcacctcctaaaggtctgacctctcaatacatttgcaatggcaattaaatttcaatgtgagtttttgaggagacaaaccatagcagttatgtattttgttaaacttaagcattttattctgttaaattatgtatgtatttatatatatatatacatatatatacacgcaagcacacatatacaggcatacttatgtgtttatatgtgtgtttatagatctttttcttaggaagataattatattttaaaagtcattgatggtagggatgatagcagaggaagttgtgaaatacaatctaagtaatattatagagcatacgttcagtattttgaaaactgctcaataagggtatatttgttgacaagtaatagatcacattacaaacttactattagacattgtttatctagtcagcatttatgaatagtctgtggtgatctgtgtgtttatattccacatacagtctatcaacaaatcctgtcatttctactttcagaatatatgctaaatgcaaccacttcttactacctttatcactgccaccttatttcaaaaccaggttttacttatttactatacgatcttgtccaagtgtttatagtgttaggatttttcttttcacaatcattcgtcataggtaaagaacttatttttctctcacatggtacattaaaaatagaagcaagcaagtaattgtctttaaaaattttttgctttgcctattattattcctctagaaaagataataataatacatagttacaagaacatttacattgaagaaggtgacttaatatttgaaattattgtgtttaatattatttcggtttttattaatgcttggtatattttgttaataatttaaatattgctaaattttggaaaaaattataatggaatcattatattagagttcttcagagaaattcaaccaataagggatggttatatctctatataattatgtttatgtgtgtgtttatgtatatgtatgtatatttgtatgtatatgcagtcatgcatcacttaatgacagggatacattctaagaaatgtgttgttaggcaatctgatccctgtgcaaacatcatagagtatacttacacaaacctagatggtatagcctactacacagctatgctatatcatatagcctgttactctaagactgtaaacctatacagcatgttactgtgctgaatactataggcaattgtaaaacagtggtaagtatttgtatatttaaacatagaaaaggtaatgggttgcactaccacattatgatggctacagcatcactaggccataggaaattttggttctattttaatcttatggggccaccattgtatgtgcagttcatcattgaccaaaacatcattattcagtgcatgactatatatatatttgtcacttattagcacattaatatggatttgtataaataaatttctagtaacgctcaaataacatacatggatgcattttcaattgcttctcaaatatatggagtattttaaataagtagattccaaaaagcaaaacaagtttaataaatgtctatttgcagctacattacacactcatacacacacatgcacacgcacactctctcacagaggcagtcaactgttcatgaaatattaagattatattttacaatgatatttaaaacttgaaacatacatacaaaacaatgaagtgtgatagctaacagcacagacttggatcagatagaatgacatttgacttccagctctgactttctgagccttggttttcttatgtgtcaagtaatgataatacctgcttctttgtgttgattaaatgagaatatatgtaaactacttgccatggtgccctgtacacatcatacacagtaaactattaccatctgtattttaattcttaattccttcccctgaacacaacttgataaatattctttaggtttctgttcctcctttcaaaagttgatttaattcataatgtaacttagcgtaatataaataataccatagaaataaccatctgtagcagtggtttgatgggaaaatacagtcacagctacaatttgataagccaggaactgtatttttccctcctgaagttataaaagtagaagtagtaatcctctctccaggcatccttttatcttttgaagaatagaagtaaatatatctacatatccaagccagtggtagtccttctgtattggggctttttgcagaggattggggctttttgcagagcaggcctgcaaggggaatgaatatcagaaatgaggttccagtgacagaaggtactgaaatgctgtgtgtgtgtgtgtgtgtgtgtgtgtagaatgtgaggggggttggataggttcatgtgggtgtaaagtgaagagataggccagggtgatagatgtatagaacttctgattttaaaataagcatgtaagctgtatactatttaatgaaattactattgacattttattgaaattaaataatgaattcatcacattttatgagaccaactttaagaaaactagctggatttttaatggtttgcttcaacttaatagtggtatataacttagtacaaacatcgaaggctatcagaaaatgtatgttagaattttaatgattatagaaactgtggaatattctgtatatatctgacacttaaaattacttgttctggggtatccataataaaatttatgtcatgtggttttttgggtcagtattttcaggtataagcctggtgtgtaacagtgaatgctcttagaagattgggtctgtatcttttgtctctgtaaattacacaatgataggaagttaatatgttagggatttaataagtatgttaatgattatctataaagataatatgctttattttttgattggtttgtcatattttattggcctgctttctgctagaataccattatgatataacttgccaaggagccctagggtatgaaaaaacagtcttccctttttaattatgagaagttcagagaccttctgaatatattaatgattactactaaagcaattcttaataatttttccactaataggagttgtaaagatgccagactcaaacagatgtgaatactaggctcccttgctagttgagttcttgttacttcacatcagtcttacagctttctgttagtgtgagtcacatgtgggtctcagcaaaatgataaattagcatagaccctggacctctgggtcatggtaaaaataatcactgaatattaaggatctgtgtaaagattcttaacctgtatagggtctgtgttcagaagatctgtgaaactcctgaaattgtctgccacattttgtgtatacgtgcatacacattttttctgtgaaggatatatgagtattttcaagtctgtaacccatgaaaggttaaggaccaacggatttataacctgttcagaagtcttttacattgagttaccatttgccatctcatttcctcactaattgcatattagtgaggaaaaacttagataccatatatttttttattagtcttattttaattttccagaaaatttgtgaccttttcataatacagtgttatttcttctttatgtgattcgtattttagtacaaataccatgttaaggtgcttgataaaatgtgaatgatttatgaaattttacttatatacccaaatttgttgttaaaagggacaaaaaggaatttttttgtattttacattcagtccttttcatggaatagaatattttaaaacaactttggcttgaatttttaattatcatatttagaaatcctgcttttatgaaaatacagaaccctcactctgtggcttacagacaatagtagtatattatgtagggtagcctaaacaatggttgattattgtgtttgtgtatatttcattctctctgaattggacttgagaggcaaactttgtctttaaacctttagctgttgctttctggacctttgtattgcctaagggatgcaaacttcttggaaagtagaaccataaagttgtaaatgaacaagggaagaaatagaaaatataatttttgtcttcattaatgtttctaaagtagacagtaatttcacaattacagtatccactctcatgaaatttactaactacattaatgagcaaatgtgaagctgttttgctaatgtggaaattaaattttttaaaacaaaacttttttattctgtcaccaaagaaagaagcacattggttatgttaataaaaataatagaataaacagtcattcattggatgtttaattgttacaggcacttttacatattaccttactggatcttaaccactgtaagcattaaatggtattgccattttgatgaggaaactaaaacatgtagaagtttcttcaaggtgttctatgtgaccttcaaaaccaggcaattaatgggtgcttaatatttgttaaattgaattgcattgaaatctctttttactctgatcttttcattagtattatcattttttcatttatctgcggttaaattatggcctcaattttgggactccaggcctcagtatacattaacataggaaatatacccatttaaatgtctgctacattgtttcctgcagtgattcttctttttataatcaaagcagtgtgtagcaagcttttatcataatattttggaaaaatacgatctcttttataatcctaactgttagctaagtgaagcagattttctatactttcattcccacttattagtcacaaattatggggctggagatgagttgagatattggaggtcttttctccccagccttctatgcaaatagaggattttcattttttcttaatagtttgtggtgtttttcctaaaaagtaatccttaatatagtttttacccatattggtttagtttcttttgagagaaaatatattttattgatatataataattatacttttggtatctctcattttaaggtattagcctcatttttaaatagtgtttgaatcggcaaatgggtaaaaaatttgggtgttatggaatataagaaaaagaaatgaatagttgtatagtcaacattttatacagatgtaagtatataaagtttatatcaaagaaaatacttcaaaatattttaagtattatagctagtattgatgcagtatggtcaaattcatttagtgagggagtcattactgctacatctagcttttataaaatttgaaaaattcatgaatattatattaaatattttaccactttgggaggccaaggctggtggatcatgaggccaggagatcaagaccatcctcgccaacaaggtgaaaccctgtctctactaaaaatacaaaaatgagccaggcgtggtggcgtgtgcctgtagttccagctactcaggaggctgaggcaagagaatcgcttgatcccgggaggcggaggttgcagtgagctgagatcaggccactgcactccagcctgggcgacagagtgggagtccagctaaaaaaagaaatatatatatatatatatatatatatatatatatatgtatatataattcatataaatatagtactttatttaaaaataaatagcattttctcctcttctcatttgtttatacttttaatatgttctgtttacttgtaatcaatgtggagtcttcttttaaaaaaaaattaacattgctgttgtgaagaaaatttgcagatgaatattggaaaatatactgaatacctagaaggaaaataatgttttttgtccttcttaatatagaggtcaaaatagaaaagctatttctaaagttgccattcgtgggaaaggaaaggccttatcatttatagaatttgatatcagggaacagttgttctgaagtaaaacaatccagaccattaccacattgataattttctccaattagacagattagaggtttaatcctaaaagaaccccagtatccaatatttttgcctacatctttaacattaaggaaatcctgtttttaaatttatatttttaaccattacacaagatctttattattggaaaaaggacagacgcaaattaatcagaaaatttctcattgaggaagattgagtttttaaatgtatgttaacaaaaggtagaaaaactcatcacacttagcatgtatacagtacttatatggactagaaagtttgttcttgtgctttcagtagaagcataaaacaaatctgatgttgtcatagagatagtttcataataggttatgtttttgtacaagtcccatattttcactagaactattacaaacattacagtcatcagcagatgttacacatgtctagcatagaaatttctttttttgtttttgttgtttgtttgtttgagacggagtcttgctctgtcaccaggctggagttcagtggcgcgatctcggctcactgcaacctgtgcctcccggaggttcaagcagttcccctgcctcagcctcccgagtagctgggactacaggtgtgcgccaccacgcccagcttatttttgcatttttagtagagatggggaatttcaccatgttggccaggatggtctcgatctcttgacctcatgatctgcctgccttaggctcccaaagtgctgggattacaggcgtgagccactgcaccgggccctagcatagaaatttctaaagtggatataaattaatcatatcaattctaaattacagtttagttaacattttttaacctgttcttcagttattacactgtatttttagtccaaaaaaagatgaaaggatttatcaggatgttttgaggggatagatttttaaataggtcattttgaagatacttttgagtagacatagtcattacatagtcattaaaaaaccagagctttacatatttttataaaataatttttaaattctaaaagtaataaatgaccttagggaagatttggaaaatacaaacaagtatgaagaagaaaaaaaaaagtccccgcaatcccactgtgcaaatcaaccactcttttttttttttccaagccaaactgtatccagctttattaaagatactttccataaacagtcgtggtatttcaggcagaacatgggcagacagtcattaacagtacacaacaactttcaaacttaactaccttcttcaatggactaccgaaaatcagaaagccactataaaacccaatgaagtcttcatctgatgctctgaacaggcaaagtttagagtgagggttgacatgtcacatttagcatgttgtttaacaacttttcacaagctgaccctgactatcaggaagtgaaatgaaaacggcagaatttatctgaagatccacaatctagaaacggaaccactgctcttttgacaggtgccatctcagtggcatcccggaaaagtccagattgcctgacacactggtaaccaatgactggaggtcaggtcccaacagatgtctgggcttaagggagttaagtctgtgctgatagatgggaagggagaagagagataaaaatgattttgtttttccataccacaaggcttttgtgccaaggtggccatatgtgtcaaagtcgcggaatccctcctgggagccaagagtaagtctctcaaaactagaagggaaaagtgttttccccacatcaatccagcttcgaagacaccctattagtgacatatgccccttccccacaaaacaacaatgaagtgttctgtgtgctaacagcatagctcaaaaaaaaaaagtaaaacaaaattttgcatttttataaaacttggtaaaaatagtatttcaaactgttcagtcaccagaagtacacagttatcaaaaatgcacacacttctcttggcacctccagcaccttcagctttctgtgcctgatctgttttgacatctccattttctgcagggttattcccctccttgccagcatcagcttttccctttctccctttgggtaccttctctcccttctttgcaggggcctttttaggcctgggctctggctttggagaagcaggtttagcggacaaccttgcagatcttctctgtggttcgtcctttaccttggctttatctcctttagcatccccttcagcctttctcttgggcatggtggtggcagtgatggtggtgggacataggcactgggcgtaggatgcagaggcatgtgggctttggtgagtccaggggtcgttcttgcctcttgttcatactgctccaaatcaaccactcttaatagtaaattctttataaatattgactattgtgtacatttaagttgtttattacttttcactgttaaaaatagtttttcctcacacaatttctaaggatgcttcttaatgacagcaaaatgcaattttctaaagaaatttatccaacttgataaaaccaagagtcctttacttaggacaggtatatggggtagtggtaagagcttccctattccctgtttgacacaaattttcttggaagcaaggaaagtagaaccatattcccaagaagcattctcttggtgaggcagaatagaagaaagaataaatactatgagaacattttagggacagtcctgaatagtagtcgagtagtaagggctccaaaagaacttacattccttcctttgtcactggaaaatcccagttagctttgaatagggcgttgactctacccccatattaatatttttagacagtgttatagattgaattgtgcttcctcaaaatttgtatgttgaagctgtcactcccaatgtgtctgtatttggagatagggcctttaatgatgtaattaaggttaaatgagatcataaggatagggctattatccagtatgactggtgtctttgtaagaaaaagactagctaccaggtgtctgctttaatagagaaaacctatgagacaagaccatctaaaagccaaggagggaagccacaggagaaaccagccctgcggacaacttgatcttggactttcagcttccagaactgaaagtctggaggctgttgttgaaaatctggaggctattgttggtggctgttgtttaagccacccagtctgtggcatttcgttaatggcagccctagcaaaccgatacatacagttttctccctttcccttccccttccccttcccattttagtagtagtgcagtaggcggaataacagctcctcacagatagaaactgctactctgtggactgtgtaagcattaccttaaaaggaaaaaagattgggagactatcccgggttatctaggtaggccataagcacaataataaatgtccttataagagagaggcagagggagatttgacacagacatacataagagaaggtggtacgatcactaaggtagagactgggataatggccacaagtcaagaaatgctggcagctagaaggaggaagaggcaaaaagcagatttccaagagggaatatagccctgctgactccttgttttctgcccagtgaaactattttggactttgtgagggaatatatttctttttgtttaagctattgagtttgtagtaatttgttttcagcagccataggtaactaatgcaaatagctgctgaaaataccaaatacttttctgtgtctaatgatgtaatcttatggttttgaatcatatgatgtttgctttctaatttgtgaaaaaatcatatcgattactttgctatttttttgtaaactgcctctttctggtatttttttcaaacactgatggatttgataatattttgatagagttttttattaaggaattaaatagtctctactttttcttttttatactgtctttgtcaggtttgggtcataaggttatatgttaaattgttttggatacatagtcggagcccaggttattctaaccttgaaagtcagttatcaaagctgaagctttctatgatagacaattgggagataattttggttcttaagtagaagaaaccatattaaagtgtgttttttaagataataagacataacagtacatccaaaaattgtttgtaggtacctagggagcaaaatcaggcataaagtctcagataacaatctaggtactgagtttctcaaacacattctgtctcattcatgttcttcaggagtgaagactacgtgaattgagttttgggggatttaatcaggaagtaaaggaattctaagcccctagagaatgtcacagtagatgactgagaggtgatcatgtttatcttttccctgtaattctttcattccattttttttttctttggaagaggtgaacatcgtagataataaactttgggagtgttaggggatggaagggaacatgtctgtataggtcagagtttctgaggttggtagccttggactttttgtgagagaaagaagagtagagttataaggatccagggatacatatgcaacccaagcattgtataaacactggaaaaataatataactcacacgtctgttattccacattttcaaatgtacttaattactttgtaaatctaaatcatcaactgaaaaattatgtttctaaatttgtggcacctgtagttaatgctttcaaacaacaaataataacagcttatacctattaccctatgggaatctgtagagtgggtttaaaaaattattttaaagggaccatcttttaaatgaaaccctccctataaacttataaaattaatcagggaagaagggatggggagaaacaaaaaccaagcttgcagcacattcagcgttaatcactaggtgaggcttgctctctggtctgcttcttcatagttgtttggtgcctattgtcctacaatcacaaagaccttagattataattctccttaactgctccatagaaaacaacttgaacattatgaaacattaagttttccctttgagatactctttttttttttttttttaactgttccaaaggcacattggcacctttgagatacactttcaggtcctgcataccagtgaaactacaggcaccagctggtctgacggtgagctgtctcagcaaatgcactcggtatcttcatgatttcatctcccttattccaaccaatcaatgaccccaaatttccagccccttgccctctactatctccttaaaatccccagcccagaactcctctgggagatggatttgagggtctcctcccatctcctttctcagccaccctgtggttattaaattctttctgtgttacaaaccctgctatctcagtatattggtccgttactgtagatcaggcgtacaaatttgttggtcttgaatctaaacaccagtcccttaatcttattactgaggatactcttggctatgtagttactcatggttacattgctagttagttacagaaccctggtgagagcctgtgttttcaagatctcttagaaatgctgtgaagaaaaggtcttaggtttaggtcttagtagtaattatttggtttgactttggaaaagtgtagatacctgcatctcctcactgtgggctatgcacagatgaaatgtagcattattacgttttgaaaggtgcaggatagcttctgtttttcaacattatgctttagttgttctagccaccattctttatttaaatgagtaggaagccaagagcaaagtaaagatggatttttggagtcctttgcttattttcccacattttttcttaccagagaacacataacatagacaggtagataggaagggagggaggtagataggcaggcagttcaaccagaaaaaaatcaagcctgttttagcaggttgtgaaaagatgaactgaatctgtcaatgtccgcatcttctttagttaccaggagtggatgtgggtaagccttggtgcagcagataatactgataagtgtatatgttccaaatagagatgtggtcataggaggaaaaagaatgttaatgccatctgggatgttaagaagttagggaaggacacagagcataattgagatgaaattgtaacttcttactctcttcagtgatagtcaaatctaatttaagtctgttactctattctcatgaaaacattctcaagagttgaagaaaataaatagtaaggcagtctgtatggaccttaacaaaacttagttttgactattggaattaaattttaatattttaatttggaaatctcatcctgaaatctcttttggtaaaaacatggaatctttttagtatgaattagaattattctggtcaacaattatagtttctgtacccattagggtatcaaagtcttatattcaaattatattaaattgactcattgactcatctagttcagtgggaatatgattttagaagtagaataaagtctacttgtatttgtaaagttgacactatgttttatgagggaatttaatgttcttttcaggaacatgaggctggacagaaagataatcttacaagaaattatctcagtttttcattttggccttttgttcacaaaagagctagaattcaaaagaaaacaacatttagcctatttatttatttgtttattattttttgagagggagtcttgctctgttgcccaggctggaatgcagtggtgccatctcggctcactgcaacctctgcctcccaggtttaagcgattctcctgcctcagcctcccaagtagctgggactacagttacatgccaccacgcctggctaattttttgtatttttggtagggacagggtttcaccatgttgatcaggcttgtcttgaacacctgaccttgtgatccacccacctcagcctccaaagtgctgggattacaagtgtgagccactgcgctcagccgccctttttaatactatggttattttagttgatatcttcagattgctcttgattggagtatataaaatatgtcatagattgtgttattttaattttacttgtctatgttcttatttctttgaagttgctatttttcactatattttgctgtcacctataaattataaatattagtcttaacagaagtcagatattttctatattggatttttttttgaaaaaaaggagataggataaaatgtaaggaaatcaaatctaggaactaatttagaaaagtcagaggatttttatttagtattgagaagtataagataagttaaatgtatacaccagagaaaaaaagttcttattacaatgtaatatgtggaacaaaaaaaaatagtaaggatatggctatctatattttattttaatgtttatttaacaaatatttactcagctccaaattaggtactagaaactgtctcagactctgggaatatatttccacacatcctggtcaatgaaacattaaatttctaattagaaattttagaagttctaagaaagcaaaaagctcatggtgcttttggaacatagtccagggagatttaacctaatccagagaagctcgggaaaaatttgtgccagactataaggtgagaccgtaaggttgagtcagagagggacagaaggggtttggagagaatgttattggagtgtaggaatagtatgttcaaaaactctgaagcgactataatgtattgtaagataccctgaaagaagttcatgatcgtaggagtggaggcagtgagaagaggtgaagccagactggaatggttcaaaggcaacacttgaaattacctgattaaaataaggcactcaacatagccttaagaatgaaggttattccatttggtattctttgctgaactgcttaacagtatttttatgtttccatgtgctgaattcattttataaatttttttaaaagtaatgcatgtgtttggagcagcattataagaccatggaaatggttttactgtttgtctcttttacgttttttaagaacaaagcttccattttccacttccatctcttggactattcatttaacggtgatctttctgtttcttaatccaggttctaaggattctggggttggtagtttaactcttaatccttttaaaaaattgaaccaatgtatcttttcaatgagaaatagttcataaatcttgctactcaaataaatcatgagtctatatgaggacttcagttgggaattcgtttattcctgttcactagaattaggaaactctatgtagataggagccatctctgtgtttacttactgtctctacagttcccagccattgcctagtatattaatccatttttgttggtataaaggaatatctgagactgggtaatttacaaaggaatgatatttattttggctcatgtttctgcagactgtacaggaagtgtagtgctctcatctgcttctggtaaggcctcaggaagcttacaatcatggtggaaggcaaaaggggagttggcatatcacatggtgagaggagggaacaagggtccggggccgcggtgccgcactcttttaaacaaccagatctcatatgaactcagagcgagaactcatttattgtgaggacagcaccaagccattcatgagggatcttcccccaagccccaaacacctccctctaggcccacctccagcattagacatcctatttcaacatgaggtttggaggggacaaaacattcaaaccgtatcacccgggatattgttgatgaagtatttgttgattgaattaatactaaattttgttggcattacattttattttgactttaaatgctgatgagtatttgatagttcatggttctgtgataacatttaggcttgtagtgaataaaacattacaatattgtttaaatcttttcttttacatttaaataaaagatggataagaatgttactttaacattttatataatatcctttaacaatctgtaggctaatctttagtttatggggcttctaacccataatgcagttgtactgattcttttgccatttccaatttgttgctgtgaccatttggtgaatattttatttcacttattatactttttagatctagagttttctgtttttgttgtttctttttttctcttgagatttattctgtgttcactcactgatagcatatttttcttcagttctttgaatatatttataatagcttttttgaattactttacttgctaaattcaatgtctgagcccagttagagtcatttgtattgagtgtattttttcttaagtaatttcctgaagactttcctgtttgtttttttggggatttttttttttttttttgcatatgtagaaatttctggttgaaaactagacattgggaaacatatggtgaaatgactctgggttctgtcatattcttttgaggaccttggttttttgttctagtaggcaattaacttccttgggttgaaaccacaaactgtctcctgtgaggtattcagcttacacctttcctctgctgctttgttagcctgaacacctataggtcccccttgtatatgcacagtgtggtagcccaaagattttggcagatgctcatcttctttgttgtttctttgtgtctcagaatttcctcctaattgacagtagccatgccagctttgggccctatactctgacacatcaagcctgtctagattcatctttctaccactcaagctgtaaatgattgaaaaatgttctcagttaataaaagaatcacagattctaaaatcttgtttttttttttttctcttcctgctttttcactaggcttcataggcctcccttgctcatgtgtaaattttgttgtcagctaggaatttgtgtagcttgtgctctgaatttgagtctcgtgccttctgtgattagcttggtgctaacatttttcctttaaattttcagctctttttccagctctccactccaagttctagcatctttagccagtgcgatgccatttttttcttctccttttttgtagctgtagctatggagtttggtcagtgccttgcagccagtatgaactctcaattcttaccccttctagttttcaaaataaaactctcttcagccttatgtctgcatttgaaagtttgaagtatcttcaagtagtttgtttgctttaatctagtatcttattattggtatctctggggttttgtatgaccacgtcagtttttcagcatgatcagaagttaaactacttcatccctattgatttcaaatagtacatttaaaacaagggcttctaaacattcaatgaaattcaaatgatgttttagacattaacttacacctcaactcttccaaatttgtaagttcatgtttgcactttgtacttcccttttttttttttttttgagaacagcaaattatatttcagctgatggactttcctcagtttctgttaattacatgtgtgtctctatttagtagtgcatttagagtcactatttttcactgctgcagatatctagacatttgattggaaaatagttcggcattgaacttagtagcaatattgggggacttgggactaaaaagcaccaatcaacttagaaaaccaagccctgtagtaacacaagggaaaaaaaaaattcctgaagccaataccttgggaaataaagataatagaaatgaaatcatctaagtagatggccttaatatttctggacatgttccataaccctcacaggtaacagtggactggcatctgggagacaggacaaaacataaatgtggaatttcaaggatattcctattttctgttaaagttgcaggaagtatgaattactaaagactttacatatggtcagattgctgagtttcagtttcaaatattaaacactctttttcagacgttctcccatttcactctcatttcatatgagttcatattattttatgccccaggcccgaagtgtagataagtttactgctccattgtatactgtttatctgattcactctccccctcttttgccttctggtgttacagagtggtaagcaggaaagcagggtctgtatctatctgtgctataggttcactatccttgccataaattaagttgatcgcttaaaaagtatcactactttagcactagatttagctcgcttttaacagaaatttcatggtgatcttttctcatttcaaggcccttgaaataagggccttgttttctcgttaatggagcatctcattctccttcaacagggcttgatttcctttgaacaaacattattcttaccaataattctgataactttctggtaatttaattgtggttatccagcctctttattctccatcagttcattttagatattcttctgatttccttttgtctttcacaagatctttgaaatcccattttctctacatctttaatatgacctgaaaaaaatgtttgttcaatttatacatcctgccacaaaatagtactctgcttcaaattccacatttatgttttgtctcctctgccacaggtaataacccgtccactattacctgtgggggttatggaacatgtccagaaatactaaggctgcccacttaggtgattttattcttattatcttcattttccaaggcattggcttcaggatgttttttctccttgtgttttctgacttgattggtgatgccgagcattcacacagcttttcagtttctcagcttagaagcaaggaatgttaaaaagttactatcagtgcctttaatcatgaaaaagacaagtagaaggaattagttctctcacccagggacatcagtgtgtatgtataccagtgggaaccagacatcgtgtctaggtaaaatcacttatcacactgcagctaattttttcacctggtaattttagccaaactaggtcatgttataaatgtcagcaaggcaaaagagagaataaaatgtcatcagaataatgcacatacatttcaatggaggttaaaatcttttataggaaacaggattatgaggtaggagatttttttcattgcagcagtgaatgtgaatacagttactatgattcttaaggtattcactttggcctcattcctgctttctttaaattagaaaaaatatctcaagtttgcttacaggtaagagttttaagccaaataaataacagttattgtagtgatttggttgaaaaataaacttctaattcccctttaaaaactgagaagaaatgaaatatagtgcaacgtcagccacaaaatcattattttgatagctaacatcatttgtattctaggctagaattttaaaatttaaagttcaaaaaataaaattttattcacattgttgattttgcccaatgacacaagctatatgttaatattaaattaatatagacaaattaaagaaagtaccacatttatcactttcatatgtagtaatttttatttcaataaccagaattgtaggtttcaaaaaatgtttgaaaatttgctttaattaatagttttgacaaagaacctttaatagaccgctgcttttcttttcaaagtttcagttaaacctgaagaaataatatggtcctgctgtgatttttgaatgaatgcttttgtggttgcataaattgtgttttttcatgaatattaggattgtaaatgaaaattaagtctggattctgatccttttcctttcaagcttattaaaataagatcttttaggatcactgtgactctctccttgttagttttatgtcataacttagccctgattataaacaaactttaactgtttcttaattcagttttttcttttgtcatgagcaaagaaaaattactgaaataaataagcattgagacatattcttgtagttgaaaacttagtgtgggaatcatatttttgactcccagctcaggatagtattaggtagggtagattattttatcttcttgtaaaatagtgtaaaataaatatttgcctatagacattacagtttagagtagagaagtttcacattagaaagatgctgattcgtctttacatttaggcataaaagagggagtacatagagagcatttataatttatctactttaaacataattattttttattatttccctttgcactatttttaatcctactcatagaatgaaagatgaggcattgaacttgtatctaagattgatgatttgttttgagtctggggcagacagacacagtaatggcttagtctgatacaggcattttgggttcagtctctagggacaggtattcatatgtaataaaaccacttgaactggcattgattgccattgttgataatcctagcaggatcaacattgattgagtaaataaaaagatcgaatttaccttcttctggcaaggcaggcagagaagcaggacaaagcataaagacttgacagcactgtagcattacctctattcaactgtgcttcagagaaaagaagtggcaatgattaagggtactgttcaattcagcaagcaattattgagcagttctgtagcgcaacactgttagctgctaaaggactcaaaaggagaagacagtatgattttgcactaaagtagtttatcatctaaattggaagacaaacggttcatatgtgaaacagctagaaaacaaattatgacagtatataattgagtgtacagttgttcatgcaacagaatacaagcacaatttatttgtccagcaagtgaaaagatatatctttataatgtttataatgttaaattttgtgtggcaacataaagtaacatagcctgagttaattcaggtctttggttatttaagatgaaaaaacccccagcaatttaaatggtatttatttaaaatatcctttattttatttatcgtcctttatttagaccacctaaaaacactagatatatgattattcatacctgagcccccccaaaaaaaaatcaagactagcttactccctgttaatgattcaatcaattgagtataaactttattaggttttgttcactattgattctttgcctcatatatcataaaggttcattctgtctattttgcagtattttccaatgtctaggtattctgaattatgttcactaaaaagtaggtctcaaagagcatcgtaatctccttagctttgtataaggaagccatgtaacaaagcagccttactacgtttctgtttttgcttttgttttatttttatctccattacttgttaagtggtaatggtgtagtagcatcttaaaataccatactattaagattgagccggggaaccttctcctattctttgctcttcagatatttctctactgtaaccccatagctcttgaacatctcatgacatatatcattgtattttaatttaataaattcatttttctatgcactagactggcttctttgcattataaccaggacttcacatagatgctggtacctcatagatttctaataaatacctgctgaattaaggaaacacaaatttatgttctacatcacgatgttagtgaaaatttgttgctgtgtttatttctcacaataaataaacatggggtgcctcctgtagtagtgtcctatgggaatcaattattgatacccagtgatgtagacaagttgttttaaaaaagaaaagattgaaggaaagcagtctcctcttttaccagcccccacctcaactatataattttaagaaaattgatatcaaaagctgtgatatccgtttctctttaccatccaaagttcttgaagttgccttgacaagcagagattccttgaatcagtccaaatacatgatatatagataaataatacgtgtgtgtgtgtagacatctttagtagaaacagcttttcagatactgatttcatactgtcttcctcctggctttccattgacttactgatttcagatacagtttcaaattgcatcttaattgtggggagtggggatagtagctagcctctggctcctcttttttaaggttatttctgagactgccttggagtggttcaaaccagaataaatgcagtttactgcctatcactccatactcttaagatggttttgccagcttttagagcctctcagatgttctaaaataaggtcaagctgattctacatcctattggtggtaggtgttagtgatgtcaatttggcacaatgtttttgacttgagatagaatcattaatccagggatatcttgttaataaatttaccgactactcacttggaatttttgatgtagcagtttttaataatatagctttttcatgtcaacaagagtacattctgactgattctatttataaaagtatgcaatactaatgtttaatattagaacagttagcagtagttaactttggagaacaaaaatggtagaggtaaggggtcagtaagaggacttctgaggatgcaggtaatgtatttattcagcgagtcgtggttatatgggtgtgtttattttgtagtaactcattgagctgtatgattgctatacttcactaaaatctatggagatcaaaggctactttggcagctttagtctaatgacaaacttattattttcttaaacaatgggcaaaattttcttctgactttcagattcctacagtctaaagggaaagataaaactattttagtatgatagctaaaatgcttttgctcttttaaaattctcattataaagtgtattgtttattttaacttttatatgactgttattggctacttaaaagtctttaaagaaattaattgggaaataacagttgaacatgaatatgggagtacttacttcaagacaatccagaaaaaaaaacaacagaatataaaatgtaatgtttaacaaaaaacaaatgtcattttgtatttaaagaacagtttaaggtatgtttaaaacaactacttctgaactgaatgatactacttctcaccccctccatggcaaaggggtcatctaaattagttgtagtcagctgcaccaagctgaagagccactttacactgaactgaattttgtatggaagctggaaagaaccacagactttactaccacattctaattggcaggaaccctgcttctgatgctaaacagcatgtcaggattgcatactgtatcaatttcagaagtccaagttacatttgggtttattgtttatccagccacaagtaagctgccttctgtaacttacccattggcttactgggttatgattttctaattagaaatggaggactttgagatgttaaaagtgggggcccaataatgagtattgcactgcagatacacagactgaatatcactgtcctaaaaaaaaaaaggcttttaaattgaaatatcaaaatcatgattaaaatcgaaaggtaaacaagcaagataggataaattcaatccatggtgttggtaccagtactcttcacgtgaaaaggacctcggcataagtgttcagaaataacaaagatcaaccagcttggccaacatggagaaaccccatctctactaaaaatacaaaaattagctggacgtggtagcgggtgcctgtaatcccagctactctggaggctgagacaagagaattgcttaaaccccaggggggcagaggttgcagtgagccaggatcacaccactgcactccagcctgggcaacagagcaagactccgtctcaaaaaattagcaaaaataacaaaaatcaataagctgaaaaatgttataaaatttgacgttgaataattcattagacatgaaattacagagtgcttacatttgttgggtactcttttaattgctttacatatattaacttgttaaattctcaagcaacctatgagatacaggacaagacaaagagaagttaagtacatgtagaaggtcacacaaatgacatttaaatccaggcagtctgattgtaattctatgctcttacccttaaaaggattcgtcaattccggctaaatggtgtgcctgaataaaatgtggagcacggtagcatttataatatttattcattcaacaaatatttattgaacgcttacgattgggccaggcactatgctaggtatttatggttataatattcccccacttatttttggggttttacttttcatagttacctttggttaactgtggtctgaaaataggtgagtacagtacaataagataatgtatgtgtgagagagaaagactacattctcatgactcttattacagtatatagttataattattctattttattattagttattgttaatcttttacagtgcttaatatacaaattaaattttatcataggtatgcataataggaaaaaacatagtatatataagggtcagtgctatcagcagtttcaggcatcctttggaggacttgaaatatatctcccacagataagggggaactatacataacagtttatgaaagtccttgacccttgtgaagtctgtattctagtagaggtctacagacaataaacaaaaaagtaaaacaactaggttgtctaataaaatatttacatagaagctatgaaggggactgtaatttcataaggtggtcaaggaagacctcactgataaggtgacacttgagtaaagatttgaaagatgtgagaggataaaccacgaggaatgttctggaagcagaacattccaggtaaagaaatcagcaaggacaaagtccctgagaagaaagtgagcttggtatcttcatgaacaaggagagagttttaatgaagcacagtaagcaagagggagattggaagaggagaggtgagaggggtgtggtaggacagatgatgtaaagccattgttaggattttagctctcgttttcagatgggaagctatttgaggaatttgcatagaaaatcaaacctcaaaatgttgagagaagggttctagaagaatccttgataactggaaaggtgaagtttttacattaacagaagaggtaaagagtaataatcaaaaataggaagatcttcagtcagtgatgctaatgtgtctgaagagtcagggtccccagtaggggaaggaagaggaagaaagtgaaaggaggctaaaattttcactggcattgtaggtagaaagactagggtttgagtggacatctgctatggaagtcaggtgacagtggaggccaaagtaacaaaagcaggcagggaaattctcagcagcatcagagtaatacaatgaaattcctcatagaaatactatcaaggaaagacagagaaagccattggacacctatgtcaatcaactagggcagctttgctaacgaacacactcttaaatctggcaatcgaaagctgcctgtttaaaaacaaaaaagtaatgaatagcaatgaaaagaaaaaaatttcaattttagaataattattagcacaaggtcacatggacaggaacaattacccattgtttacataaattctcatggtagcaataatgtaatgcatatggctttgaagatgggtaaaattattactttaatacagtaaaacaggtaaatcatgaatgatgtagactgcttgtgccagtatatttgaagtaaagtaaaattcagtgttcaaatggagaaaccattgaagtgtccagtaatgatgcatttaaataaggtgatttggctgcaactgcattcatctgtaaataatttacacacagatcgagttaggaacttccgaaaaaatagtactcgttctaaaaacatccaattggataatttcacttataagggtaaagagtactgattttaaaaggttctcagagtctgttttgtgaagagatcccttaaagtataatggtggcggagcacagggaagagctcacatgcagccgcaggagagctagggaaaaagggtgacagctctgctaagccgccacttagaaaagagttggataagagcagtctcttcagagtctgacacctttcattttacggaaaaccttcacctagtctgtctatctcttaccagtgaacttcttcaaatgtaaaggtgtttgtaaaaggacataaaaatcaatcatttgtataatataatttcagatctgtgccttttatatatatacttttaccacttattttttccatctgtgaaatgtgctgacacctactttaacaaactgatacaattgagaagagagagtgtgggctgctaataagaagctctcagtcaaaacatagtcaaaaacagagaacagattgataatgaatacttaattctttttaggagtgtttttggtcctacaggattcagaattataaaagctgtaattccctttggctgcaaattgtaggcatgttgcttgcttgttacatttcgagttccaagttgaatcagttgctttcttgaacagttgaaaagctgtcatttaagcatttcaggtatttcattttcctgttacaatcctgggttagatttgctgttacttagctctcacctcttcatctattacagttttctccctcatttaattggagtatatcctcaaagatcttccacagaaaaggcatactggagatacaatttcagagttcttgaaggtctgaattatctgtttgctttcatatttaatagatagtttgggtatatagaattctgttttcaaaatcattctcctatagaaccttgaagacatttcctccattgtgtcctggaatttagggttgctgatgagaaatagaattccaatttgattcacattcttgtgttggtaacatctttttccctccttggaatctcttaagggttttcttctttatcttcgatggataaaacttcaagagaatatatttggattcaagtattttattcattcagttcgcttgatacttgctcagcccttccatcttaaaatcaatagttttcttcaagtctggtggtttttaaaaattacttgtctgattttctttctatagcatacatacattatttgtgcccacctgttatctttggttatctttgaacactcttttatatgttttatttgcggcattatgttacttagaaataagaacatcatatagtttgttagaaaaggatacatgttattgtaacagaagaagtagagcagaggaggaaatgtagataaccttgggtatggaagcatccaagatgtcttccagaggataagtaaacttggtacaaccagacaatggaatattattcagtgctaaaaagaaatgattcggctggacccagtggctcacacctgtaatcccagcactttgggaagctgaggtgggtggatcacctgagcacaggagttcaagaccaacctggccaacatggtgaaactctgtctctactaaaagtacaaaaattagctggtcatggtggcaggcacctgtaatcccagctactagggagactgaggcactagaatagcttgatcccaggaggcggaggttgcggtgtgccgagatcacactactgcactctagcctgggtgacaagagcaagactccgtctcaaaaaaaaaaaaaaaaaaaagaagtgatccgttgggccgtgaaaggacatggagaccccttaaatacacattactaactcaagccaatgtgaaaagactctatactgcatgattccaactatatgacattctagaagagacaaaactgtgaagagagtaaaaaagatcaggggttgggggtgggagatgagtagatggaacacagatgatttttagggctccagtaaataccatgtatgatactataatttattcaaactcacagaatttacaacaccaagagtgaaccctaatgtaaactatggacgttggttgattatgatctgtcagtataggttcattgactgtaacaaatgtactactctggtgggggatactgataatagtaggggttatatgggaaatttttatatcttcctctcaattttgctgcgaaactaaagccgatctaaaatagatttttttaaaaagtagagcagagtaaaggggttaatgtattggggtgggggtatgcaaattgcaattattgaatagaatgatcaaggtaggcctcattgagaagctgacgtgagcactgagcaaagactgtggctatctgaatgaagaatgttacgggcagaggatataactagtacaaggatcctaaagcagaatgtctctgatatgtttgatgaacagcaagcaggttaatgtggctcaagtgaattgagtgagggagagagaatggtgggaaataagatcagagaggtaaattgaaatgggctgcgtcactagtctagactttgtaggctagtgtaaagatttcttagtgtgacagagatgggaagtgtttacagagtagaatagtaatggttatatttgagtatttttctctttggtagttttattaaaacagatgtaacattgcagttttacaaatcacatgattttcaatttagttctatcataagttcataaacttgaaaaaaaatactacatcaagcttttattttaaaatgtagataaacgttacagaaaaaaaattgccaagcgcaatggcacatgctatatagtccagctacttgggaggctgaggtgggaggatcactggagcgcaaaagtttgaggctagcctgggcaacgtattgagaccctgcttctagaaaaaaaagaggcaagatttttaagctgaagtactcttaggaaatatttcacatgagcaggtattatctttaatctgctttttattatcatggttaaattatgagcaaagctcataaaatgcaataaatgcattttgtatttcttgcaagttagcagtggtgttaaatcttaaatctctgatctgtactaatatcatcaactcctactgagaattagaataacagtagaaactttgggaaagattttaaatgacaacaaagctaaagggtcagaatgtcgtcgtttcaaagcaattttcttagttgtaataaaggtaaatttaataaaagtaaaagcaatctgctcccagaatgttacagtattttgttttgaataaatttatattatctggaaatcaatatggctcatgttgcacaaaaaacaaggtctgaaaatagtaatgccctagagttccagtaggaggccatcgccttgaactgtttagaccaatatgaaaggctacttcctggaagaaacaatgcttctcagcaagatatttcttaaaataccattttcagaattatttgtagccactataataaaactatcagtaaattgtcagattgttcttggcattggtgacagaaaaactgcacatatttactggactgcatgacaattaagaacagagtttttcatgattaatgggttaaaaggcaagagttttgaatgaacttaaattgggcaattctcaaatctttgatgattttattatatgtcatcctgaccacttttagctggtttaatgtaattttgaaatgtttccctaaatgttacatctgttaatagttagaaaccagcttaaattcccattaagttttattcaacaaacctaaagcttctgttctgagaacctcataagtaagtaccctctgtgccatagaaggactaacagtatacttcaacattttacaattggttttgaaaattaaaaaatatgtaggctccccaggagttcatattcaatttaacaacatcaattctacttaagacataaaaatctatttctactggcaacaagatgaaaatctccagctcatactccttatatggggtaaacacccagggaatgattccagcaaagcacagaaccaggtttgtgagggagagactgggctttgacatagtaccactggataatacatacatcagtaattgtttctgtcacttacaaatatgtatctgtttaatgtcttcagttgtttagacgaacgatttggatgatcctaaatttctttgaaacttttacatttagagttccaaaaatttgtttttctccaagattaaagcaattctagcatagtagcagcatgctgcatcaacaagttgatttttttttaaagtgtatgtcttctattgaagagctcgatgaagttcttaactgttgtctctttaattaaacagagaacagcaaagcttgtttttttgccaatcgcaaatttatactcaatttaaaccatggcttttaacaaaattcctatactaaaataactcttcacacaagaatcttagtggattttttataggttcttggttaaccagcaaaactcaacaaaatttgttggcattagtaacaaatactttttaaatatgcttctatttctcccatcagaactttgatttctcttcaaagaagcctcatcatagacttactcacacatttgtgagagttattagaattgccataatcaatggatactgaagaaaagggaagatttgagggttggtttttgtttttaatttttaaaaaactcgtatcatgattctggagctaaaagcagctcacatgggccttatatgagctttgcctctctttgagcagtacattttaaaagtcaggaagaaaataaaatctgactcttgtagcatttagctttgtattggagtggcctttgcaggtaatgccaacttccacgacatttagaagattcataaagtgctggtcaaaataatggaaaaaatagcagctgtcatttgatcagaatctgtgtgcaaaccaattaaaagccctgtcataactatttaagcatgtaaggtgatttatgattacctttcataaattaatgaattctaccaataagagcagggtgctacattgggtgctcctgttctcgcagagtttacagctacacattacatgaggactgctccaggtttgctgtgtttaaatgattgacaaggcagaaactttgtcttttcttcaactgattggcactatctacttataacttataacttagcttatttttcactcccccccaaggagagtagagtccagaatggccggtggtagtctcagagtagaagagttgaggtgtcataagataacgacacccttgaatttatttctcctatactttgctttataaaagtgagcacaaggacagacaggcagaaaatagtagatcactatgtgaggctagagagagtcctctttcaggttcaacaaaggaaagacagaagaaaagtgaataaggtacataaatataagaacataagtgtagacaggtagatgatgaaaaatgggagaaatggaagacgtaacaaaaaagaaaaaagatgaagaaaaatatgggaagagaaaggtaaggtgagatgaggagggcaaaagaaacagaatggagaagagagaaaagaatggaggcaaaggaaagaagggagaatacagcaatctcctcctgaaatctgcctgtcccaagcataaagattaattgtaatattttaattacaaattagcttttcctgagaaaacttcataagcacataattcttataaaattgtgttacctcaaatatttaaaatgctttctagtcaaatatttagggggtcatcattctccaaaactagctagccttatgcagctggtaggagttcttcacagctgttctttaagccatgttgcatgagaacttcatagagaacctgagaagttccattttaagagtttctcctgcttcggtatcctaggcaagaaatcaggagaaaggaatgagaaggaagaatcactagtgtcaagtgacacatgaaactccagtaaatctgggtattacttaggtcaactagagtaattcaacataaaggtagaatagttgttaagattttaaaagccaagtggtgatttcgaacttgtagctattgttctaatatgatgggtaatcacttcctgcaatggtgaactatttataaactgctggctcctcaaaatgtaaataaagaaaaattattccaggctacaagattaattttcctctatgtctttaatctgaggtagatccattttttgttaaaacacacttgttttatttatttagtcaaattcttcacattaagaaggaggaatctgagacccagtaagattaagtgactagtttatggtccttgggtagaacaggaatgaagcagaggtttccattcctaggtcacttcagaactactaattgaggttcatcagaaaaaagacataagccaaagaaattagaacatgaagttgagtatcatctttagtaaaaaggatctagtcattgcttccttataatattgaaaattagtttaaccgtaggtggacatttctttgaaatggtttctaccactaaaaataaaactgaaggtagaggattaggttagaccctggagcaaaatcaaaacagcttatttcagcctaagaacttttttaaagtaaatggcaagccccaaatacctacatatctgtaattttctgagccaccataaaatctgcatactctgtaccaaagtaaaaaacttcacttactgacacaacctttactaaaaagtgccacagactgtacgtaagaatacttttatttagagaagaataaaatacaagctgtctagttcttaatatggtaaaactctctatcctcttacactctgctttcttatttatttatttatttatttatttatttatttatttatttattttgagatggagtctcgctctgtcgcccaggctggagtgcagtggcgcaatctcagctcactgaatgctccgcctcccgggttctcgccattcttctgccttagccttctgagtagctgggactacaggcgcccgccaccacgcccagctaattttttgtattttctttttagtagagacgggatttcaccatgttagccaggatggtctctatctcctgacctcgtgatccacccacctcggcctcccaaagtgctgggattacaggcgtgagccaccacgcccagccaatttgtcttttagttagcctgaataaatttaacctctcagaggatccctcaactcatgtgaaaaaatccttaatagtttctgtcttacattaaacaaaaaggcagacctatgtcacctggagtcataggaccctgagttatctcctaaggtaactctaatgtacattccttaactctgaagctaacagctatgaaggtgaatgccgatagctgctgtaggtttcacagagagactcaatgattatgaagattctgaccgtatctaataacagacaacagataattgtacagtaagatttaggaaaaaaaagtcatttcagttttgaaagttttgttaaggtatataaatgcatatctgttgcctattagtatgatgatatggtagacaaattgcctttgtcaggttttagttttggctctgccattaattagctatgtggtttttgagaatttcagtcactttaacacatgtttatagatggttacataccaggcaccgtgcaagtcattttaacagttatcttaggaaatcctctcagcaaccctgagggtttgacattattattatcatcatcttacaggaaagagaactggggtttagattgagttttttctcaaggttcagtagctagtggcctgcttccaaagcttgtattattttgaaaagcagccagtttctggaactatgtccttaacaagtacttttgacccagtgggaatgaaaggggagtgcagaaagaggtatataggattccagccctcctacttctgcttcagccagagcaattgcctgttcattgttttaatatattgagcttttcaggtaagattttagaggggagagggttctgtagcattaaatgcctgatctcacagtattatgcttcactagaatgaaggggtaaaagtggtattaagctaatataagaaaagtaaataataatcgttggataggcttcaaaaaagaaatgcatttgagatggaccttgacaagcagataaaatcttgatttagttgaaggactccatctggggaaacattaatgaaagtgcttaaattttcaatgctaattaaaatgtttatttttaaaatgtttcctttgatcctgtttttctttattaaataataccctggacaggaattaagagcacagcctgaagtgattgtgatgtccaagaagtactactcatggaacaaatagacaacttgtcatatttcaaaattaaatgctgactgcactatgaatatagaaaagtacagttgtaaacactatattctgtaccatgtaacatcttatgtatgatttcagttctttttaagaccaccagactacagttacaagaaagccaagatcagactgactcaatttgcattacatacatgttcagggaaagcctaattagggaaaacagaaacttcaaatttcactcttttaaactgaataggagagtatcttacatccactgccagaaaatatcaccccagaagtgaaaatttacatgttttaatttctgaaataatgactttgaggaaaacagttagaaattataaaacatacaaattcctatttgtcacactatggagactttggagaatatgattctccaagtatcttggtgtttaaacaaataaaaatatagttcagccaaaaataaactagctcacatgaaaaagctgtagtattaaaaactgctacatcagaaagtcgaagtgagtattcagtaaatttattaacaagatatccctggattaatgattctatctcaagtcaaaaacattttgccaaagtgacagcactaacacctaccaccagtagtatgtagaatcagcttgaccttatttcagaacatctgagaggcactaaaagctggcaaaaccatcttaagagtatggagtgataggcagtaaactgcatttattctgggcttgaaccacatcaaggcagtttcagaaataaccttaaaaaagaggagccagagattaaatactatccccactccccataattaagatgcaatttgaaactttatctgaaatcattgagtcaatggaaagccgggaggaaaacaatgttaaatcaatatctgaaaagctgtttctactaaagatgtctatacacacacacatattatatatctatatatcatgtatttggactgattcaaggaatctgtgcttctcaaggcaacttcaagaactgttgatagtacagagaaatggatatcacagcttttttcttaaagaaaatataggttgaggtagggactggtaaaagaagagactgctttctttcattttttttcttttttaaaacaacttgtctacatcaccaggtatcagtaattgattcccactggacacaactacaggatacactccatgtttattccttgtgagaaataaacacagtaacaaattttcactagcatcattatgtagaacataaattcatgtttccttaattcagtaggtatttattagaaatctatgaggtaccaacatctatgtgaagtcctggttataatgcaaagaagccagtctagtgaatagacaaatgaatttattaaattaaaatacaatgatatatgtcatgagatgttcaagagctatgggggtacagtagagaaatatctgaggaggggtaaagaataggagaagtttccccggctgaatcttaaaagtaaggtattttaagatgctactataccattaccacttaacaagtaaggaaaaaaaaaattacaaaaaaaaaaaaaaaaaagaaaacagccatatgattacatgaaaattgaataccttctcctgaatgatttttaggtagacaatgaaattaaggcagaaatcaagaagttacttgaaactgctgagaacagagatacaaaataccggaatctatggaatccgactaaggcagtattaagagggaaatgtatagcactgaatgcccatatcacaagttagaaagatctcaagttaacttacaacttaacatcacaactaaaagaactaggaaaccaagagcaaacaaatcccaaagctagcagtagacaagaaataaccaaaatcagagctgaattgaaggagattgagataagaaaaatcattcaaaacataaatccaggagctggttttttgaaaaaaaaaattaataaaatacatagatcactagctagactaataaagaagaaaagagaatattcatataaacacaaaatattcaaataaacacaatcagaaatgataaggggcgattgcaactgaccccacagaaatataaccatcggaggatattatgaatacttccgtgcacataaactagaacatctagaagcaatggataaattcctcaacacagctaccctcccaagagtgaaccaggaagaaactggatctctaaacagacaatatcaagcttggaaattgagacagtaataaatagcttaccaaccaataatgtccaggaccagacgtattcacatctgaattctcccagatgtatgaagaagagctggtaccatttctactgaaactatttcaaaagttgatgagcaactcctccctaactcatcctgtgaggctagcatcaccctgataccaaaacctggcagagataaaacaaaaaaagaaaacctcaggtcactatgcttggtggacattgatacaaaagtcctcaacaaaatactggcaaaataaatccagcggcacatcaaaaagcttacccacccccatcaagtaggctttatccctgggctgcaaggtcggttcaacatatgcaaatcaataaatgtcattcatcacataagcagagctaaagacaaaaaccacatgattatctcaatagatgcagaaaaggcatttgatacaattcataccttcgtgtttaaaactcatagcaaactaggtattgaaggaacatacttcaaaatgagagtcttctatgacaaacccacagccaacatcatactgaatgagcaaaagctggaagcattccccttaaaaattggcacaaaacaaggatgccctctctcaccactcctattcaacatagtattggaagtactggccagggcaaataggccagagaaagaaataaagggcatccaaataggaagagaggaagtcagactatccctgtttgcagatgaaatgatccaatttctagaaaaccacatagtctcagccaaaagcttcttaagctgataaacaacttcagcagagtctcagaatacaacatgagtgtgcaaaaatcgctaggattcctatacatcaacagcagtcaatccaagagccaaatgaggaacatactcccattcacaatggccacaaaaagaataaaatacctaagaatacagctaactagggaagcaaaatatctctacaagaaaaactacaaaacactgcttaaagaaatcagaagtgacacaaatggaaaaacatttcatgctcatgaacaagaagaatcaatgtcattaaaaatggccatacttcccaaagcaatttatagattcagtgctattcctattaaacctccattgagattctttgtagaactaggaaaaaaaaaaaactatcttaaagttcatctggaaccaaaaaagagactgaatagccaaagcaattttaagcaaaaagagcaaagctggaggtatcccattacttgacttcaaactatattacagggctacaataatcaaaacagcatggtattagtacaaaaaaagacacatagcctaatggaacagaatagagaacccagatataaggccatatacctacaactatctgatgttcaacaaacctgacaaaagcaagcaatggggaaaggattcctattaaataaatagtgttgggataattggctagccgtatgcagaaggttgaaactggaccgtttccttacaccataaacaaaaatggattaaagactgtaatgtaaagcacaaaagtataaaacccctggaagacaacctaggcaataccatgcaggacaatggcacgggcaaagatttcatgatgaagacaccgaaagcgattgcaacaaaagcaaaaattgataaatgcgatctgattaaagagcttcagtacagcaaaagaagctatcaacagagtaaacagagaacctaaagaatgggagaaaatctttgcaaactttgcatccaacaaaggtctaatatctagtatctatacggaacttaaatttccaaagaaaaaaacaaaacaacctcattaaaaactgggcaaaggatataaacagatacttttcaaaagaagatatacatatggtcaacagtcatatgaaaaaaagctcaacatcactgattattagagaaatgcaaatcagaaccacaatgagatacccatctcagtcagaaaggttattattaaaaagtcaaaaaataacagatgttggtgaggttgtggagaaaagagaacacttatacactgttggtggcagtgtaaattgcttgaaccattgtggaagacagcgtggtgattccttgaagacctaacagcagaaataccattcaagccagcaatctcattgctgggtatatacccaaaggaatatattaataaaccattttattataaagacacatacgtatgttcattgcagcactattcacaacagcaaagacagggaatcaagctaaacgcctgtcactggataaagaaaatgtggtacatacacaccatggaatactatgcagccataaaaaagaacgagatcatatcctttgcagggacatggatggagctggaggccattatccttagcaaattaatgcaggaacagaaagcaacaaccacatgttctcccttataagtgggagctaaatgatgagaacacatggatacatacaggggaacaacacaaactctggggtctattggagggtgaaggtgggaggaaggaaaggatcaggaaaaataactaatggatactaggcttaatatctggttgatgaaataatctgtacaacagatccccatgacacaagtttacctatgtagcaaatatgcacatgtacccctgaacttaaaagttaaaaagataacacaatatcaaaattttatgcaatacctacaaatttaataaaagttgtacaaagaattactgacagaaatttcaagacctaagcaaacaaaagaatcatattcactgaccaagaataccacttttactgctgtgagtagaaaatattgtgctaagccaaaaaaaaaaaaataactgagcatttttctttaagctctataccagcatgtgctcacatcagaatatttattaaacagtcatccttctatgaccttgaatttctcttaattacaatttaggagtgcataaattgacttaagtgtagcttttggacagcattgaaagtttcagatacagatggatacagatggaactacaaggcagccctgtgagggataattagaaaaagtataatattaagagttaggcatttgtaaagcaggtaacctgtttgacagaaaaagaattaaggttatttacaacaaagactccggaaaggtaaaggaagataggagagagtaaagcccttagtgctgatctatgccaggtgtgcgagaccctagttaggtatcaaaatagcctgtacagttctgtttttgttgtaatttggttttgttttgttttaatacatttgtcctggtctaaagacttgcacaatttctgggagtggccttctgtatagcagttattcatacaggtctctgttggttctgttagagacaaagttgagttactgtggcctggctgtgcaaatactcttgttttccttttctaccaactttaaaaacaacactaaaataaaaacaaaatgtgtcatgtgaagcaactcatgtatgttgctatctcttggatccggaaatatactgacaaaattgaaatggaagaccagagacagaaaaaaacaaaaaagcaatttctcaccatgcatattatttgaaacaaaagaaatttaagttactgacatcttgtttgaacatcttgtttggagatttctaaaatcaagtaataataagtaacagtaaatggtactgtgcccattattatacttttaagctgtgttaaatgttaatgatattgtctttagcaatttttattgtttttagtgaaagaaaaatatattcacatcagagcatggttaccattcatattcttcctttaaagtcatatttttcatcataaattcttattaccttggtatatttgggactgctatggttggggctatttcagataacaaataattgcaaagaagtatttacttttcattgaaatattctttaattttgttttatgacaggattgaggtatgccctcaaacattatttcagtgattattgtagataagtattcgaatctttcatctgttggatatctggataaatcaaatggcctggccatggcaaaccacaaaatccagtttcgtagagctcatttgtttcaatgaaagattttaattaatcatattggttgcatcacaatgattttgaagttactttgatattaaataaaaaagaattcttatataagcaatggtaataaagtactaaagtattaataaagtattgagaatttgaaattgactagagaattcaaaaatgagaagagacaagtcaaggtaaattccctcatattcacatctacaccttatgggttacaaacatttgaattctgaaagataatgctggcacgactgtgatggtcaatgggtttatatcaaataaactatattgtagtttataaaatggttttctcttactatagccaattaaaatcttaaaaatagagtgtgtaatgtagtacagattttaagttgcctttatatggcttatgcttcttgttatatttgtgttttggggggaattcttggcaagagattaggtccacatctgattttatgaaatgaatcaacaatgacagtaaagtaataaagtcaacataatgatttaattgtctatgattcacataagtcacttaacaattatatttgtttagtggtatgtttatcataaagttaatatgtttccagattgttcaagttttatattgttatatttttcaaatttcattttatgaataatgataatttatattccctcaaacttccatgtattaccatagttgatcttttctgttcattctctgttttgaaagaaatctgactttttactttcaaacatctagttttcattatcttggagctaattcaatcgctgtgatacctggaaaaaattacattttttatcttttagtttgtaaggagacttttgaacctgaaacagaaactgaatatttttgagattcactagatggattggttttcttaatatgcatttggtatagtaataataacgtgttatctttcaggtataattttcaattcatatgaatatgaacaatttatattgaaatgctgtggcgtttttatttgtttagttcttagaaagggtagctgttctatgggtttacagagacaagatttttatacataattggagatactagatggaagtagtttggctaaaaaggaaaaaaaattctatttgattgaagatggagggctgagcatacatgatgacttcttatccttcctgacacctcacctcatagaggcatatacataaaggaatagatccatgcagcaaagaaaatcagagagacttactagcacttggtatgttttcaagaaattactaggagaaggaaaaatgggaatgagctaactgatggaacaagcagtgcagaggaggagatgggagggaactgatcagcctgcctgaaccttggagagtctctcttctgagaatctgcaaggatgaagatacagagctcaaaacaggagactcaattaaaggaccatatctgcaactgggacaattggctcacctacttcacttttacaacccagattagaaaccagtctgatttcagttcttctgagcaatgaaccatatgggaaagggtgacgtttctgttgtgcctcttggcatgccactactaagcctacattattctggcttgggttggggggtgcagttttcctaccagttcctgccttaagtgaaattcctgcctaaagtgaagcttgcccgtatccaaagctacccatgtgcacagagctcctagttaatgctaccaagtaggcaagaagataggtgcaacctgtttttattattatgcttgttcattgttttctgaagctgtcatttcaaatgcttgatttttccattatgttcttaccttcagtttattgttcattaagtatttgttccccattacacagatttttcaaaaattaaagcagactcttttctttttatttatttatttatttatttatttatttatttattattatactttaagttttagggtacatgtgcacattgtgcaggttagttacatacgtatacatgtgccatgctggtgtgctgcacccactaactcgtcatctagcattaggtatatctcccaatgctatccctcccccttccccccaccacacaacagtccccagagtgtgatgttccccttcttgtgtccatgtgatctcattgttcaattcccacctatgagtgagaatatgcggtgtttggtttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaataatgccacaataaacatacgtgtgcatgtgtctttatagcagcatgatttatagtcccttgggtatatacccagtaatgggatggctggatcacatggtatttctagttctagatccctgaggattcgccacactgacttccacaagggttgaactagttgacagtcccaccaacaatgtaaaagtgttcctatttctccacatcctctccagcacctgttgtttcctgactttttaatgattgccattctaagtggtgtgagaaggtggcaaatctcattgtggttttgatttgcatttgtctgatggccagtgatggtgagcattttttcatgtgtgttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcctgtgcctatgtcctgaatggtattgcctaggttttcttctagggtttttatggttttaggtctaacatttaagtcctgaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagctatgtggcattatttctgagggctctgttctgttccattgatctatatctctgttttggtaccagtaccatgctgttttggttactgtagccttgtagtatagtttgaagtcaggtagtgtgatgcctccagctttgtccttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgctagtgttcaaagtgaaagcttccagtttttgcccattcagtatgatattggctgtggatttgtcatagatagctcttattattttgaaatatgtcccatcaatacctaatttattgagagtttttagcatgaagcgttgttgaattttgtcaaaggccttttctgcatctgttgagataatcatgtggtttttgtctttggctctgtttatatgctggattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctttgcccggctttggtatcagaatgatgctggcctcataaaatgagttagggaggattccctctttttctattgattggaatagtttcagaaggaatggtactagttcctccttgtacctctggtagaattcggctgtgaatccatctggtcctggactcttcttggttggtaagctattgattattgccacaatttcagatcctgttattggtcttttcagagattgaacttcttcctggtttattcttgggagagtatatgtgtcaaggactttatccatttcttctagattttctagtttatttgcatagaggtgtttgtagtattctctgatggtagtttgtatttctgtgggatcggtggtgatatcccctttatcattttttattgcgtctatttgattcttctctctttttttctttatcattcttgctagcggtctatcaattttgttgatcctttcaaaaaaccagttcctggattcattaattttttgaaggtttttttgtgtctgtatttccttcagttctgctctgatcttagttatttcttgccttctgctagcttttgaatgtgtttgcccttgcttttctagttcttttaattgtgatgttagggtgttaattttggatctttcctgctttctcttgtgggcatttagtgctataaatttccctctacacactgctttgaatgcgtcccagagattctggtatgttgtgtctttgttcttgttggtttcaaagaacatctttatttctgccttcatttcgttatgtacccagtagtcattcaggagcaggtggttcagtttccatgtagttgagtggttttgagtgagattcttaatcctgagttctagtttgattgcactgtggtctgagagatagtttgttataatttctgatcttttacatttgctgaggagatctttacttccaagtatgtggtcagttttggaataggtgtggtgtggtgctgacaaaaatgtatattctgttgatttggggtggagagttctgtagatgtctattaggtccgcttggtgcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttagcaggatgtaatggccttctttgtctcttttgatctttgttggtttaaagtctgttttatccaagactaggattgcaacccctgcctttttttgttttccatttgcttggtagatcttcctccatccttttattttgagcctatgtgtgtctctgcccgtgagatgggtttcctgaacacagcacactgatgggtcttgactctttatccaatttgccagtctgtgtcttttagttggagcatttagtccatttacatttaaagttaatagtgttatgtgtgaatttgatcctgtcattatgatgttagctggttattttgctcgttagttgatgcagtttcttcctagtcttgatggtcgttacattttggcatgattttgcagcggctggtactggttgttcctttccgtgtttagtgcttccttcaggagctcttttagggcaggcctggtggtgacaaaatctctcagcatttgcttgagcagactctattttcaagagaagtagttgagtcttaggagtctgcagaaactacttttacctctgaagacatttgctaatatgttgatgggatataatttaggaacaattagtgtttacattttatcattttagtttgaatttaataatagcataagctaacactgttatttaatagtgtacgtaaatgctaactgaatatatatgtattcagttacttattctttatatcttacaggcaaaaaagatacaacccatgagtgcttactttttcgggttgtaccttttttgcctgtaagccataaagagtattttattaaaacattaagaaatgttagtctcattaagtagaagagaagaacataattcttatttttaagccatttagtagtgggaattgaatgtagtgttcagaaacgttgcagttagatccactcttaatttttctcatttccttaaatttcatggatatgcatattgagctattttcgtattcaatctcagctaaataaagtagcgcaaatatgcatgactgaaattaccttctataaaaagttccaaaagcatttgaaaaatatcccacgggtgataagtctgtaatattttactttattaaaatgctgtacctggcttctgagtggttatctaagaagaagaaaagaatctacagtataatgagagttaaccatgttttgtccaaaatgattttgaatcaccgttcggacagatcttgaagactagtggaaacttcaaatggcagtatcgaacttctgttccttttggggttgttgagtatatgaagaatattatttttctgtgtctgacagtcggtagctttgacatgattatagtgaagtataatttagatgttagttttaactataatagactgtaactccttgtattttgggtgctgtagaaattacctttccctttgcatgtacgtgacagttaagatctgaagaatcttgattaatggttcttggatttatgtttaaagaaatcaaggatgggcatttttctcatctccgtctttggcatttgaaacagtatacaggttgagtattccttatccaaaatggttggaaccagaaatgtttcagattttggattttttcatattttgtaatgttttcatacacgtaatgagatatgttgggatgggacccaagtcttaacgtgaattcatttattttttatgtatatcataaacatataggttgaaggtaatttaatgtaatattttgaataattttgtgcattaaacaaagtttgcatacattgaatcatcagaaagcaaaggtatccctgtctcagccagccacgtggatactctgtggtgtttggcatcactgtcattcctgactctgaatttgtatgctactgataaacaactcttttattagacttactcacacatatgtacttaacagtgaaaaaaatgagttcagagtaactaagcagcataatagcatcaaacaatggcaggctttcatactttacctacagtgctgtttttgttaaaaggttactctactctgtattttattttttttaggtaagaagaaatattggaaacatttgagagatcaagaaatgggtcctctagggatgaggagaccttctgaataaactatgtcctgtgttcctgcattttgacagcaacccatcacataaggccacttacggaattttctacttgtagtgtcatgtcagtgctcaaaaactttcagatgttggagcatttcagatttcagattttcagattagggatgcacaacctttacaaagggcctttatagagattttaaatatataacttgttgtctactgagtaaaagatgggctgcttctgtttttctcctaacagtattttcagcttctgtactaaccagttccagatgttccacgataaagaaatatttaattttcatatgaaatttatgaaaggaaaatgcataggagggcattttagcaaaacaataagacaaaacagcttttgacagttggtttgctattaataagtacataggagtacacagtaaatggaaggctcatttagacccttagaatttttcttagcagggggccctttacctgaaatcatggtactagttttaaacttcatgttcttttttgtaaagacatttaaggcgatcagctcttttcaaaattaggttaatttttcagaaagaaataatatatcaaataaaaggaatattatggtgggttcagatgaattttaattgaaacataagcaacagaaaattttaagattcttatatgtggaccactttgtataatgtgcctacaaggtaaagattttgtggtcatctgaattttgggagaagtaattttccaagaattaatacttaagctttttgaatcacagttttgtatacccaatttcattatttggttctgtgcgatatagaatgttcaaggctaactataatcatttttgtccaatttgttttaaagagggttcagcagctccaggaatggtataatggtgaatgatgtttccatatcaatacagatctacaaatatgagtatatttgaagaaaagcaaattcatattgaatttaaaggcatataaattggatttcttttccattcatggacatctacttgtataaagaataaaaattacagtttgaatacatccaaaaccttttctcttaccgaatttcaatactcttttctaacaatgtcttagaattttgtagtatatctattcctcccctagataagatctgtagcacacttactctcttcctccctgttactatcctagaatgcttttgtattttaattttagattatttccttttaaaattatgcataaataattatttaaatttagcttcctactttttggacactactattggacaccaccacatctttttttctctggattgatttttttttgttttactggagttgatcatttaataattcttagattgtatctgaaggtattaaactagcctgtttttgcatgactgaaaatgtatatttattctcacttgattgctgattagacttgacatagagtcctatgtttaagtcattttatcttagatctttgaaaatactattctattgacttttctgatattgctaaaaagatttctgatatcaatataatttttgtaccactgtagatgaccctttttcatcccttcgtcctctttctttctctttggaagattttggaatttttatccttggggtttgatactacgctaggatgccatattattaatgctttgcctcatctgcctctccctgcacctctgcttttgtctgaaacccgaatctacctttagctaagggaaattttcttctttcatttctgtgattgctttttctactcagttccgttttattctttttttcagtagctactagaacttctagatctatcctccttttctcttactttatatttcctcattttgcaggggattctgaataatcttttgtctttgtcttctatctcaataattttatctttagctacgtcctttaatttttttttttttttttttcctgagagtctcgctttctcacccaggctgggatgcagtgatgcaatcttggctcactgcaacctctgcttcctgggttcaagtgattctcccacctcagcctccagagtacctgggattacaggtgcacgccaccatgcctggccaatttttgtatttttagtacagacaggatctcaccatgttggccaggctggtcttaaaggtcctttaatttttcattttcttttttaaggctttgtattgtcattattttgttagtcatgtttttaattttgtagcagtcttttccataattgtttttttttgtctgtgtgctatcttttcaaatctcactgagaattacaattatatttaacgttttcctctgtttcttttactctgctgagtgttatttcttcaatatgttaagtttggtgactttcttgctaatttttcctcaagtgtttggtgatttttggttgtttgttgtttgttgaatagttgagagcctaggctgaacagtcttggtggctggagggtatttatttcatcagcccaaatgagaatccctttttacttcttgtactatgtagattctcattacagaagccttcatccaataactgcagggcaaaagaagtgggtgtggctgggcagggtattcccggttgtagaagtttttcacctgggtttcggactacatttccataaattggctgctaccttgttctgtttctctaatctgggactctccatagtcagaaattgcatttgggagaatgtactcctgcttttgttatttattgaccatgagctttgagtttctctgagcctctatagcagactcacactttcttgttttagctgcaggtttctccaatgtgattttgcctttaaactaatcacatctcctctgatttgtgtttgtttacagagcttcttcaaaatttttggtctgcagtggtattattttcctgcactatcattctttcttctttttagtaatatattttatatggaatttgaggggaaaggaaagaggtaaatgtgtcctcattggccatccattcttttttaaagtaaaatggaaaaatacagattttgaaattaagagaactaagagatgatgaaaccatttcaatggagacttatcaacatattatgaagggaggaaaatgtgctgaatattgctgatgtttaatgaatttagaaaggacatttatttagcattagcctctgtcaccaatttattatttttccctgtggaaactaatgactttggagaaatttcttgggtaatgtttattgttagtcatcctgtttaagaacaacttgcttaaggtgatatttttatttcatggtagcaaatggattgttttgacatattcagtgtggacccatttaaagtaggcatgttattttcaaaagtgccatggcatgtcagtatcttgtaaattctaacttaaccaatattaaagaagtaaaccttcatgtactttaatggagatcacaaaaggacttcactgtcttgttctatgcaagatttagtaaaaacagagtattaggtgttatagtaatggtcatgcaaagcagtagctcatctgtacaagaaaattaatggtcttctaaaatggccagagatttgtttataacttcattttaattaattacatttttggaaaatgagttgaatttaagattagaccccaggcttgaatttgtcatattttttataatggtattttgaaacaaagtttgctaatagatgtttaaaagagagtaagaaaatatttacatagggtttatttgtggagtaagtattgtgtctttgtcattattcaaaaatagaaaaaagttgtgaagcaacatgttctctttgtgaatgttgaaaattactaacagatctgtgcgattggttttgtatgccttgtgaagacttgccaaatttgattttatttttctcttttacttttttctagtaaagccaagtcctacttgagagacatcagtagcctatggaaatttgttgcttttctttgaaaagtgcacctgcatccaaaactgagtaaaaacatatttcaggaagaaaactataactaattaaatttctcagtactacctaatttgccaatataactagttttggttaaaaagaagttgattataatgttcataactgtatattgaacagaaaaactggatgcaatcagaaatcataggtgtagtcaaggagatgaaaattgtagatgtgaccgttgctatttgcttttaaggtttcctaatcttgcctagcgtaatgactgagttttatgggtatttggaggattttcttgttccaggtggtggtcgtcctccttattttattttttggtaaggctaggagtaatgtagatgtgtattcttctcataacttagtaaaactcttttatcaaattggtcagtgcagcctgcagctggggacttctaaaaacatgttaccatgactagaaatttttatttcagtgcacttacttgacatctttctggttattattgaccaaaacacttgactcctgcctcttctttctttttatccattttgttgtccttattttgcatatttttgcatatgtacagatttctggcttcctcattcctatcaacaaccagaataacttttagtggtctaacttgtatcttcacttatcaacttaaactgttctttttgaaatgttaccagtgggttcagtgctcctgtctctgttctctgtctctggatctctcttcaacctttggttccactggccagccattcttaactgtttcggtttcagaaatattttttccctttagttttataataataattagctaatttttcttgagcacttactttgtatctttgactattctaagcactttacatgtcatatgatctttaacacaatccttagagatctaagtttgtattattttttccactttcagataaagaaggtaaggcacagagaggttaattactttgtttgaggccacactaataagtggtagaatcaggattcagacacaggcagtctgactaaagagctggtacttttcctctttagatgctatactattctgatgagtgtctcctctcatctttttctgtttggatctagttgtgtatattttcatttgccctacacttacctggttaggttaaaatttctacatccctcaaaactgctgaagtatcagttaaaaatatagttttcaacagaatagaagtttaatacatgttgtgaaccaatttcttcgtgttgccttttgaaattaaatttaaagagagcagtcattaatggctcaaagttagacctaagaggatttataggtgatgtgtatatgtgtttttgttttatccatcattcttcagtttcttaattaccaatactataccaagacaaatgcctgcatttcatcattaaccattaaaatatgattttcttagagttgaagattgaatttagggccagttttttcaagtacattaattatgtttaaatgtgtaagtctactcattataaaagtgaattattttgtaagtgttggttattaagtctgtgtattcccaagattttcagtctgaagtgagctgcagatacaatgcctaagcattttgtcctttgtattttgtaccagcaaaatgaaaatcattttttatagcctcattactcattcccaaaatgacctgaggtaccagttaggtccatttgcacaatatctggcaatatttctatgtcaaatatgttacaatctggtatttaaaatggccactgtaagtattatcaggcactattgttcctttttaaaaaacagtataaaatttgaaaacagtgctttggaaattatgtctttagtggctgtaatataaatggttaaccttacaaagggaaaacatgaaattgtttgaaattggtttatattggttgtcatgctaaacatattttttaatagtttgcttatttggtttgatattggttgtcatgatttaaaatgctatggttgtgtagaagttcttcacgaatatataagccgtttttacttacacatatattttagaaaatgaatagtttatatttttgctgttggaggactttttaaaaacatctatgaaacactaagatacgtctgaattggagctgaggactaagctctcatttatcttgcccaaattcctacataagggatctagagagtcatgccctacaaaccataaattctcatcagatgggttttatttgaccctatgtatcatgacttacttttcaatctgactctggcataacattacgagacaaggaaaaaatatttaaccccaaaatatatttccttgccataccttgaaattgccctgcaaagtctcttgtgggaaaaatccacatcttatagagaatcccctttcctctttgttttccttcctttctttccagatccaggcgataatcaactaagagccaggcacccttttaggtccgataagaaacattttacagcctgctctctctctgaagtctgctctctgagagattcctctgcccaataaaacttggtctccacaatcgtttttcttaacttgaacattcctttccattgatcccaggtcttgagataaactcgaccaattgtcaactagaaaatatttaaatttacctatagcctggaagctccccgcgcccctactttttgttctcctgcctttctgaaccaaaccagtgtatttcttaaatctatttgattgatatctcatgcctccctaaaaatatataaaaccaaaatgtaccccgaccaccttgggcacatgttctcaggacctcctgagggctgtgtcacaagccatggtcgctcatatttggctcagaataaatctcttcaaatgttttacggagtttgactcttttcgtcgacagagcaaaccgtacttcctgaaaagattaagagttagacagctagactttattcagagtgtgaacctatgtacctactatgtaaaatgcaagagctttagagcctttaactaaaggagtggcccctaaatcaagtcaaactcttctgtttcccaactacctcttgctgtataggagccatctggctctgctttctcaggtgtacattcttagaggaattttagtgattaaagtacaggccttggtgctgggggaagaaagagggttttcttctgcaggtttgttaaactgtaattcaggtcaaatttcgaatatacgtatgaaggcacaaaagtgtttaatattttagtttattccctttagtagttacaaaaattactgcttagtgaaaacttagcatcaggatatcccttcactaaaatctaggtctgtaatttgacaattcatttcacagcacctgacattactgttacattcactgtagcacttagcatgcaaagattatattttctacaactctcagtctcctctgttattggatgatgcgagcgcattaactacaaagtcacgtaaaggtcaagtcaaggcttaatttgaaaacagaagcctgagacccatccgtttacataacagacacagcactgtggtctcctgtgtgactgttaggtctgagcactgccccatattgctaatttctcacattgcttttcttaacattttttttctttaggagcttgatggagagatataccatttctgtcaggttttgcaaaatgtcttgagctccttgaaaaatagatgtcatgtaaatgcaaagtacggtcagttcttttagcctaagacattatttgatttttatagcaagtctattccatgtaaatgacatgcagtcatatagcttaccatgaatacgttcatgtcctaaaaatctcagatactgcctatattcagagtagctaacatttaattttgttttcatgtgttctttgaaaagagtagggaaaatgttttttatattattatggcttaatctctggatttggtcaccagtgaaatgaatttcatagcctcattctattacagacattttgtctgcttcgcaaaataacacaattttgcattattggtggtctgtgttcaagagacattacatctaaagagagctagaaattgcaatttaatactaagcaatgtgatgtgggaaaggaggccaactctccacatgctctttctgctagagcataatattctgcatattgacttttttttcactatccccaaaagtcaggatttttcattaagttctgataatactgttgaaattgaccttgattattcatgtaaagggcctctcagacaacctataggtatgagaatagctttcagaattgtaatcatatttaggttatatttaagcagtgatgttacacacttcccaaaaagtaatttattgggacatttacataactctgtgtacttaaatttatctacttattgcttatttaaaacattacatatgagagtttgtgttttccttactcaccattttccatacggctttattttcctcttagtttgaaaacttaaaaaaaattcaagttaacaagcatttattaaacatctgttgtattcaaggccctgggctacgtacatgtggaacataaaaaatgatgatgatgacagtgattgcaaacacttgcaataagtcctcatattgctgtcaagtaggtgctgttgttatgccatattacaaatgaagcagatgagccatagaatatttcataatttgctcaaggtcacacagccagtgatttgagaagactggcttaaaacacatgcagttcgacaccagagatgacactcttaaccactgtgctatactaaaatgaagacaagatcctacccttaagaacctttcatcctactagaaaagtggtaatacatattcagagaaaaaaacaaaaagaaaacagtaagtcagtatgtgttaggtgctgcattactggctcaaatatggaagacattggtgctcagaaagagatgtatttcttttgggaggtggggaaggcctcctggaagaagtgttttagctgacccttaaaaaagcggcaggattttgtcaagtgaagttaattagaggaagaccttctccttaagggggcaatgagaacaaaggcattgttttcaggaaaatgcagtgcccaaagttaatttgactatatgaaaaagaaaaatatttatacctatgcagacctttgaatgtaatgcatgttttcatttaaaattagaaatttatataatttttgaggtattatggatccaaattgtagattttttaaaggttaagctgttatatttttctttttaactaaaggggtatatttcaatggaaaggagttgcccaaactgaaatccgcagcgatgctaaggaataacatttatttcatatgaaaatattgtaaaatattttatggatattgttttttacatctaatcttaacattatctgtaagctgaactttgatgcagtagtagtaaacctactttctacaggaactacttctattacactctttaatttaaatctctttccataacctgtcaatatttaaagtacaacaaaagatagttgcactcagaataaaaatttgttttcacagagaattttagcccattatccctgatgaacatcgatgcaaaaatcctcaataaaacactggcaaactgaatccagcagcacatcaaaaagcttaaccaccatgatcaagtgggcttcatccctgggatgcaaggctggttcaacatacgcaaatcaatgaatgtaatccatcatataaacagaaccaaagacaaaaacgacaagattatctcaatagatgcagaaaaggcctttgacaaaattcaacagccgttcatgctaaacactctcaataaattaggtattgatgggatatatctcaaaataataagagctatttatgacagacccacagccaatatcatactgaatggacaaaaactggaagcattccctttgaaaagtggcacaagacaaggatgccctctctcaccactcctattcaacatagtattggaaattctggccagggcaatcagacaggagaaagaaataaagggtagtcaattaggaaaagaggaagtcaaatggtccctgtttgcagatgacatgattgtgtatttagaaaacctcattgtctccagcccaaaatctccttaagctgataagcaacttcagcaaagtctcaggacacaaaatcaatgtgcaaaaatcacaagcattcctatacaccaataacagacaaacagagagtgaaatcatgagtgaactcccattcacaatggcttcaaagagaataaaatacctaggaatccaatttacaagggatgtgaaggacctcttcaaggagaactacaaaccactgctcaacgaaataaaagaggacacaaacaaatggaagaacattctatgttcatggataggaagaatcaatatcatgaaaatggccatactgcccaaggtaatttacagattcaatgccatccccatcaagctaccactgactttcttcacagaattggaaaaaactactttaaagttcatatggaaccaaaaaagagcctgcattgccaagacaatcataagccaaaagaacaaagctggaggcatcacattacctgacttcagactatactacaaggctacagtaaccaaaacagcatggtactggtaccaaaacagagatatagctcaatggaacagaacagagtcctcagacataataccacacatctacaaccatctgatctttgacaaacctgagaaaaacaagcaatggggaaaggattccctatttaataaatggtgctgggaaaactggctagccatatgtagaaagctgaaactggatcccttccttacaccttatacaaaaattaattcgagatggattaaagacttacatgttagacctaaaaccataaaaaccctagaagaaaacctaggcaataccattcaggacataggcatgggcaaggacttcatgtctaaaacaccaaaagcaatggtaacaaaagccaaaattgacaaatgggatctaattaaactaaagagcttctgcacagcaaaagaaactaccattagaatgaacaggcaacctacagaatggaagaaaatgtttgcaatctacccatctgacaaagggctaatatccagaatctacaaagaacttaaacaaatttacaagaaaaaaatcaaacaactccatcaaaaagtgggtgaaggatatgaacagacacttctcaaaagaagacatttatgcagccaaaaaacacatgaaaaaatgctcatcatcactggccatcagacaaatgcaaatcaaaaccacaatgagataccatctcataccagttagaatggcaatcattaaaaagtcaggaaacaacaggtgctggagaggatgtggagaaataggaacacttttacactattggtgagactgtaaactagttcaaccattgtggaagacagtgtggcgattcctcaaggatctagaactagaaataccatttgacccagccatcccattactgggtatatacccaaaggaatataaatcatgctgctataaagacacacacatatgtttattgcggcactattcacaatagcaaagacttggaaccaacccaaatgcccatcagtgatagactggattaagaaaatgtgacacacatgcaccatggaatactgtgcagccataaaaaaggatgagtttatgtcctttgtacggacatggatgaagctggaaaccatcattctcaggaaactattgcaaggacagaaaaccaaacaccgcatattctcactcataggtgggaattgaacaatgagaacacttggacacagagagaggaacatcacaaaccggagcctgttgtggggtggggggaagggaaagggatagcattaggagatatacctaatgtaaatgacgagttaatgggtgcagcacaccaacatggcacgtgtatacatatgtaacaaacctgcatgttgtgcacatgtaccctagagcttaaagtataataataataatttaaaaagataaaaatgcttaaacagaaaaaaaattggtttttactgtcatgaatttttcccacgtttatgtttattaacaactgacacaaacaaaacctgtacagaaagtactctttattatacactttatttcaaagtactgaaatagtgttttatgatcatagtatttctagaggaaagattttctcccaagcctttaaggggaaagctaatccacttggagaaattttgggccacccaccaaacctgtgatttcctgccccaatttatgaaccaagttatactgagatcgttaaatggtgtgatttctccttatgactttcacattttactttataggttatattgacttttagatttcaggtagtaaaataaaaaatcttatgcagttcaagttagaaaaattggattagtccaagtgatattttcacctggtattttttttcaggcatttcaatgttactttttattacatttataaaattatatgttttaaattgtatggttttcccttatctttttgaaaaataccatactgattcatctcaaatattttagcctcttcttaagtttccctttcccctcaacttttccgtaagcgcacaaaagaaagtattgatttttgccaattattttggttgctgaggttgtaagccatcttggtttgcttacatgtaggttattaaagtacccttcctagtctgacttgccagtcttacttctctaccttttgttagaggaataagggatgaggatgagagaattaatatatattttttaccccatttctgcatattttaatcccatctccagaaaccaggttaatttcacctctgtcacaaatttgaaaggaagggaaaagatgtattaattgccatttttattgttattttctgactttcaagccttctaatctaaggttagtaaatggacagcatttaaaaaaatattcttgttatcttgacataatgaagaattatgtttttgagtattttgtccattgtttcttatttcctactttacatttttatttacagcaaggttttatccttttactaaagggaaggagatgggatgaatggcagactttaactggatgctttatttaggcttttcgaaagcaaaaaaagtttatacattgttacagctgggtgttgggttacaggctgtttgttatattcatgtattagttcctgttattttaacattttaaatatttcataattgaaaaaggaaaaattagactgggaccagtttatagaaagctttaacttctaggcaaaaaaggtagaactttacagttggttgtggagaagatattgactgtcttttgtagagagtagcatttcgaaaaactgaatttggcgtctgtatttagaacggtctagagaatggagatactgatgaaaaggaatgttagcaaattcagcattctgatttctgaaaaatgagtgcttagattaggtagtggcatggggactagaaagaacagggatgctgctgctttgtataatcattcccattatataaaggttatatataaattaggacggacacggtggctcacacctgtaatcccagcactttgggaggccgaggtggatggatcagctgaggtcaggagctcacgaccagcctgacgaacatggtgaaaccccatctctactgaatacagaagaattagttgggcttgatggtgcatacctgtaatccgaacactacttgggaggctgagacaggaaaataacttgtacctgggaggtggaggttgcagtcagccgagatcacaccattacactccagcatgggcaacgagcaaaactctgtctcaaaaaataataataaagattatatataaataaataaaatcacaccatttaacaatctcagtataacttggttcataaattggggcaggaaatcacaggtttggtgggtggcccaaaatttctccaagtggattagctttccccttaaaggcttgggagaaaatctttcctctagaaatatatgatcataaaacactatttcagtactttgaaataaagtgtatattaaagagtactctctgtacaggttttgtttatgtcagtttttaataaacataaacatggggaaaattcacatgatagtaaaaacaattttttttcctgtttaagcatttttatctttttaaatttttatatatttaatatataaaatatatataaaatataaatatatatttatatttatgattatataaaattcctatatctttatattatcatttccataaccattttagtaagcatccccaaatagaagttagggtgtattactaattctgcttaatatactttgtatacttttgtttcctatctcaaatctagtttctattatgtaagtataagtaccctccatgaattgggttaacattctaaaccatgaccagactgagagcatgacgactaatgtggtttttactcctaagctaccagtatggaagatcaacatttaagaaggcattagtcatctgtgctgctgaaaataatggtttcacattagtctggaccaattagaaggagcctatgtctacttggaagagtttgatttgcagcatagtccttggctgcttctacaagacttggcaaacttttgtttaagtcagaccctgcttaaatgtctaaaaggaaactcttaggccattatttccccctactttacataatattgctccatacaaacattccacttttacaaaatcatttactttttcccaactctgtgatacaaatgagttatcttttcgtaaccaccaacctctcagttttatatttgttagctcagatctgacatgaaagtaaaaattacttataaccactttgggattacacaaatttaacctgttcccatgttgtattcagtcctctgtgaaatacgagggtacttcaaaaaggtcaaggaaaaattgaattaaaatataaaaataaaagatgcaaattttatttctcaacataggctccattaaggtcgagacacttttctaagcgataataccagccatttagtccatccctcatttcttttggaattgaggaatttagccatgtcagtgcagtctttttgtaccttactaactgaaaaaaatgggtattctttatagatatttttaagatcaggaaataaaaagtcagaggaggcaaatcaggtttgtaagggggatgcttaatggcttcctattgaaactcttgtaaaattgctctgtgtgattagaggaatgagcaggagctttgtcgtagtggaggaggactctagtgaagctttcttaggtgtttttctgccaaagttttggctaatgctctcaaaacactttcataataagcagatgttatcattctttggcctcccagaaagtcagtaggcaaaatgacttgaacatcccagaacactgttgccatagcctttgctcgtgactggaccactttcatctcttggtagccattgttctgactgtgctttgtcttcaggatcatactggtaatgccatattacatatcctgttaccattcttggaagaaatgcttcggaatctttatcccactcatttaaattttcattgaaagctctgttcttgtctgcagttgatctgggtgttgtaagagttttggcatccatctagtggacagtttgctgaacttatttctcaatcacaatcgtgtaagctgaaccaattgagatgtctgtggtgttggctctggtttctgctcttaatttcggttctcttagggcatgaacaagattatttttttcctctcaaatggatgtggatggtctgtcactgtgggcttcatcttcaatgttgtctcgtcccttcttaaaacaagttatccatttggaaactgctcatttcttttgggcattgtctccatcaagtctttataaaacatcaatgatttcaccacatttcacccacaattcatcttaaatgtgatgcttgttcttgcttcacttttagaagaattcagtttgctctgataggggctatttttaaatgaatgtcctatccttcttagtgcctcaaactagatcctgttcagacatactgtaaaaagttagtatattttggtgcaaaagaattttgaaatccatgcatagttttttcataatatgcatttttcatgagctttttgaagaaccctccttgtaatgtatcttaattc

SEQ ID NO: 222 - DNA, 4956 bp, Homo sapiens
agaaagaaaaccttccttttatccttccagaaattcccagttggaagactatataggaagttcatggtgctggatttcttcctgccttccatgctgttcccatcccccagttggttttagctcttcctgctgcctcaatatgtggctgtaatccagattctccagcctccattcacatgaattttcctatacctcatccgtgccccaccttcaactagagttttcctgtgcagggatatgtcctgatccgcaccactggtctttatctctcctgagtttgtcctgaacttccagctgttgaaccatagacaatggtttgactcaatagctctaaagccagccggtccatctgttcttaatcttacctctgttccactcaagatacctggagttcacttcaattccttggtctcctgtttcttccacacgctgtcagccaggcaagtcatcctttgtggtatctcttgcatccttcgagatgtctcttgcgtctatttcatctttttatatccagtactttcacccaagggcagatcttcatctgagcatttattcatgtcttcaaaaataattactgcatagctcttgagttccaagagctgtcagagatgccgatcagagtttgggtcactctagctgctgtaggggaataggctgtagaatggcaggagaggaggtgggggcactggctgggaggctggtatagttgcagctgtgagaggcaatgatgcctcttggtcaggtggttgccgtggagatggggagatgtgggcagacttgggctgtgagcgtaggctcctgaaagagtctcctgccattccatatccctcatgaagcctcccctgccactctggtgcctaagatcatcactctcctttgagtctgcagtgcctccattggccctttgcctgtgtaaccaaatatatcctttctctaagcagtgatttttgagctttttataaaagggacctcttgaaaacatgaagaaagtccacacaccttttccccagagaatgttccttcccatgaaagtttacaaacaactgcagggtgtttaaccatggggtccctgttccctaggctaaggactctattatctctgtcacccacaagccaacctctcacttctttccatcttcttctcttattgtatttcagtgggcacagaagatgctccagacatacatttccttgatggcaccctcattcctgataacttcctttggaaatgcatgacattcacttgtccatttttgtaaagtcatgcaaaatttggtttgaaatgttctaaaataacctaagaatgtggttggcttaatggttcaatttggagcacctctttgggccaagggattggagaggaggagctgtggtcagagttaggtctgctggcactgcagataaacaaatgttttcaatgtgaattgtgctgtataaaggtccaagggtctttccagaagaagttagcactaagttaaagcattttgaggctggagtgcatttagagaagactcattaatgttcatgtgatcatgttatgacaggtcaataccactttaaatcattccaaatggtctaacatgtggcttgaaaaataacagaggaaacagttgtaaggatgattgcatagtgctctattactgcgacttttgtttctaaagccaatgtgagggccacacaactgtgagacaaaggcgattactttggtattgaaagcacctttgcaggactgctatcagttagcagaaaatgtcctcctggcactagcattgtcttctgttaaagtgctttccacagagcattccttaactgcagtccacaacaattctggatttaaaactgagaactcaaaagaaagactattttttttgagagttctgtatatattctaggtgctaatccttttcagatagatagtttgcaaatattttctcccatccatagcttttttttcatcctcttcactgggtctttcagagagcaacagtttctgattttgatgaggcccaatttatacattttcccttttatggatcctgcttctggtgtccagtctaagacctctttgcctagctctagattctgaggatgtttttcctatgttttaatctcaaagcttcatagttttatgtttaagtccatgaccgattttgagtttaatacttgtgtaaggtgtgaagtttacctagagattcattttgttgcctatgaatgagagactaatttttagaacctcttatttgaatgtatttattgcgcttctttttttgtttttagtacagatggggtctcgctgtgttgcccaggctgggtgccaactcctggcctcaagtgatcctcctgaccaagcctcccaaagtgctgggattacaggtgtgagccactgggcaggactactgtgcttttgtgttttctcttccactagccctgagctgaagacgaacatcccagaatgttctgttttcttctgtctttcagtatctcagtatggaggggctccagatggatccaaataaggaactgcgaacgttcatattttaaacattaaactgtttcaccaagtttcttgatgaaaagatcaaatgcaggcaagattattaatcacaagatattttattctaaaatggtcttgtgtacaattacagagatccaccatgacaatcctgctctttctcactccactagccctgcaataaattggaaattcacacagaaacactgattcattgtgaaattcaaccgaaacattcagcagttctcatgactttttttgcacttataatagattttttcatatttatgttaatttgtaacgatctcatggacatgtaaagcttttagctctctacctgtgtgacattcagaaaataacctattttccatttaaagaggttagttgaaatattcagataggattatcctatctaatcctatctgaatatttcaactaacatattaatatttcaattaaaacatgaggtcttttcaagttttccaattatgcatatagaactggcaattgatatgtggtcttgtcaaaatagtgaaagaacaatcatgcagctgggccctgtgagggctgggataagccagcgtccagacaagttagacacaactattttcctctctcttctcccttgccctctaaccatgaggaattatagtgccttttgctataagtcaaaatgtcagttctcacaaaaggatttgaataactggtctcaggaatggtttgaggtactctagggttgataccagagtaagacttttaaaagtctctggaaagggtagcagcataacttaaatatatcaatttttattagagatgaccatttcttcttttaataatcacattgtcactatgcagatctgcatttttcatgaaaaacttcatttctgattctgaaggcgtttccccttcatttgcaagcatttcataaatgctgatgttcttaaactttgctttttgttcaaaactgttcatcgttaagtgactctttaatagctagttaataaaatactttcacccaacaaagaccagattgtgtagctggtaatttcagatttacacggaacaagcttcactaacagcgaatttttaatttgcaagtataaaactcccttgtgcatatttagaggaagagattcttagaataaaattggaatgcttccaattctctttattcttaggcacttcttcaaaattgtctcgcagagtaagagtatgatttttaaaattaactgtattcagggggctttttttttccagaacaagctagaacttctggggtataggcagaacaatagggccctaggtggtctcccagatcgggttccctggaaacactcagatggagatggatgtaggtggtctactgggaacaccacccagaaggaagagagggagggaagcagccctgggcagagggagaagctaagttatgatgcaattgcaagagagctatcagctaatcccaaagggagcaacagaagctgggagaacccttggagttgtccaggcaaggtgagggggctgggctttggtactatcacgtgactgtccttggatgcagctgccccagaagtggtgtaacctcgcctgtagtggctcccttagactggagcaattcctggggtgggatttagctgtgagtgtcagcactgtcatgtggggagccaggtgcttgagtgccttggtcctgaaaggggtatccaaggggcccaactcagcatctactgccagtgaattgggttgtgccccaaatgagcagtaaggggtctcttcttttgttcattcagtgaacatcagtggaacgtggttaaagaaagggatgaagacaaatggaggcagacggaagaaccactgcgggtcacagtgcaggagccgagcatgtgaaaggaaccactgccttcagtcggccagccgcagtcatgcccggagctttgaacacaatgttggcttttatttatttatttacatatatatatatttatatatatatatatatatatatatatatatatatatatatatatataaataattttgcgacagagtcttactctgtcactcaggctggagtgcagtggcacattattggctcactgcaacctccgcctcctgggttcaagcaattctcctgcctcagcctcctgagttgctgggattacaggcacccaaaacaatgcctggctcatttttgtatttttgtagagatggggtttcaccatattggtcaagctggtcttgaactcctgacctcaggtgatctgcctgccttggcctcccaaagtgctgggattgcaggtatgtatttttagtagagatggggtttcaccatgttggccaggctggtctcgaactcctgacctcaggtgatctgcctgcctcggcctcccaaagtgctgggattacaggcgtgagccaccatgcccagccaaaatgttggcttttgt

SEQ ID NO: 223 - DNA, 8323 bp, Homo sapiens
agaaagaaaaccttccttttatccttccagaaattcccagttggaagactatataggaagttcatggtgctggatttcttcctgccttccatgctgttcccatcccccagttggttttagctcttcctgctgcctcaatatgtggctgtaatccagattctccagcctccattcacatgaattttcctatacctcatccgtgccccaccttcaactagagttttcctgtgcagggatatgtcctgatccgcaccactggtctttatctctcctgagtttgtcctgaacttccagctgttgaaccatagacaatggtttgactcaatagctctaaagccagccggtccatctgttcttaatcttacctctgttccactcaagatacctggagttcacttcaattccttggtctcctgtttcttccacacgctgtcagccaggcaagtcatcctttgtggtatctcttgcatccttcgagatgtctcttgcgtctatttcatctttttatatccagtactttcacccaagggcagatcttcatctgagcatttattcatgtcttcaaaaataattactgcatagctcttgagttccaagagctgtcagagatgccgatcagagtttgggtcactctagctgctgtaggggaataggctgtagaatggcaggagaggaggtgggggcactggctgggaggctggtatagttgcagctgtgagaggcaatgatgcctcttggtcaggtggttgccgtggagatggggagatgtgggcagacttgggctgtgagcgtaggctcctgaaagagtctcctgccattccatatccctcatgaagcctcccctgccactctggtgcctaagatcatcactctcctttgagtctgcagtgcctccattggccctttgcctgtgtaaccaaatatatcctttctctaagcagtgatttttgagctttttataaaagggacctcttgaaaacatgaagaaagtccacacaccttttccccagagaatgttccttcccatgaaagtttacaaacaactgcagggtgtttaaccatggggtccctgttccctaggctaaggactctattatctctgtcacccacaagccaacctctcacttctttccatcttcttctcttattgtatttcagtgggcacagaagatgctccagacatacatttccttgatggcaccctcattcctgataacttcctttggaaatgcatgacattcacttgtccatttttgtaaagtcatgcaaaatttggtttgaaatgttctaaaataacctaagaatgtggttggcttaatggttcaatttggagcacctctttgggccaagggattggagaggaggagctgtggtcagagttaggtctgctggcactgcagataaacaaatgttttcaatgtgaattgtgctgtataaaggtccaagggtctttccagaagaagttagcactaagttaaagcattttgaggctggagtgcatttagagaagactcattaatgttcatgtgatcatgttatgacaggtcaataccactttaaatcattccaaatggtctaacatgtggcttgaaaaataacagaggaaacagttgtaaggatgattgcatagtgctctattactgcgacttttgtttctaaagccaatgtgagggccacacaactgtgagacaaaggcgattactttggtattgaaagcacctttgcaggactgctatcagttagcagaaaatgtcctcctggcactagcattgtcttctgttaaagtgctttccacagagcattccttaactgcagtccacaacaattctggatttaaaactgagaactcaaaagaaagactattttttttgagagttctgtatatattctaggtgctaatccttttcagatagatagtttgcaaatattttctcccatccatagcttttttttcatcctcttcactgggtctttcagagagcaacagtttctgattttgatgaggcccaatttatacattttcccttttatggatcctgcttctggtgtccagtctaagacctctttgcctagctctagattctgaggatgtttttcctatgttttaatctcaaagcttcatagttttatgtttaagtccatgaccgattttgagtttaatacttgtgtaaggtgtgaagtttacctagagattcattttgttgcctatgaatgagagactaatttttagaacctcttatttgaatgtatttattgcgcttctttttttgtttttagtacagatggggtctcgctgtgttgcccaggctgggtgccaactcctggcctcaagtgatcctcctgaccaagcctcccaaagtgctgggattacaggtgtgagccactgggcaggactactgtgcttttgtgttttctcttccactagccctgagctgaagacgaacatcccagaatgttctgttttcttctgtctttcagtatctcagtatggaggggctccagatggatccaaataaggaactgcgaacgttcatattttaaacattaaactgtttcaccaagtttcttgatgaaaagatcaaatgcaggcaagattattaatcacaagatattttattctaaaatggtcttgtgtacaattacagagatccaccatgacaatcctgctctttctcactccactagccctgcaataaattggaaattcacacagaaacactgattcattgtgaaattcaaccgaaacattcagcagttctcatgactttttttgcacttataatagattttttcatatttatgttaatttgtaacgatctcatggacatgtaaagcttttagctctctacctgtgtgacattcagaaaataacctattttccatttaaagaggttagttgaaatattcagataggattatcctatctaatcctatctgaatatttcaactaacatattaatatttcaattaaaacatgaggtcttttcaagttttccaattatgcatatagaactggcaattgatatgtggtcttgtcaaaatagtgaaagaacaatcatgcagctgggccctgtgagggctgggataagccagcgtccagacaagttagacacaactattttcctctctcttctcccttgccctctaaccatgaggaattatagtgccttttgctataagtcaaaatgtcagttctcacaaaaggatttgaataactggtctcaggaatggtttgaggtactctagggttgataccagagtaagacttttaaaagtctctggaaagggtagcagcataacttaaatatatcaatttttattagagatgaccatttcttcttttaataatcacattgtcactatgcagatctgcatttttcatgaaaaacttcatttctgattctgaaggcgtttccccttcatttgcaagcatttcataaatgctgatgttcttaaactttgctttttgttcaaaactgttcatcgttaagtgactctttaatagctagttaataaaatactttcacccaacaaagaccagattgtgtagctggtaatttcagatttacacggaacaagcttcactaacagcgaatttttaatttgcaagtataaaactcccttgtgcatatttagaggaagagattcttagaataaaattggaatgcttccaattctctttattcttaggcacttcttcaaaattgtctcgcagagtaagagtatgatttttaaaattaactgtattcagggggctttttttttccagaacaagctagaacttctggggtataggcagaacaatagggccctaggtggtctcccagatcgggttccctggaaacactcagatggagatggatgtaggtggtctactgggaacaccacccagaaggaagagagggagggaagcagccctgggcagagggagaagctaagttatgatgcaattgcaagagagctatcagctaatcccaaagggagcaacagaagctgggagaacccttggagttgtccaggcaaggtgagggggctgggctttggtactatcacgtgactgtccttggatgcagctgccccagaagtggtgtaacctcgcctgtagtggctcccttagactggagcaattcctggggtgggatttagctgtgagtgtcagcactgtcatgtggggagccaggtgcttgagtgccttggtcctgaaaggggtatccaaggggcccaactcagcatctactgccagtgaattgggttgtgccccaaatgagcagtaaggggtctcttcttttgttcattcagtgaacatcagtggaacgtggttaaagaaagggatgaagacaaatggaggcagacggaagaaccactgcgggtcacagtgcaggagccgagcatgtgaaaggaaccactgccttcagtcggccagccgcagtcatgcccggagctttgaacacaatgttggcttttatttatttatttacatatatatatatttatatatatatatatatatatatatatatatatatatatatatatataaataattttgcgacagagtcttactctgtcactcaggctggagtgcagtggcacattattggctcactgcaacctccgcctcctgggttcaagcaattctcctgcctcagcctcctgagttgctgggattacaggcacccaaaacaatgcctggctcatttttgtatttttgtagagatggggtttcaccatattggtcaagctggtcttgaactcctgacctcaggtgatctgcctgccttggcctcccaaagtgctgggattgcaggtatgtatttttagtagagatggggtttcaccatgttggccaggctggtctcgaactcctgacctcaggtgatctgcctgcctcggcctcccaaagtgctgggattacaggcgtgagccaccatgcccagccaaaatgttggcttttgttaccattgcctacatcgtgccagatttgggtgctgtgattttatgtttaccattaccctctctcccttgctcgtaacttctaactcaagtagctcgtcttgcttgactgcacaggctatcccttttctctctcactgtgacctggcaccagggttcccagacacagtctgccagaccctcggagctgctcctcccacacagaagtttgcgagtctgtgtgctggtcagaacatccttgtaacatgaggagcacgactgtggctgtctgagctggagctgggtcactgcctctcaacagtcactgtggatcataacctctatcaatccactctgaagagctgatgcagactggagtcacagcaggatcatgatcttttttttttttttatattactttaagttctgggatacatgtgcagaacgtacaggtttgttacataggtatacatgtgccatggtggtttactgcacctatcaacccgtcatctaggttttaagccccgaatgcattaggtatttgtcctaatgctctctctccccttgccccccatcccctaacaggcccctgtgtgtgatgttcccctccctgtgcccatgtgttctcattgttcaactcccacttatgagtgagaacatgtggtgtttggttttctgttcctgtgttagtttgctgaggatgatagttttcagcttcattcatgtatctgcaaaagacatgaactcattctttcttatggctgcatagtattccatggtgtatatgtgccacattttctttatccagtctatcattgatgggcatttgggttggttccaagtctttgctattgtaaatagtgctgcagtaaacacacgtgtgcatgtgtctttacagaatgatttataatcctttgggtatataccagtaatgggattgctgggtcaaatggtatttctggttctaggtccttgaggaatcgccacactgtcttccacaatggttgaactaatttacactctcaccaacagtgtaaaagtgttcctatttctccacagccttgccagcttctgttgtttccacactttttaataatcaccattctaattggcgtgagatagtatctcattgtggttttgatttgcatttctctaatgaccagtgataatgagcttcttttcatatgtttgttggctgctgcataaatgtctttaagaatccactcttcagagctgattccgactggattttggtcagccatgaagtggtatctgactgcaacacactctacttcaaacatagtcatgttttaggatgaggccatcttcaagcctgagatccgtttctcatagaaagtgtttatgctgaaagcatatgggccctaagagttcacttctcctgcaggcttcaccatgaagacccccccagttattggcaagttcattccacctccgcttccaacccccctacacgacggaaggacgggcccaatgtgacactgtgtgaactctgatttcctttggtaacaaatacttctgttaaaatatatccagatgtcagcgctagatgataaatttgaacaaacacattttggttaaattagtatgattattttgactttccagtgtttacttggtttgttaagcatttttacttctctctaccattgaggaaagacaagtgggataatttattttgaggaaggaaaactcaaagctatcacgtatgtgaaaaaacatgtgaggtatctgagttgttgaaatcacgattgatcctaattgatacttacaagttatagaaaatgtggcaatggattgccaatcaatatttaaaaactgaaaacctgttggtagataacatggtttctctaggaaacaaacggctgcactcccaacagatttgtaaatatctcattgactcaaagcaaagaagtcaataaaaagaaaatgaaatcaaatttctaaaatttcatacaaatattttaccttatttttctcctttgttcctttcttttgttttttggctttcttgggttgtttttcctttttcttcttcttctttttgtttttttcttcttcctcttggtttgctatgatatcctcaataacctagtgaaaaccaaaataatcataccattttcatagatccctatcaagagaaggactgttttccctgtctgaaaggaagtttttgtgctggtcagtgtcatctctctgcctggccctggaccctgcaggccgaccccttctggggcatggtggggctcctgcctaccatctacccttagctggattcatgaacagggggcagcagcctcagtgtagatggagagagagtctcgacgtttctgagcccagttccttccctaattccacccactccagctcctggaggttccacaaactctaggggaggtcatagcttcctcaacgtctcagcaacagctggatgtgccagccctgcccacagctcgtcaaaatccagggggaggatgccactgcttcctgctaggctccaatggcaacagccactcttgcaataactttcattttcatgagttggtttctttcaccagtgatttaatttatatcccctacagtgacaaaagaccttttatcctcctaaattataaaatatttgttaaaaagtatccagttcacataggattagcactactggagaattattatagatttgttaaaaaaacatataattcagttcaatacaacagtgttcactgagcactcactcactgccatagagagctgtgaattccaggagatataaaggtgacaatgacaggacacgcttcctgtttggcccccagggctctgctcatgacttgtcatgtggccaagacaagctgcataagctctctgagactcagtttcctcagctctaaaagggagccagcatctccgtacatagcacttaggatccgccaggcatgcttctgagagcctcacagagacagactcctttgctgctacaccagacgcatgggggttgctgttgttgccctgttttatggatgagggaactgggacacatacagtgcagtatcccagccagggacacacagctagtgagtagctgagctgggattcagcacgtgcttaaccaggatgaatttcataatgtagggagaaaagaggcataatgtataagaacacatgtcaacttactccatcgtacaaaatgcacagagtgaaaccaacaatccatactccagtctcaggtacatacacatgtagtccaagtacaaaggaatgtaagggaatgacaaactccaaattaagtacagcagttgcctttgaagatggagcaattaaaaaattgggggtggggagacaagggctaatatcgttttatcctagtgtggagaaaggc

SEQ ID NO: 224 - DNA, 17220 bp, Homo sapiens
ccacaaaaataaagcagcacaatggttgcagtaaatgacttgctattactacaccacaaaagtggagaaagctgccatagaagcaaggtgcacccagggtttgtgggaggcccatggttctggggtccaaagacaggcccagtgctgatttttgtgggtgggcctggtgtcagggtttgtgggaggcccatggtactgggtttcactggcctggtgctgagctccatggtgaagtcagatgttcacttctctgtccctttcttccaagataaaactcatgggtctaggagatctctcttggcactaggctgtgtgggctttggggtgacatgggtaaagtgaaactttcattcttactctcttcagtgcatctttttttttatgattctgtgctccacccaggtgctgcagcctctcacctgaatcccagagctcttgtgaagttactttcatctatggatggttattaaattggtgttttcagcttacagtgaaagatcttcagaacaccaattcagttgccttcagggttaaaccataatatcaacacaaaatggatcaagagccagtcatcctaaaaagaccacatgcatggcccctgatctagcaaaagtagtcacaaatgcagctgaatgtgtggaaacctctaagagaaaatgtgtgaatcacagaaagagtggctccagtcatggaacgtggagaaagctgccacagaagcaaaggctgcctatgctcatgccagcactgacagggagaactctccgccctctaccttgggtattctggctccaatgacagggctgtctctggaatgaaggtagaagcaggggccaaactaaatgaacttcaaataccctgatctaactagctactctaaaccactgtgagatggattggtggcaacttacacttccaattcatccaattcctttccctatgattccctcactcacaaaaacctgctcattaccattggcctcccttatagatctatgtacaggaacagttgggggctgtttggggaatgtgctttggctcttttgatagttcccattctatcagtggggcttgggtaatatgaatctgcaactgaccggggctggggagatgttactctcagatggttgggtttatcctatttatgaatccacaggcccaaaggttaaatggtggaccaattaaatttaccaaaggcaggcatgtttccccgtgaggtgtcctggcaacaggcggccctcctggacatgccacagcatgtcaggggctgcttttcatgactgaatccgctccaccgcacccctctgcaggctccttccccactcaccttgtcctttttctttcctgctttcactgggcgctccctttctctgtccacagctagctttaagtttttaagttcctgtctcatcaactcatcaacctaggagaatacaaaacatactacttttaagtcactttgcatgtcttgtgttttgtttgtgaagtttaaaaatcccttaaattatggggtaggtcattagtaggaaattgtaaagaagcacaatggttgaagtaaatgatttgctgttactacaccataaacgtagctgtacctgtatcctgatctctgactgtaattcttttcgtttctcctctttgatcagttctggatcatagtcctgagagaaattccaagactcatcttttttcatccagatttctacactccagaagggtaaagaaaaagaaaaagaaaaaattttaaaaagatataggttaatgaaattttaaaaagacgtaggttaattgtaagttattgcaatataaacataagcctaactttatatgttattgcataggataaaagtttgaataaaataagctggacagatgagattcatatatgtgcttgtaaatgcactaaaaaaagaaaaaaaactgctgatgtaaaaatattgagttttagtttactcaatattttttaagtgtgatacaatagtattctactgtattattataatcatgtaaaaacaatatgttaatgctgggattatacaatcacagatgaccttttttgtaatgttttatcttactttttttcttcaaatgattcactaaaatacgaaagattttgttgcctgttgaactctccaggaattatcccttgcctcctattacaaaacagacaacactaaacacacaagtacccagtatttctccctaattcaacagctaaatttctgaattactttttggatgtttttgaaatcacacatatttaaaatttcccttttgcctcttcctggtggttaggagggtggacctggagaaacatgaccctagacaaagtaagaataatttcccatcactaaaataaatggaaatagagctcctttctcagaagggaggttccaaatgtatgctgaggtgtggaatagctggatcctcgacgtgggacttggaagaggtctcccatgggaagccaagacttgtcatttggggaaggagacatctttctggaatctatgtcgagaatgtaaaggaaatttgctggaatttgtgaagctgacaaccgccacccagtctggccacttcactgggagctgcctttagggttctgatgaccttcaacctaggaaggcagctgaggacccagggcacagacagaggctcccaacctctaagggacaagggctgccccttgtgaagacagcagaggctgcaggcctccaaggcagggggtggtgaatgaatgagggaggcttctcagcatggcttccctgacaagcatggcatgacccactgaccgagaagggagagggtggtgctctaactctacattgggaggaaagtcatagtcacagacagaagcacaaatctggctgctggagacccagagccatcaaacgtgaagacctagcatagagacgtttccccagagaattacatgggcaaactaatgggaaggaggggttgagtctctgaacaaaccacagaggaccaggaactggcaaaagggatggacaaggaaaggggcagggataaggtgctgtgagacccgggaaaagctagactctcaggagaggtggggaaagcctggggagactctgaggcaaactcagaactggtgaataggcaggacaattgtcccgagggttttggccacctgccacctgcctggggcagcacagcttggtgcaagagccactgtttgtggccaggtggaacccctgccctaccacctaccagctggtgaccttagcaggggatagcctttgcagagaccattcccctttctgagaaatgaaaataaccccttcctcacgctgatatggtgatggtaaatggaataaaatatataaagttgtatgaataaattaatttttaataaatatttatatataaataaatatatacagttccagtttagccccaaatagttgctgccatcccccaggaagcagagcatctcacagggtcttagcctacctcattgacactctgtacccctcgaggggagaggataatgcaggacagcagctacaccagaaacagctatgccccaaagccccaaagcaggtgcatgccagcaaagaggaataagggccctggggccagtgcctgcgtctttagtggtcagagtcaggaccctcaggacaggacacctgcaggaagacaggacatggaaatgcagctccagttttcaaaaagagtgggttgggccaggcgcagtggctcatgcctgtaatcccagcactctgggaggccgaggtgggcagatcccgagatcaggagtttgagaccagcctgacgaacatgatgaaaccctgtctctattaaaagtacaaaaattagccaggtgtggtggcgtgcacctgaaatcccagctactcaggaggctgaggcaggagaattgcttgaatccaggaggtggaggttgcagtgagctgagactccagcctaggcgacagagcgagactgtctcaaaaagaaaaaaaaaaaaagtgggttgggttcacaagctgcagctgctgataccagaggtgagcacagaaggggcagaaggggttgtctgccacacacggcagaggcaggtccacctgccttcctggacagactacggcacggatggctcagcaggtgtctgagcggggtgggtggtgggggttccagcaggacccagcaagagctcttggctggcctacctcctaccagcaaaccgaagggcagggctgtgtgtgtattgctggctgagcaccatctctgccacagagatatggaggaccagcccgtggtggcgcaagggcagttgggcaggtttttgaaaatgatgcagaaaatgatgcaaatttctttcagaatggctaatgtgggcttacaaacagacagaaaataaatcacaaaggtggtaaatttttcataggaccaatgcacttaggcgtccttccccagacagggcagtctcataagaggtggcccagggattgggggcacagcgctgggggtgggaagggggctcagatgggactctgaaggtgactgcagaggtgaggccaaagttcaaggggtgtcttcattcacacggggcaggtggccagcccaaaacaggtgtgacgacaagaggggagaagaggcgaaaaaggctgatgggctggagtgggcctacaggaggcagctgggaagcctgggctgaacaactctctttacacataatcctttccagtgagagccagcccgagagccaaggtatagaaaacaagcattgcatacattgtctaaagcatcccattggtggaagagatacttcatgtcactaatatgtggaagttcgttctttgctctgcactcccttagattttgtggttagcttgtaggaggtatgtactccaaaggcccggagagtttacgactcctgcatttgaagtgaattgctcttttctagtaaattttctgaaatgtacataagcttaaactgtgaaaaacttcaaaatgtaggaataacacgtagtgataaaacataggaaaaggaatcaatgcttccttttatgtgtttaaaattgtaagcattctccttcgaaaattctagaaaaggtttaaatgtgtcataatgtgctgtttactaataataatcccccttgtaggatttctaaatcttctgcaatagcagcacctacctgttacatcagggcattttaaacaaaacagctttgttagtaacgggaagctacttttctttttcactagattcactaaaatcaggaaataatgtatttaataataaaaggaaggcagaatctttaacagaagggaaaccatgacacgattacttatgtagaaacagttgtacggtagaacacattctcattctggagttgcaattatatttaaaataaaacactgcagagccgttttgcccatttcccctctagatcgtttaaatggattgagttttccactgaaactttgcttttctcatgacacttttgcgcagggcacttttcaatcccttcaagaatttcatggacatttataaatgcaggaagctattcatggccctcaaagggcaacaactgccccactctctcctagagcggagaaagagcttttatcctaagaatgtgaaaagcgaggccaaggcagtttcacacgtgggggggcaatgaaagaggggcgggggggggttaatcttagtgattaaaatgctaatgttttatttgaagaggaaaacctttgatttttaagaaaagaattctaagaggaagacatttaattccttgaagttaccaaagacctggcagataacaagtccaatgccacaacatccaaccaggaaaatgacactacaggcttgcttctaggagggacgctgcttgctttttcagtcttaatggaaacagatattacacaaaaggcgtggacagttttcagagcttttgggccggtcagcaggttgcaagagttggcttcccatgggagcattagatttctctaatgcttaacgtttgcttgtatagaaataatacacattgttttaaacaaagtcagagtattaaacagattataataaaaaacctgtcccactctatctacctgctaattacattatccaatggcattctttcctatattcatttattcattaaaaatacataggtcaaattcagttattacattttgactttattgagccgattataggccaggcactgctctcagagcaggtggataatggaaggccctgccctcaaggacttggcattgcactgtgagaagcatccgtgaacacacactcacacccaagtggtaagtacagcgagcaaagggtgggcgcgggcagagggggactgtcactccacaagggccctcaaggaaggggcctcactggcactgaggcccaaagggacaagcattctgagccagaggaacagaaagcatgagtgccggaggtggagcgtgcccagcctgctggaggaagcgcagtggccacaggggcgtgtgtagcgatctggtttcgtggaagctctttcgggtggtttctgtgttcttttcctagtgtctatataacatgctcatatgctacttcttgatttatccatgtcagacatgagcccctgacttcctgccatgggacagcaggcttctgctctctggctcctttcttcctgtgccctcattgtctttacatagtcgtatcagaagagaagggagccctgctttccacatcctggggcacctactgtctgagtgtaagtgaaggacagctttcagatgcccagggcagccacaactcccctctgtgagtcccttcttgggacatcctagagaatgagctctaccaaaatgagggagaggcaagaagtcagcaaaggccaaggaaggctcaaggatcgcagctgagacggagggctccacaaaggtgctcttcggaagaaaacaaattagtaagttacctggcatgtttgaaggtgtgggagttatcttataggtacatgcagtaccaaaccagtgagggtggctgtaaaggccaaatgatgatatgcaaagcagagtcttagatgggatgttgttgcagacacatacctgatgccagtggaccctagccaggcccacggccccactgtgtggatgacagtaactcccagcaggacccactggatgttgttactgtcatccgaacttacagaaactactcagtttatgccactatctccaccccatcccaccactgtaatccccaacatataagctcattgttggcaggtgttacctttatatctctgggctagcactgcacctgacaccctggaaatgctgaatgtttgttgaaggaatatgcaagtgaaaaggtgtttttgatagtgactgctctgcaccattaaggagttgatggattcttaagcttggatgacagcggggcttctaccagtacctgcccatacgaggagagcaacatttacctcccccagttgttgtgaatattaaatgagatgggcatggaaaaactccaagccttgcacgtcttaggtacttaataaatgttagtttccccttttgacctcctttcttcccagtgaaaatggattgagttgccaaatcctgccagtgtcatcgtgtcccccagggttcccctttagttcagcatctcatgcagtggggtgcccttgccactagtggtatgtaagagaattttcagtggcacacagacatttttatcttatatcactagcatatcaaacctatgaccacattcatattgttgcttaggataaggtgcaattattaaggtgaaagccctgagtcaatttaaaaatacatctattaagttaataatatccagagaagaccaaggttgggaaggaggccacgaatgactgccatttggaaagattccacttcacatccggattgcaactttcagaaacttccacactagcactaatgactgaggtcaccttggcaggtcactgtgtttggatttatcttgagggcacagtagaaccacaggagttcggtaatagttctaggaaattaaaatgcaaatatctgaaagaccagttcctacacttgcggatccagccagatgacagctatgctcatcaggctgaacaactgacagaaaaatcgtgtgtcagaattgaggcacacatcttagtttaataggaataagacatttgactacacatacagtatcaattttcttaatttaagcaatctaaaaatatgtttcttccctgccactagcatgaaaacattcagctgaagtcttaggggttcaaaaacaggatggaggtcttgactatcttctcatcctatatgcatcttgccttttaaccaattgtatgcttaaggccaccaaaaggaatttttttttttttttgaggcagagtctcgctctgtcatccaggctggagtgcaatggcgtgatatcggctcactgcaagctccgcctcctgggttcaagtgattctcctgcttcagcctcccgagtagctgggattacaggctcccgctgttacgcccagctaattttttttatttttgaagagatggggtttcaccatgttggccaggctggtcttgaactcctgacctcatgtgatctgcccacctcggcctcccaaagtgctgggattacaggcgcaagccacctcgcctggccaggaaatttaaaatagagacaggcagaatgtctcggttgtgagtggcatacagcagcctcccgtgatggggttcccagcacgtgctgctgtcttggtgaccatgcacgttctcctaaactgacctttgtatgcgttacatccttccttcattgcaggaagaaaaagacttggtgacattttccatttttcgtcttcttcctgttcaaagcagaatattttcgttaatctcaggcaagaccgggcagcaaaagacgcagacgctgtgataaccgtgacgagggtccatgccgcgcaggcccagtcctggtccccctgggcagtgcccctctggcccgtctaagtatggagtgctgtgtccactgaccaggcatgggtggtccaggctcaccgaagcatcccctgctgataccggctttctcttctcagtggcctcccctggggtaccccatgccccgagtttgatcctgtcttcttttttgattaaaaaactttctttctttctttctttttttgagacggggcttaaacaatcctcctgcctcagcctccccagtagctgggactgcaggtgtgcaccaccacacctggctaatttttaaatttttctgtagaggtggggttttgccatgttgcccaggctggtcttgaactcctaagctcaggcaatctgtccccctcagcctcccacagtgttgggattataggcctgagccaccacacccggcctggtcctgtcttctcatgctctcactccttccttgctctaaaggctgagttcctagcctgagtccatctgcctccctcctccacgttgctgtaaccagcccttggagctactccgagtcctttgctgagctgtgctgcttgccagttctagcaccagggctgttccttcctctcgctacctgccccatccttgagcctggagctgcagcctgactctggggccctgcttccttcccggagccagagtctagctagcctccctaccctgggccccccacagcagagagagcctggccaccatccttggctcctgctgctgactctgtgcaccaagatgggagattgcggtgctacccgccgccagcccaggccatagctctgctctgagccccagcacaacaccccctctgcccctctgccgccagggttcacctgcgcctaatagtgagagctaggccctgcaaaccctcatgtgatgtttctctgcaataatgttgacactgcctcaatagtctggtttccgatgaccactatcatggctattgctacccttagagagggcgaaaggaacaacgctggcctccatttggtcctcgggttcccgaagcaggctcagtactctctatgcagtgacaggaggggcagcagttgggtggcgcgggcgtgcctcccctgggctgcttccagagcacgccctgactctggcacctgatgggctcttccgtttctgggctccagggttgggctccgggatgcggtggcctgaacacggtgcccccacagtccctcgtggttgtgtagtatccatgcatcagatccagaggtatttctcctctctctccccatggccaagcaatcaccaaaccccactgttctgccgtggaggctttcctggggtctccctgcttctgcctccagtcccactgccctggccccttgctccaaggttggctaacgcagggtcactctcttctctcctgctggaaggggtctgcagcagacctggccttacgacttccttccttggaagccccacagaggcatttgtcttggagctcctgggaggcaccgttccccacaggacacagtccaagcccctcagcagaccacacacaacccccacaggtgtggtccctcaggagtgcccccgcccacctctggggcctttgcccttgccgcctcctgcctctgccgtcactgcagagatgctgacaaggccaccctccctgcacctgccatgctctttgccctgctgtcctgtccgcttggaaggccacccttgtcctacactttctgatgaattcagagtctgaacagacctcccgtcctcctgaaatcctctctgatggccttcctgcccttttgacaggattgtcacttcctaagaacagcccgcttttcccaccagacacagcaggcaggaaggaccccgccagccctggggcctggccacttggcctgtgtgcgacatttgctggatgaaacaagaagagggaaagtataggctcaatccatggataaatgtgtaaatacaatgtggtatttccatacaatgaaatgttgaactcacccacagaaaggagcgaacacagacacgggctacggagcggaggaagcgtgaagacctaggctgagagcgtgaagtcagaaccaaaaggcctcacagtgtatgatcccgtttatatgaaaacagataaactcagggacagaaagcagatcagtggtgccagggggttggtgcggggaagagaggggggaaggggagggactgtttaatgggtacggggtctccttggggttgatgaaaatgtctccactgtcacgctacttcactgcatccctcgtgatttttgccagatctgagaatccctgaccagcagaaccatcatttctttaaagactcacttaaacttatgttctttaaagaggcactctctattgctgaggtgaaaccatagtggatacactggtttcccgatacacatgagaatacaacacaaccatcggaataaaagaggctgggtgtggagccattggactctccccagtgcgtgccccaggtggctgggaaagccagggcttcctggaatcctccccagctcagggctggcagcggctcttgctcccaagacagtgctgggttacaccctgagcaaaggcacacttggttgcctcagttactttctgaggcaactgtagctctgatcaagtcacctcctggctcaagtgtccccaggggcttcccacagccccctgagaccacgggttaccagctcactcagaggacacacctcctgcccctgctgactctcatctgtggtctattcccctgtgaatccaccacgtcttttttcagctttgcatttcagctttgcatttttcagctttgcattttgctttgagtccactgtgtctttcagctttgcatttgctcaggtcaccaggaagcaaggaagacgcaggaaatgggatcacaagagcttcaggggaggcccggggtgctcgggagaggactctcacttcatggggtgggggggcatggcaggcttgcctggaaccgcagcccataaaccatgcagggggagctgcagccagcggggaaccagggagagaacctggacccagaaacaccagggggcccaaagcctatgacacagctcacccaccttccagagcgcacactaaatcaaagctctctggtaagaaagtcccacctacgacacaaggcttgggttagctacgccccattcctggctcccaagagacccaggcattagagaaaagcctgcaagagcagcaagaaaaagactagtagtggataaagcaaggcctgggaggaaagagggagaattcatgaacgaaagagaaatttaaaatcactttaattagtatatttatcctcagatatattatttatcatctgtctgtctgtctgtctctctctttccaggtatcactaaggagtcatacatctttattactttttcgtcaatgttattgtctattattgccatttttgttttggatactcagattgttctatgtttggtctctgggagcccctacactggtgaggctgtgctcttagggatggatgaaggcaaggaagaggaggagggggagggggagggctccagggaaggagactgaggtgtgacaaagggtttccagcagaaggaacagcatgtgtgaagtccagatggggaggctgtgtctcacagggatggctgaaggaggttcggcagccgtgaggactgcgtggggctgggcagacagacatgaggctggagtggcgggagagagagagaggcagagagaagagggaggaaaagagagacagggggacagagatggagacacagagaaagaggatggctcttgaaaggaccaagagctgcagggagcttggagttggcttatgagcagggcagctacccaggagcctggtgtgaagggaatggccccttgggacatcactctggctggaactgggggttgaggggtggggaggaggctagtttgcatgcatatgtgatatccatctgttatagcagaatcatagtttatggcttaaaagttttgctggatgaataggtgtaacatggtatttaaaaaaaattatatttctttagttggtgtggctgaacttcattttatttgcttttcatttcctaactttgtggccttatcttgatttttacaaatgaaagtgcatgagcctacctatttacctgtgaacctttcctgagcagctactaagggtgggactcactagatactagaactgcacagggcctgcctctgagatccttgagtcctcctgcctccccgatcctcgctcgctgtgcctcggggccccgactgcaacacaccacagcccctcttcccccgatgccttttactaggtggttcccaggtccagggcttccctgtaactgtcacacacacgtttccccgaatagaaaccaggggtcgccttcccagatcccatcccaccactgtggctggccttgcacactctggcccacttcctgaggtgaggaaggctagccatgacccgagttctgatgctctcttcctctacacagggtgggtggcccactccactgtcagacaacttttttgacttaacccaatggagagttaaaaaaaaaaaaaaaaaagaaaaagaaaaagaaaagaaaagaaagaaaaaagaaaaaaaatccaatgccccagctctgccctagaccaattatgctcaattaagtgagaatttcttccaaggtgtgtggatattgggagtcgttttttcctaaaaccaccccaggcagctagactgaaggccatagattcattgaagttgtccttccatcagctgaggcccagttcctggagcctcagggagtctgcaccctcttcatgccctaagtctgctccagatgaagccttcctgactcctatccccatcgctcaaaagagatttccagattattcgccctcctggccatcttctgtggactgttctagctacccaggctcccagtcaagcaacggtgctggtttaatggtcatggtggagccacggccggtaacctccttggcctttgcggcatgtgaaggtggcctgcagttatgccactgtctggacattcccagcacaccatgggcctggagttaacaaagtcctcctatctttttaatgcatataccatgtagacagatatctcctgctttgaaattatatgaatggtttttaggtgtttattcgtaatgacttgaccggctcaggctgctataagaaaatagtatacactaagtgccttataaacaaaagaaatgcatttttcacagttccggaaactggcaagtcctagatcaaggtgcagattctgtgtctggtgggggctgctctctgcttcagagactgcaccttctagccatgtcttcactccgcggaaggggcaaagcagctctctggggtctctttcacaaaggcactaatctcaatcacaggggctctgccctcaggacctaatcaccctcagaggccccacctcctaacaccaccacattggtgattagctttcaatgtatgaattttttgtaggtgggtgaacacaaaaattcagaccatggcacccaacaaatgtaaatttcttacatttggcccacctaagtgacttcatgcttctggaggggagtgtttattcatgcctccgccattttccatctccattgctttccacacttgctggctgaacaaataatgaacaggtgggaggagaagtgcgttctcacctgcagaccgacctcagagttgagtcactgtagtatctgccttctctgcttggccacaccagcatgccatgatctgtggtttgttgcatccaactttcttgcctttttttgcaaactgagccatttccatggctccagttttctgggccttgctttctctggggctcctcaaatatcacagttagtagtactgagacttgacctgcccggtctctgggtaccgctaagatgctcaaccgcacagaaagcttcctttagagcagacagttgctttctcatcggcctctcactttctcttcatggcccaatcagttataaatcactcaggacaaagcagttgttaagtgaaaataaacttatggaggcctctcgatttgatttagacgatagtagtcctcctttctccaaggaggatacattccaagaccccagtgcacacctgaagcctcggatcgtaccaaccactacatacactatactttttcctatacagaaacaggcaggtagtgtatacagcatgaacatgctggacaaagggatgattcacgtccatggtgggatgggacaggatggtgtaagacttcattcacactgcgaagaatggtgcacaattcaaaactcaggaattttccatttaatacttatgggtcacacttgaccgtgggtaactggaactgcgaaaagtgaaactgagaataaggggggactagtgcatatttaaaaagctggtttatggaaactgaccatttttcgtaagtttccggctactgtgtgaactttgtcccttacacaacacagataaatgctacatggagaacgtttctaaagtttcttactgagagtcaatgggacatactgagagatgcagagatgcaaatgcaaatgtttccagaagaggctttgttatcaaaatatctttgtgaaattaggagggcagtcagagataaaccgtgcgccttcttcttgccctccccaaatgttaactactgctattatttcctgcctggcttaaagagcgattcaaatgcatggaggttttgttgaaaattttctattggtaaatatgtgcatctgaagtaggctgttgagggatggctaacatctcacactggtagggctgtggaaaaattcaaatagggctgcaactgttagattttttgaaatgaggttatatattttgaaatacatctgttctcagcggctttcagattacctgctcctcccctctgggtccgtatcctggggtgggggagaggtcgaccagcgattttgaagaggctgacgatttcccactgatctgagagtgaaataataatccccttctctagattcagaagtgaaaaccaacccagaaactataatggctgaacactatatttaaaaattaatatgcaccaaacaacgtgatagcttatgcaactaaacttgaaaaacagatcaaggatctccactattttttttttttttgagatggagtttcactctgttgcccaggctggagtgcagtagcacaatctcggctcactgcaagctctgcctcccgggttcatgccattctcctgcctcagcctcccaagtagctgggactacaggcgcccaccaccacgcctggctaattttttgtatatttagtagagatggggtttcaccatgttggccaggatggtctcaatctcttgacctcgtgatccgcctgcctcggcctcccaaagtgctgggattacaggcatgagccaccgcgcccagccacatctccactatttttgagcttgcatttagctcgtcattttactttctgctcatgcatttgcgacagcactagggaatcaacattcctcatggctttgagggctgcagagtgctactctttcccccacaaaagaaatacaagagataggagagaatctacagtgggaagtctaaaaatgtacagctgtgtcctaaatacatttgtcacaagtttctttgatggtatctgggttaatttttgtcggaaagagcttcttggttatgagtacggtagtaagaaataaaccacatttctcacatgggccatgcaagctgccagctggttactggctctccagtcctcagacttgggctggagtctacaccatgggccctcagctctctggcttttgaactctaccaccagctctcctggggccccctcttgtagacggcagatggtgggacttctcaggctccataaccaaaggaaccaataccttataatgaatgaatctttctctatataaatataaaagggcacagaagatatctatatatacacacacacacgggccacatgtactttttatatatcgctctcctattgattttgtttctctggagtgccctgactacactttcttctcaagccttctcctcacctctgctgcatcatttcccccctgtgatcctctctctctttaaagaacctcctcactgcctccatcatagccttagttttcactcctcattttttttttttcagtggaaaataacttttagtgagacctcagcagctgcaaaatctattcctggcattaagctccgtcttctactgcaattt

SEQ ID NO: 225 - DNA, 1863 bp, Homo sapiens
aaatacagaatctcacaaatcccgattttaatgtaaagaagcaacaaatatagtctaccttcatttggcataggaaggagagaaaacgctcttctaaaaatggaagaaaagacacagaacagcttgtccctttccatccaattaaaaacctcgtgagactgaactagattaaaaacaaaactctccagcgaagccgcaggcgcctccaagatagggagtccaccaccaataaagtacggcagatgccagcagtctcgtccccgaacgcaccgtccgtcccagggaagtcgcagcggcggggaggccggtcctaggttggggctggggtggggtgtgcggggcctggggacgcggaagctgcggcgcgccgaggtgacacggcttccaggggcgacgggcgcgcagggtccccaggcgagcgaggctggggagcagggcacctcccaggcgccgcgcggacgagagccgcgactggcacggcctggcagccgcgtaggcccgggccgttaggggcaccgagggcggtgcccgacttccagtgcggcgagcgcggcccccggcctccctactggcgagaacccctcccccgccccggcactgacctgtccagggcccggctgggcctggccgggcggggcctacgcagcccctcggccgggcgccgactcgcgcggggtcccgggcccgggcgggccgcctcctctccgccgggagcctccgagccggggcccggggctgccgcggcgcatccgaccgcaccggcctggccggcgtcaacaaagggcggccggggcgcgaggccgggacgggggcgcgaggccggggcgggagcgcgggcggcggccggggttgcgcgcgcgcgcgcggcgggcgctcgagggctgcagccgccgcggagacaatgcggcgagtctgggacggctcccgcggccgcctccgccgggggcggggcgagggagcggggcggggaggggcggggccgcgggaggggcggggcggacacgggccgcgcgcttcctttgtgcggcgagccccgcctcgcgccctccggaaggcgggttagggacgcccggggctcagcttagggaggcgggcgccacgccacgaggaggctgccctgatagccggtgcaagtgctccttggcggggcggcccgcgactcccgccttggaccgttcactccctgaggggcctgggggtcagtcagaagactaacgaccaccagtcaccgagagctcagttcgtgccaaaccctgctcgcgctgtccccgacttattgttcacaacgaccctacaagtcattctccttcccactgggaaccgaggatcagagggaagtcatggcccgagtgccccggtcacacctccgtgagcggcctcgggctcgcggttgaggctgattgaggaagtgggttcaggcggcccgccgtgcctggcacacggtcagagtcccgtaagtgttggttatcttccccaagcgcaccgggtgaacctgcgctgtcgtggcgaagcatactcattcagcacgcgcgcgaggggctgcgggggtacagagacgtgcagcgtgacacagtccccaccctcaggagcgcgaggcgcaggaaggtgctggacacacgccaggcacttctctccattcttgacttccctctgttcccaacatggtcccattttcttgccttccttagtattcatattcgttgcctgcctttcttctccccccacccctttccactctcaggcctcatcccatcttctttgtttacatttattttacattccccgaatatttacttagctccctttctcctctatttttcaaattttcaaccccccttttcattaatattcatatttccttct

SEQ ID NO: 226 - DNA, 1868 bp, Homo sapiens
cattcatttctgatacacgtatctggagaattctgttctgtgcaattccttttgttcctaactggccgaagttttgccattcagaggttttggcattcaaaactcaatgaaatctaatttcccaaaacccatcatctctcaccaaatatcccacagtgaactcccttttaaccaagggttcacacatcaacaggcagggacacacctgagtttgtgtgggaaacttctaaccaagggtcttgtcaattattcctgatcactgacccccctcttctggaccttggaaagataatcctagaaagaaatggctctatattctttgggggaggaagttagcaaggaaagagcaaattgttcacattttcagaaattttacatggaaatgtaaaaatattctaagacacatccaaaatatacttaaaaaaaaaaggggaaaagaagtagtccgtaccgggaaaggctccgccccctcctggatcacaaacccttcgataacatgcgtcaggatttggggtttcacaatggcctgtggtggtttattctcaccattctggggggcagtgccggcgatgctggaggcagagtttccgttccctgaggtcatgccggggctgctgaggtcggtcagtgcatgaacaatgccctgccctgtctctgcacgagagagagtaggaaaacaaagcaggggagatcagaaccagagtccacgcccagggagggacagcaaggactcaaactgcgcccggcttttaccgtggggccaagcgacaatgcaaaccaagcagtcccctcccctcagtgacccatttaaaagtggcacagtttcaatggacacatcaccaagtatgagtatagtcagttccacaacaacgcatgcagctaatcagctagcagtgtttcttcatttcccaaccgtgctatgaacagttaacccggataaacagacgggaattctatctttgaggagttaagaccttggtcgatactgatttgaacaaataaggttaatactcagtttgagggagaaaagtattcaaggtgacatctaaaaccaggacaagaagctgagctaggtatagggctttgagtgtgataaagagaagcttctacgaggttccttagaggagggattttaagagccctgtgaaatgtcaaaacactgaaccccagaaattgatgccaagggaatgtgggtgctgaaccccaagtaaaggctatcatgtatatttgactattcagagactggtcatctggggtcagtgcattgaaatatgcagaaattccatttctctgctaagaaggctgctaggcagaggctgagattttctctgctgtttctgctgagctgagtgctctcaaaatcagtcctcatgcccagatgtcagcttcttatctaatctgatcctcaccaaatcatagatcctctgtctctctgtggacaacctttcctaattctccttccccatgggcctgctagccttcctctaaaagacctaacagagtgctccagaaagtgagattacatgcctatacacaaccacacgacagtgaacttcctctcttccacttcaaacagcatctctcatgagctgtctcattgtcttagacgtgcaagacttcatctcctcacttctgtaactctctcccgcccccttcccagggctgttctctaccaccatcaactgccccgtgagctgaggctgcctttaacctggaacttcctaaaaaagaaaagaaaaagccatttctttattgcaacaagtccattaatataaagcataccccagtgaggtatgagtgatatatactttaaaagtgatttcagcacacttgttaagtaatctttgcataaaactttatatgaagat

SEQ ID NO: 227 - DNA, 2063 bp, Homo sapiens
gcaaatgtcagttcatttaggggtttctggattacaaacacttgagcaaaaaatgttgattaccactgttgcggagacagggcatgagtactcagtggggtcccatatggtacttctattagcaaattggtaaaaggcaaataaaacatgctatataatttacaggtggcaaagttaagcagaggtgttagtataatgaatagcagaattcagatagaaaagattcctgccccaccacttgtttttttctatgcctcagtggtcttacctttaaaatgaggatgataaaagttgctacctcagagggttattgtcaggattaaatgaggaaatatgtgtagtctagcagagagggctcagtaaatattaactattaatcattactgttttcttgctaggctggaactatgggctgaatttacaaggtaacacttaacagatgtaagcaattatattttggttcaaactataaattatacaagtttgagactagggagagctggcatgacagcagttccaggtaagacgaaacctcagaaacaaaaatgaaacccagctctctggaattcaggtgacagtgctctgtgaacaacagtgtcattcctatagggtgggagagttcacgggggccattcgtgcaccatcctgatgaaggaaggtgagcgagtgactaccgtaggagtcagagtcatggcgctgccctttcagagccgcgggacctggagcccctcagcctttgtttctgcctctgaataatggggcgattctacttatgtcctagggctgtcgtgagtgagtaaaggacttggaacagtactcagcatatactaagtgttcaacaaattttggttcctccctaccgtaaaacatggatctagggaacagccctgcccctgaaacaggcctctaaagactagtagctgtttatatttggaattaatgtgctcaattttggggaccaaacgttaggaaaattaatgaaaaggtagaatgtagatagacaagcctgaccagaatggtgagaatggaggtcttgatctgtcataggtaaaaaatgaaaaaaagtctcagatgtttagcctggagattttctcttttttaatggggggagaggcaagagacagtccgacaactgtctacaaacactgtataagatggactcttataattcacaagacagaatcatgaccaatgctggcaaattccaagagagcaggttttgacttcatttgaaaagcaactttctgataattagagcaaatctacagtggaatggactgctgttcaaaaccccttctcatctgcaagtgtgcaaagagagaagagatgacctccttcccatcctttaattttcctgctgtcctttctccatattctcttccttgatcctgcttctgttccctatagaaccttcgtactctttttgccctgccttgtgctaaggtatttttttcttatttctccatcaatttctaaactctttttctctttcctgttccccgcccctaccccctcagcaaacacagcacaatgactggaactgcctccctgagttgcaggtggtccatggctcagaatgtcactgagatctgggccaacagtgctgtgcaaactggcagagaggggaagggaagcaaatagatctttgcagaaggcggaggtactgctgtgcctctcccatccgggtgaagggacccagcagagtctcctgaaccccaggcagggagaagtccacttgtaactgagcccgcacagatggacagatggggatcccagagctgagcagttttcctcagagatgcttcctgtgagctgaactcatctgagtccccttctgcctccccctggcatttcccttatttttgagatgtggtagccgttttgccatatttccaatatcaagaaccccctttcataccaaaggaagcagagaactgtgacaactggccacctgcctccactctccacttggcatatgtctatgtggatgcatctgacaccagtgacatgcaggtaggccccagtgtctggctctagaactttcacctcttctgtctccaccc

SEQ ID NO: 228 - DNA, 4584 bp, Homo sapiens
tgctcatatttcatgttaaagatccataataccaccacagaataggaattctttgtgcttaattatatagtatggaaaagtcaaaacagacacgtttgagaaaaggtggtttagggccaggcatggcggctcacacctgtaatctcagcactttggaagaccgaggcgggtggatcaccaggtcaagagttgaagaccagcctggccaacatggtgaaaccctgtctctactaagaatacaaaaattatccaggcatggtggtgcgtgcctgtaatcccagctactcaggaggctgaggcaggagaactgcttgaacccagggggtggaggctgcagtgagctgagatctcgccacccccctccagcctgggcgacagagcaagactctatcttggggggggagggggggaaagaaaagatggtttatgactagttcataatgggtcttggtccactcaagctcatgtttttgttgttgttgttgttgttgtttttttttttagatggagtctcactctgtcacccaggctggaacgcagtggtgcgacctatgctcactgcaacctctgcctctcaggttcaagcgattctcctgccttggcctcctgagtagctgggattacaggcacgtaccaccatacccggctaatttttgtatttttagtagggactgggtttcaccatgttggccaggctggtctcgaactcctgatctcaggtggtccacctgcctcagcctcgcaaagtgctgggattacaggcatgagccaccgcgcccagcctcaagctcatgttcttactggtggttctaatgctaactaaaccaggataaacctttaatgaacaagagttgactatgactcatgtctttagtactcagtcctccataattcagctacataataaacttctgagctgagcaggggccatctaagagaaaggaccaatgaagttttttttgtttgtttgagacacagttataccagtaagttagaaagtttccattaagtgcctatattcacttgaaaaaaaatttttaaacagctttggcttttctgtagagatggaaacatttcctttcttttagaattagtctttccaattgcaaaggtgtctgagaacttgagagcttgtctggaggttctagcaggggagggcagctactcgtatgcccttgactgagggacggccctcctctacgggatggtcgtcctctttgacccagctgctggttcaggagggacgcacatggagcagtgaaggaggaaggggacacctgcgtagccagccagatcagcggaatcaactctgccgatcaatggggtgacaggtgttgcagccagatggccctcacatccatgtttgagaacgtagaaaaaacccctttccctcacaatctatgaataactaggaggactgagttgatgattcaatcaaattaagtttctgtgcttttaaattttaaatatttaactctgcctttacacaattacattttctctgcttttatgttttgcatatgctaagaaacatctattttatttaaaatgaattactaacatagattactatgaaagctaaaattttgttttttagatgatggctatttcctcccaattagagcctggtaaaaaatattccctgatgagtctaatgaactgcagattatacaattataggattggaaagtctggttcgatctcttgccaatgcttgaaaattttctataatatgcccacccaatgattttctggcatttgtttgaatacctccagcgacaaagaaactcactactctggaagcagtttgttcccaccttggacggctcattagtgattccttatataacgagcccaaaatctgtctttctattaatttctgcccagttatcctcgttctgttccttaaactcacagagaacaaggccaatcagatttgtctaacaggcagagacacgggcttagacctggcttagagactggtctctatcattgagtcaactgcgggcaagtcattgtccctctctaagcctcagcttcactggctgtgaaataaggatcctacgcctaccttagagtgctgctgtgaggactaatgagccagtgaaaggcagtgcgtgctagcttacgagaaaatgcttgagaatgctcctggtgtcatgaaggatgtcactcatgaccacagtcttctctcctccaggacaaagcccttctgttctttcaggtatttcttacataaaaaggctacaaattcgtaatcatcctaggccctctctgcccacatcttttaacatcaggtacctagttaatactaagcatcatctgtcaggtgtagtcatgtaagagatctggttggtaagatttttggttttctgtgtttgctttaaagacagtcacatctctgactgagagcataggtagaaagtattaattcccttgtttcagtttaatgaattcttccatggaattaatccattctcctcttaattctgggatcactcccacctcctgcctctttcgctgatagtcatcagaaaacagcccccctctgaccttgtcttttgtgggatccctctatccttgcttgacttccctgcctccatcccccactcctgtctcagatctatgcctattaatgttcactgcaagacagaagatcactcttgaggtcagagtctgtcttcatgccagatacattcgtgagcagatatggtcaccagctcaaaggctacagagccaatgcttaactctgggaagcaaaactttttggaatttgaggttgttttttaaaaaagatcttgttaagagagagaacacactaaaaaactcttgcaccacattagaaactaccactccccattgtaacccagggcagatcaaaggagagacagaatccaagggacagatgggagagtgttttatgaatatacaaaggttcacagctacttcgctttgcagtcatcttgtagaccaatagctcctcatctgctttagtaacaaaggagtttgggctattcctggaatgaccgaacacaatctcgccccctgccaagctcagcacactgagattaatttaatctgcttcccgctctcccagactgctttgcggcctttggggaaaagcagcttaacagtgaaacttgcagaaacctgccctgctggccctgaggccagataaaagagacaaagaaatactctgaatttggttccttactcaattcccttgaccagttcagaggctataagtgctgccgggcattcccacaggtctcaaatgcctgtatacagtcaggcacctgaaaccgaaaggtggaggcaggataaggccgatgggagaggctgggggaggggagtaaagctaggcttcggtgggggaagggggaggtaaaatcttggcctttagttgacgctgaccacaaagggccaagtattccggtcagaatgaacagagcagcatgttccacggagtcttgcctaacatatgtctcaacttctaggctgtttctcatttctggtctcattcacaggctctggtacaaacagcccttacaggggtgggagaaaacaggaaggactactcagctcctgtttgtgaaattatctgctttgggactggtcacgtctcctaagcagagcagacttctctaggcagggggctaccactcactcagtcacctcgagatcttcaggggctaaccccatgtccaaaatatgacaggtgcttaatgaccactaaactggaatgtgtggcatccatgatctcagtcttcactgtctacatatagaatacagggctgcctagtgccaagataagcaatttggcactagctgagatttacaagttgctttctgaagctatgatgttttgagagcagctaggctggtggtacctgcctaccggagcggcatttctagatacctgattatgaagaataagagctattttttggcccatgtcttcctgttacagtggggatttcctcaacagaaaagaggtacaggtggacctctgaattccctgtcccctttgaaacatttttgccagacccaggcacttggcaaggcaggatgacctctagaggcagaggcagggaggctcctaggaccagtgggttgatgtccagagctgacgggctctccagcctgctgaggacagacgtcaggctggtgccagttatgcacaattgggccacttcagagccagtgctgatgttttgttttgttatactggaatacagcttagtacaggttaagtatcccttatccaaaatgcctgggaccagaagtgtttttaattttggattttttcaggttttagaatatttgcattatacttactggttgagcatcccaaatccaaaaatctgaaacgctccaatgagcatttcctttgagtatcacgtaggtgctcaaaaagtttgggattttggagcattttggatctgggatgctcaatctgtactaacatctgcaacaggtatttcagatggcctagcactcattctatctgaccctaagatagcctgaagacatggcttcaaaggcaatggagaccaaacggagcttttccttctaccccctcac

SEQ ID NO: 229 - DNA, 6985 bp, Homo sapiens
caaatttatgaactagtcttaagataaatgggaaaattgtatttcaaaagtgagacagtgataaagctaaggacaagaaaaaaatgttaactttgtatcctgtaaccttgctgtaattgcttattatagttccaggagtttttcggtcaattctttttggattgtctacatagatgatcatgtcatctgcaaacaaagacagttttatttcctcctttccaacctgtatacttttttttcccaatcttattgtgttagctaggatttccagtacaatgttgaaaagcagtggtaggaggggacatccttgccttgttcctgatcttagtgggaaagctttattgttttttaccattaagtatgatgttagttgtagattttttaaaaatcaaggtgagaaatttcctgtctattcctagtttgcagagagtttttgtatttaaaatcattaatgggtgttagattttgtcaaatgccttttccacattcattgatatgtggaaaaatcatatgatttttcttctttagcctgttaatgtgatggattacattaactgattttcaaatgttgaatcagctttacatagctgggacaaatcccacttggttgtgatgtgtaattctttttatatattcttgaattcaatttgctaatactttcgttgagaattttcacatctatgttcatgagagatattggtctgtagttttcttgtaatgtctttgtctggttttggtattagagtaatgctggtctcataaaatgagttagtaagtctttcacttgcttctatcttctgaaagacattatagataattgtgtaatattttccttaaatttttggtagaattcagtgaacctatctgtgcctggtgctatatgttttggaatgttgttaattgttgattgaatttctttgatagatataggcccattaagactgcctatttatcttatgtaagctttggaagattgtgtctttcaaggagttcgtccattttatctaggttgtcaaataggtgagcatagattgttcatcatgctccttgattatccttttaatgtctgtgagatccgtagtgatgatgtcccctctttcatttctgatattagtaattcgtgtccttctgttttttcttagttaacctggcttgaggcttattgattttattgatctaaagaaaacctatcagctttcggtttaatgattttctccattgtttttctatttttaattttattgatttctgcactggtttttattatttcatttttttctgcttactttgaatttaatttgctgtgctttttctagtttcctagagtgaaagcctagatgattgactgaaggtcttctttttttctttttttttttttttttgagatggagtttcgctctttttgcccaggctggagtgcaatggcgtgatctcggctcactgcaacctctgcctcctgggttcaagtgattctcctgcctcagcctccagagtagctgggattacaggcatgcaccaccacactcggctaattttgtatttttagtagagacagggtttctccatgttggtcaggctggtctcgaactcccgacctccggtgatccacccgcctcggcctccgaaagtgctgggattacaggcgtgagccaccgcgcctgggcctaggtctttctttttttctaatgtatgcattttatatatatttccatctaattattgcttttgctgcatcccccaaattttgaaacattgtattttcattgagttcaaaatagttttaaatttctcttgcaagttattctttgacctatgtattatttagaacttcgttgtttaatttccaagtattttggaattttccagctatctttcttttttcttttttaaaaaattgagatgaggtttcaccatgtttcccaggctggtctcggactcctgaacgcaggccatccacctgatttcagccttacaaagtgctgggattacaggtgtgagccaccacgcctggcaggaattttccagctatctttctgtttctgatttctagttgtaactccactgtggtctgaaagcagacactgtatgatttctattcatttacatctgtgaaggtatgttttagggtccagaatatggccaatttggtaagtgtttcctgttagcttgagaagaatgtatggtgttgaatgaagtaatttataaatgtcaattatatccagttgattgatggtgctattgagttcagctatttccttactgattttctgcaggctgtatctgcccattctgattgaggagtgttaatgttttcaattttaatactggattaatcttttgccttgaagttctatctgtttttgcttcacatattttgatactctgttgttaggcacacacacattaagcattggtatgttttcttggagtattgatcccttaaccatttggtaatgcttctctttattcttgacaactgtctttgctctgaaattaatgtagctactcttctttctttcgattattattagcatggtatatctttctttatctctttcaatctgtatgtgcctttatatttaaagtgggtttcttttaaacaacatatagccaggttttgtttttttagatcattctggcaatctgtcttttcattgatgtatttagatcattgatttattttttatttatttatttttttgagacggagttttgctcttgttgcctaggctggagtgcaatggcgcgatctcggctcaccgcaacctctgcctcctaggttcaagcgattctctagcctcagcctcctgagtagctgggattacaggcatgtgccaccatgcctggctaattttttgtatttttagtagagacggggtttcttcatggtggtcaggcgtgtctctaactcccaacctcaggtgatctgccctccttggcctcccaaagtgctgggattacaggtgtgagccattgcgcccagccagatcattgatgtttaaagaaattattggtatttggattaatatctaccttatttaatactgttttttatttgttgctcttattctttgtttctatttttgccttccacactttttcaaccttttatattttttattgagcaatctgtatgattgtatttttctgtcctttcttagcacatcagttctacttctttttaaacatttttcagtgattgtcttagagtttgtaatattcatttataactaatctaagtacactttcaaataacactatacggcttcaggtagtacaagtactatataataacaaaatatttctactctctcatcttttgtatcattgctgtgatttattttacttacatgcttatatatatgtgtgtgtgtgtgtgtgtgtgtctgtgtgtaattaaatgcattgttgctaatatccttttaaacagtcatctgttagatcaattacgaataaaaaaataaaagtttttattttaccctttacgtattcattctcaaatgctcttcctttctttatataaatccaagtttctgagctatatcattttcattctctttgaagaacttttaaaaatattacttgcaggtcaggcttactgacaacaaattctctcaatttttgcctgtctgaggaagtatttctctttcacttctgaacgttaatttcacagggtgtggaattctaggttgatgagtttttttctatcaacactttaaattttttcttccactctcttcttgcttgcattgtttttgagaaatcatgtgtaatttttatctttacttctgtgttcataaggtgtttaatgatttatttttaatttaatttaatttaattttttaagagatagtgtctccctatattgcccaggcttgtctggaactcctggcctcaagcaattctaccacctcagcctcccaaagtgttcagattacaggcatgagccatgagccaccacacctggctgcgattttttctttatgtttaattttttgaaatttgaatatctatgcctaagcatagttttttttgttttctttttgttttgcatttatcttgcttggtgttctctgagcttcctagatctgtggattggtgtctaacattaatttgggggaaattttcactcattattgcttcaaatattgcttctgctcttttctctttttcctctcctgggatttccattacatatgtttacaccctttgtagttgtcccccagcttttggatattctgttatgagtttttattttcagtctgttttctttttgcttttggtattggactttcttttctttttttttttttttgagatggagtctcactctgtcgccaggctggagtgcagtggcagtggtgcaatcttggctcactgcaacctccgcctcccgggttcaagtgattctcctgcctcagtctcccaagtagctgggattacaggcatgtgccaccatgcccggctaattttttgtatttttagtagagatggggtttcaccatgttggccaggatggtctcaatctcatgacctcgtgatccacctgccttggcctcccaaagtgctgggattacatggacatttttattgttatgtccccaagcttggagattctttcttcatcatgtccagtctactaatgggttcatcaaaggcattctttgtttctcttacactatatttttttgtaatctctgtgatttcttttttgcttttagaattttcatgtttctgtttacattatatacctgttcttgcatgctatctactttttccattaaagtccttagcatagtccatagtccatagaagcattaaatttctggtctggtaattctagcgtttctaccatatgcgattctgtccagatatgcttgttcagtctcttcagatctttaaactgtgttttttgtcttttagtttgccttataatttttggttaaaaggtacacatgatgtactgggtaaaaagaactgcagtaaataggcctttagtaatgtagtggtaaggtgtaggaagaaggggaagtgtattagttcattttcatactgctatgaagaaatacctgagactgcgtaatttataaataaaaagaggtttaatgcactcacaattccacatggctggggaggcctcacaatcatggcagaaggtgaaggagaaacaaaggcacatcttacatggcagcaggcaagagagaagtggcgagaaaaagggggaaaaaccccttataaaatcatcagatctcatgagaactcactcactgtcatgagaacagcagcatgggggtaaccacccctatgattcaagtacctctcaccgggtccctcttatgacgtagggattatgggagctacaattcaaggtgagatttgggtggggacacagccaaaccatatcagggagcattctgtggtcttatgagtaggtctcagtcttttggtgagcttatgcccctgaattgtgaacttcatcactgtttctctgtccctatctctctccatctccccactcccactcccacactttacatgggaaggaatgacttagaaggggttggaattgggtatttcttttcttccatgtggaaagctagagggagctgggttggctatttccctttccccagcttgatcaggctctgatcaaaccccagtaggctctggtaaaatagtttcttctgaggccaggctttcttaagaacagaatgctctggcacatttcaaaattggttttattttgtgtccccctgctggaatcataagggaatttttctctgatatttgctgtcaggtagagctcctggatgtaaaacgcataaaagtgtggaagcccccatatgactgggtctctctggagttttaaacttacagttgtcttcactgagcctctagcaatccattaattacagttcaggttttcctatcctagcacttgttcctgtggaggtttttgcctgggagtttatgttctgataagttgtgattctcagtatctgcctgtctctctgatatttggggcagtggtttgtcctataactctacttttctgatggttctaagaagagttgttgatttttcagtctgttccagtttttacgtgatgttaggatggagtagcaacttccaagctccttacatgctgaaccagtttattcctttttaatgctgaataatattccatcgtatggatatactacaatttgtttattcatctgttggtggacatttgaattgtttctagtgttgggctatcgtattagtccattttcatacttctgtaagaactgcccaagactggtaatttataaaggaaagaggtttaattgactctcagttctgcatggctggggagacttcaggaaatttatgattatggcagaagaggaaggggaagcaaggtaccttcttcacaaggtggctggaaggagaagtgctgagtgaaggaggaagagccccttataaaaccatcagatcttgtgagaattcacccactatcatgagaacagcatgggcaaaactgcccccatgattcagttacctccacctggtctctcccttgacatgtagaaattatggggattacaattcaagatgagatttgggtggagacacaaagcctaaccatattatgaaaaaagccactctgaacattcatgtttaagtctttgtgtgaacatatgttccacttttcttgcatgtatacccaatagtggaattgctaagttttatgataaataaatttcaactttctaagaactgccaaactgttttccacagtgatttaccattgtacattcccactagcaatttatgagcattccagttgctccacatccttgccaacacttggtattgtcagtgaaaggaagcatttactatatcaatttagaaagactagtttcttctaagcttgccatttgacagaaagggaatgaagagtggatgggactctgtagtttcttcatttggatagctaatg

SEQ ID NO: 230 - DNA, 485173 bp, Homo sapiens
aaggttacaggctctttccttttatctcacttctaaaagacttctttggaatagcgtgtatacttttgttttgcattttaatagtttttacctttaagatctcaactttaacatcttaaaactttttttctttttaattgtagatttttggaataatcacagctatcttaaaacttttatgctcctaagcccttagaagtgagggcttgatacttgtagaagcataaataaggccagatgatgcctttgcagaggcaaatctgaacctagtagttgggaggtccattactgcgtctgcttctgaaaccccaatagagcactagcaacaggtagctattgcatgcctgttgggtgccaggcactaaagagttgggtgccagctctaaagagtagtgagcaaaaagaaaacatcctggtatgctggagtttattttctaatggacaattaacacaacaacaaaatgaactacacagtatatcagaaggtattaaaagccatagagaaaaataaaggagggaaggggctgatgttacagttggtttgtattttaaatagggcagtctgggaaggcctcactgataaagtgatacctgagcaaagacctgaggagctgagagagtgagcccttggcacaggtgtgggaggaggcagcagcaggcacagattcagaggcaggaggatgcccagtgtgtgggtggagcagggaggaggctggtgaggctggaaagggagtaagggctgaggaattgtaggaggcgtgggaggaggtctctgcagatcattcagggccttgtgagacacgtaagactttcgccttttctcagagtgagatgggagtcatgggagggtttctccctttttcttttttcttcttcttcttcttcctttttttgttttttgttttttgtttttgagagacagcgtcttgctatgtgttgcccaggctaggcttgaactcctgggctcaggagatcctcttgctgcagcctcttgagtagctgggattgcagacatgtgccaccatgcttggctttttatgggagggttttgagtggagcagtgacatgatctgatctacctaaagcagaattgctctggctactgggcagaagctggggaccatttaggtggctgttgtattgatttaggttacacttgatttacactatccaagatagtgtagttggagccagggtggaagcaatggaagtgatgagaagtgtttggattcaggatatattagaagggcagagcaaaaaggatttcctgatgggttgggtggagaagagttagtatgtctgcaagatttgagcctcagcaactggatcgtgtgctctgccacacactcctttttatccatggcccttattggtgtccaagttattatcaagcagtcactctgatcccaattgagaaactgtagacactctggtagccaggagaaatacttctgtggtcttctgagccattgctcagaagatgctaccaggttagttaatgagagagaacttggctcaccagtataagttacttagtctttcttgacaccttctcattacacatttggcatcacattctggggaggaactgtgatagatgttggtgccatccaaacctgcacctcagctctgagtctgaagaatgcaggaaaagagcagaagagtaggaggagctaaagcaaagataaagaatagagagatctggaaacttgtagtacaaaccactttgaaaaaaagactatcaggagcagtaaaatgtgtatctttccctggtgttttccctttttatatctacctttcatagcttccagttgaaagataaaaagatgtgatatttccacaataactggagtgggaattaatggactaacatggaatgtaacaaaaacaaagattaagtcccacatttagtaattgagagatggcaagagaagagtttatggatccttctagtcagatacatagaagatacactggctttccaagatcccactcttgcttgcacccaccgtaatctctcctacttaaataaaccaccaagcctgctgtgagagagtacgaggacatagtttgctacgatgttggccaagtatagagctgaaaaatctcaccctgtttatttattaggaatcttgttttccatccttgccttgctcatgtggggctgagtaaatcttaatctgagttcttatctcaggaagagcaaagggtagccctggaagccttctaaatagcaggtgcaggacagaatgaagaggaaaagagagggtggagaccagtggaaaatatctttgagaggccaagaaatccataaggctgatgagctagagaaaggagcaggtggatgggtgagctggtgcctaagggcgcaaactggaacctaccgggatgggatgatagggacaccagatggactggcgttgggtcaaaccagatggtgggcttttatttttaaaaggatttgtaagtcctaggaacaaggaaccataagggtactgggcctttaatcccattagtagaaaacaaaagtgtgctctttaaaaatgtaaactcatcaattatagaatttatcaaaactttgggacagactactcacttgtgaaaccccaaggaatctctggattctgtattgatggaaggagaaactgaagaaatagtctaggcattataagttaattaaagactcctccttaataatttaaagtgcgtttactaagtttacattccaaaccaaacaaaatatgatatatttgtatgaaataggctggctcacatgtggagttgggagaacagctagcagtgtaagtagggactgatgaattattgagtaaattttgagttggtaatgagaaaatttttaaaatttaagcatctattgctttcccaaaaatcagacccctgcaccccacctccccagttgctgtgtctagcgcaacctggcctcagtatagctacagctgctctcatggttgctaagacatgagagcttctactgtagtccttgtctctatcccagccttaattttagggtccagagctatttccataatccctctacaacggacttattttcaaggagaccagactcttaagtgtagcctggagccatcagtttgtgctcccatgtggcatgagtgtggatgctgtgcctgcagagccatgtgtcccttgcatagacatgcagaggggttggacgggagggtttggtgtgctacagagttcatgaggaatctgccttcttcgtattatgtaatagccgattctcctgctgataggaacactctaatctaaaaaagtcaataaatgttaagtgttaatattaagagaaagttttaagtagtgtgattagttgttaaatgacttttctgtttagaatatgcagatatatccattaagtaactatcaataatactgcatcattttcaatgctatttcatagatatatctttccttaattacttctgaaaagtataactgtcactttgtagttgaagttgaatagagttgctttccaacaccactgactgtttttgcttgcttgttcattattatctctacaggtatggaaacctgacaagcccaaactgtgaagaagatggaagccaaagttcatcagagtccaaaatggtgatcaggaagtgagtctcccttttctttgcattctaagctctcagtcaagacaatatcttaaagtagtttagtagagtattttattcctttgaatgttgccatgatttttttttccatagtgcatacagaggcttattttttgattacctaacaatattcatttatgtatccagtgaaagtatcttaagtaaccactgtctgccaggcattgtgctaaggtatacaaaacaaacaagtgaagaaaacaaacgaacaaaataaacagtcccagctcataaaaagtgtgtattttaccagaaagagacaaagaatacacacaaaaaagtgaagaagaatgaagcagggtctgagggctggagcgtttggctatgtgtagggtgcccggattgggctgtctggtctgttggcattggagcacgccgaaatgaggtgtgccctgagccttgcaaatagccaggccgacagaccacgggaaagcctctgaggcaggagcggtgtttgagaatcagcagggaattgcatgtggccggagcgcgtgctaggggatgagcactgtgaggtgagcaggaaggtggccactcacaaggggactcatagcaacttggggaaagatgttgaatttgattctgaggaagataagaagcgcttagaaggttttgagaagagtgctgtggcctgacacatcttaaaagacccgctctggctctgtgtccggaaagtagcctgtggcagtgtggctggggacaagggtgggagcagggagcctggtcaggaccctcccaagagtccagatgagggctgcttgtggtgcgggctgaagcaatagcagtgaaggtgaccagcctttgcagagatcttccaggtgttggtggcaggacaagctggagtgcatgggctgtgtgagagaacaagaggaggccagatgcttcccagggttgcggtttgagcagcggagagacagaaccttggctttataaaataaggaagatcgagggagcaggtttaatggggagtgtgtatcagaaattcagtcacagacataattagctcagtctagatttcagggagaggcatggaatggaggtataaatttggatgtctttagtttatacatggtatttaaagctatgagactgaatgtggcttcctgggaactaagggcagatagaggagagaagatccagagactgagcctggttccttgggtgtttagagttagggaagtagagcgtctggcagaggagactggaacagagcagctttggggaaggatgggggaggagaaaaaagaagttgttgtgtccccagaagacaagcaaagaaaggatttcagggagggagtgaccaactccctccagtgctgccctagatcgagtgtgagggtctgaaaagtgactcctcctttgcagtgctgcggtctttggtgacttgacaagtgcagtttggtggatggaaaggtgggcaagagagaatgaaggggatgaagtggggacagtgagtcttgttagaggaggagctttgctgcaaaggggaatagagaaatggatggaagatgggttttttttttggttgtatatgtgttttttaaaagatggaagatattttatgctgatgagaatgtcctatgagaaaacatccatgatgcgggggtgggggccattgtaggggtgatgttcctgagtagatggaatgtgcacctgggtgcctgaaaccactagtgttaaatattcattttggggccaaaagtctggggggaatcctgtggaatttttaactcctcagaagagttactgatagactcctttcttcaggagctagggatgtgaaagtagaaagctgagtatcttttttaactcctgagttaggttccatgtagttttacagttttgttcagtggatcataactttccagaaaaccagacataccagtgtaggtatttgaatgtcaagcacaaggtacagtgggaggaacaattcttttgtttttagaagggcttggggaaggcctcttggaggaggttacctttgatctgggccctgaagcatggtgaagattttgttggtagagccgtctgggtataggaaacagtgggaccaaattgggcaaatgcaattttcatggaattttggggaacaacacagaattggtgtggctgcttcatagagtacatgttaggtgagaggggagtcagtggagctgaagctagattggacttacttcatgaagggcattaatttcttgcaggagagtttggactttccctggtaagcagtgggcagtcagcagtaatgaatttttataggagggaaacaatataatctaaaaggtgatttttcagaatgggttagacatagagccttctcgctcaaagtgtgaccgtggacctatagcatcagcatctcctgggtgggagcttgtgagaaatgcagactctcaggccccactcagacctaatggattagaatctgcattttaacaagattctcaagtgattcctaagcactttagagttttgagaatcataggagtctatgaaaactcactaagataatgatttttttagaagaacctttttataatggacattttggagcatatacaaaaggagagatactgtaagaattgagtgtaatctagacttgtgagcagattcagaaatagacatgttattatacacatattttggaactcagtccaatctagagctgccattcaattagccacctgaacactctgaggagagtcacaatcaaaaatatccagagctggccgggcgtggtggctcatgcctgtaatcccaacactttgggaagcccaggagggaagatcacttaaggcaggagctcaaaaccagcctgggcaacgtagtgggactctgtctctacaaaaatttttttaaaaaattgctggatgtggtggcacatgcctgtagtcccagttacttgggaggctgaggcaggaggattgcttgagcctgggaggttgaggctgctgtgagccatgatcgtgccactgcactccagcctgggcaacagagtgagtgagaccttgtcttaaaagtaaataataataataaaaaaatccagagcttctctgtcccatgaggtgttttgagataaaatagattttttgggaagtagcagttaagaaaattgcaccctgggtatgaagagtcatgttcattcttttaaagtctcattcgaattcgttgtatactaggaacactaatgtgaatgaaactccaagctaagctgttttaaagagttttagagttttaagcatatgagggcttaacaaagagcttcacacagaactcccctgaggggtccatcctctggggacaatggtcctttcctaaagtctcacaataacttggtggaaagttcttgacccttttgctcagactgagttgccttttaaaaaattatgcctgatgaaaatatgccactttatcttataatgggtcgctctgtcctacagattctggaatgttaaaatcccttcttactggtgacctctttcttccttccatttccctttcttctgtctttctcactgttttttccccacatcttttattgtttttcatctcacttcactattattttttggctctctttttctgaaactatgcttctcctgatcatttctgtgcctagatagggtcactgctttgtctttgtctttgtgagaggaaatcagggaagcatcttctcccatctgtatgtaatgtattgcaaatttcctggtcatcccagacctctggcatctgacttgcagcaatgattgagggcttcctgatgatcaatagatgtgtaggaggtatggcagtggttctcaacagggcgattgttatcctccagaggacatttgccaatgccctacagacattttggttgtctcaacttggtggggggaggctattggcaactcatgggtagaggccagggatgctgctaaacgtcctagcatgtgaaagtttcttgtattggttcgaaccctaaaagcatgccaacagacaacacaaagcggtgtggagcaacacactgttttaatgagtgcctgggtgcaggcgggctgagacctaaaatgacatcagccccaagtgaggacgggacaggggctttgtagtcctctgtaaacaggaagtgtcccagtctgacgtgactgctacgtagtacctggacggcctctttctcggtcttcaggggtatgtgtcttccggccagggtaggtgtcttccggccagggtagttgtcttccggccagggtaggtgtcttccggccagggtagttgtcttccggccagggtaggtgtcttccggccagggtagttgtcttccggccagggtaggtgtcttccggccagggtagttgtcttccggccagggtaggtgtcttccggccagggtaggtgtcttccggccagggtaggtgtcttctggcccgctgtcttcctgcttctgctatcttgctgacgcgtgctgctggcgcaagtggccttgagctttgggactgggcctgagaagggaggagttactcatcccttcaagctttcgggcccgggggagaatctttcagcatgcacaaagtaactctcctctaccccaacaaggaatgatctgaccttaaatgtcaatagtgcctaagaagccctgctatgtagtattgaggctctagttctcaagtgaaactgtctttatgaatacctaacatacataaaaataggagcaggcctatttggaaatttctctatttgtgtctctttttataagtagctgaatcaaatgtggaagtgattcagaggcagccacatggagagggaaaggccctggtgaaggagcctggagaactcggatcctgctccttctctatcactctgtcacttaccagtcatctgaccttggcttagtcccttcacctccctttgtttcagtttcttcacctgaaaaatgagtgcttggagtaaatgctcgctgaggtccttttaagttcagtgatgtctaagataaaatttatttagctttttctttctctcaaaaaatgaataacagaaacagagatatggtccacacagcatagtggacttttgagagtacggtaccttcgaccacttttctctgttggaaagtgtgttaccagttttgaagagacaggaagaaacacatacacaagctttgtttgttattagtcatgacatcacagctgctcactggggtcatgaataaagagctgagctaaagcattgtcttgtgggagtaaggcaaggagtggcaaaatgcccattgttttcttttgctatgaatctgttctcttgtgatttcaggtggaaaaccgacagcaggaatccaatgacattcaggaagtaaacatcctgtttagggcagttgccttcagttttgcagacctgggtggaggaggggatggggacagggactcactattggatttaaccatgaacagaaaaatgcccaaatattgtttgttttcccgttttagctgtaaagcaaagagcaacccttacattttatacaggctcccaagtaccaagtaaaatctttcctgtatttccaaatatggatttaaacctttcagagggtaaaagaactttaaagaaggaaaatgtggaaatacagatgaagcattcaagatgaaaaattggtttctgatgtcttggaccacaaccgactagtgttcttcatgcatttaaaaaagtatcagattgtgcagggactcccacatgcggagtacttgtaattccagtccagagttcaggctttgcacaatgtcaggaccctctaaagttatctggctaagacaagaatgtgttcagttgcaaaggattcaacttccaaggcttctggatgttggaatctttgcctcacggtgatttctgatggtagggctagactgattatataaggtgtgccacatttatttctaggattcctaaattggccactatttatcaattaggaaactcactttctatgacagaagaaaacatttctgcctatattcattctacccgtgcccttttcctgctgacatttttacacgataaaatgctatctttttaaataataaaatctgaaccagatggaaaaagtgaattgtctctagggcagatttattatagtcattgaattcagaaatgaagagaatgtaaagaagggatattaaccatatagagcttttacaacacgaatcttcattctctgaattttatatgagatggccatatctccctctctctatatataactttatttaaagagatttaaaactcctcaagaaatgatgctttatttctttcctttaatgactattataaggttgaaattgtttctgttttcttttctttaattgaatctcatcagtttccttctggagtgccaagttttgttttctcaaactctctaccatagtactacttcaaattgttgaaatcgttctgctttcatttccacatattcagaagatacgtatattgttcttgtaatcttttcccagaagttgtaaacagtgacaccagatttcagtcactggtaaaggatcatgtaaatagtagtaatccaagacatcggatacactttaaagagaaaggaaaggagttaaaggaagttggctgtgttacattactgcctcagaaacttcacagtggaaagttaaaaaatcttcccagagagtttgcaatcaatattcattcctgcaaattcagatgccctaagaaggcaattgaaattaattggagtgattataacaaaaatggggaaaaggaggaggggtgaagaacagcaaaaacaagatttaaaactccaatttagaagaattaaaagttataatgtgaaaggaattttttttaaagtgaaacaaaagaaatgaagaagtgatatgccatatcgaagagtctggtattgtctttaaaatatccctacaggacaaagaagaataaaaaccatagttttacaagtcattagcattctaagtcaagtctgcattttagggacatgggtagaaagccctgagcagaaactgatgttctaatagttgaggaagaataaaacaacattgataatcaatggctcaaaaagaagacagatcaatcatacgagtatctcctagggttttctacattaaagaatgtctcttttagaaaggaaaacagacatcacaattagactgtattgtttgattccctgcacagcattgtaaacaaagaaaatgatgacactgcccttgccaccaccattggctacaatttgtggtatgcttacaaggcattctgctaagtactttatatttgtgtcttcttcaaccatcacaaatatgctgagatattgtcctcactttataggatataaagtgaagcttcagagaagttatgtgttttgactaagatcaggcaggtggttaagtgacaggtctgatatttgaactcccgtccaactgactccaagacctgggtgggaagcccaggcatgccatttatagaagagcattgggatctcggatactcaagatttttctccgcatttgcctatatcaccataataagactgcggaagtacatgaagaactagattacaatatcattgttgtgactaatgttttagattgttattattctgagatcttttgtcattatttccattgctctatgctgttttgcctggctgttgctttattattgaatgaacaccctgagcaaggttcgcacacagctgttagaaatgtggaagctagacctttttcctggggaaggagatgggttgaagaatgtgaggaaacaagaccaaattaggcccatcaaaggagaacctgcttcctgttccttgtgcctcgtagcatctgtcactaccaacggaaactcagttctagtggtgaaaactatagaaggccttagccatttttttcaatagagttctatttataacatgaaaactcccttcttggactgtggggaatgagttattgaggtccttgaaagataattttggtgactggcgatgtccttttctaataatagctagaatttattgactacttagtaggaatggtccctgtgttaagtactgtacatacttgttaaatcctcataatgattatgttttattattcttattttacagaggaggaacctggggcgtaggttaaggaacatgtccaaggctacacagtgaataaatgaaagagctgggatttaaccgaggccttaacctctgtgctgcatgacctttactatttttcctctgataaaaatgaaaatatttctcttaagtacttagcttgggaatgaaagacaggtgtgtaaataaccttgactttgggtaattggcttcaggcttatccatcctactccgggccctctcccactcacatttactgtctttctgtatgtcttcctttcataatctttttcttcctccttcttgccgtggaggtttttttttttctcttctctcccttccccatagtccctgcgttgcccttgccttcttagtgcttaaatctgactctggctttgttggcattatttccctggtcttttctcaatctctctttcacgtctcctcctagtatttgaatccctgtttaccaacagcactgaaatgtgacaatgtaaagtgtaaaaaagcaacgcaggacaaccttgacaagtccagataataatattttcatcctttccaggaaaaaaacaaagaggaaagctttgtatctttctttgttccttctcatcaggaaaatcatctagctggaggtctcagaggcagcttctatctggcaaccttccctgaaacagagcaaaactgttctatgattaggagaacaaggtggagggtccggcccagagtcagggtcaaggttgacttaggcttcagttcttgaaggacaaagtgtattagatcctgccctcagagcttggcagaagttacttcattgcttgaaaggcccaccgtctgcgtaaatcttcttaccttttcattatctgcagcgaagacaagatccagttctcagagaatgtattaaaatagaaaaacattttgctgcttttgaaaaatggttccatgtcttattttctgctgatgattaagtacaaaaaattattatttcaaatagattgctggggagagaaaagaactctagatggatagtgttattctttttgtcacggtaatcctatttcttggctcagaagttacacatcatgggagaggtgacttcatacctgaaaaaatttgtattaaacatttgaccaattatagagtattttactgcctatggaatgttaatatgatttaatacgtttacctaaaatctgcattcattaaaaagtctgtgatttgcgcataatcgctgcctaaatgcttgcctcagccctctctgcattgcgtgcctgaagatcgtggggtggctagaagttctgaaccattttcttttatctctcagccaaggtgcatctgtctaatgtcttctaagcaggtgttattaggtgtgatttctggttggctgagaaatcaatgagtggccagctgcggtggctcatgcctgtaatcctagcactttgggaggccaaggcaggtggatcacctgaggtcaggagtttgaaaccagcctggccaacatggtgaaacctggtctctactaaaaagaaaaaaaaaattagccaggcatggtggcacgtgcctgtaatcccagctactcgggaggctgaggcaggagaatcgcttgaacctgggaggcgaagattgcagtgagccgagattgcgccactgcactccagcctgggcgacagctctgtctcaaaaaaaaaaaaaaaaaaaaatcaatgagtatagcagatttcatcatgctcctttcccccaactctttatattttttagtttaacagatctttaagtcctctacaagtgtttagctctttcaccgcagaacctctgcctcattgctgccccagaatcctcatcccactgactcctaaccctcaagatctcagctttcacatcatttcctcagggagatcctccctaaagccttgaccaggtcagctccctctgaagttcagtgcttccctgggaccctggacttcctgtattgtgatgctcatcgcataaattgtttttgtgactctgggaaataaagggcactcaacaaatattagtttaattggtgaatgaatttcttagaagcaaaagtcctagaagctgctttagtatgtttcaaacagtgacatctgagcatgtcttccttcccctatagacgattgcagtcggttggaaaagaatcacacactacaaagttttgtatgttgccaagaatgcctgaggtagaaaactcaattttggttgtctcctctgctatcagttttgggcccctggccttggccacctacccggcatacttgcccttaggaccgaggagttttgttctgtgagccaccaaagattactttggaaaaggaagtcacatactggcttttctccagactgaatttaggttatgtcacaattgtaatcatccagtttggcttcaggaattacttctgcctttacaagttattcaagaatcatctcttgcagttaatactacagtttgatgtctttgatttgtcctagagaggatacctcaaggtatatgtatgtgggcacatatgtgtgtgtgtgtcttgtgtgtgtgttcacagcagccatcttcttccagcaggcctgaagtcacacatgtcatagcatggcttgtattctgtgtcattcttcctgtgagaggtggcagattctttgagtcaattcctgtgagtgctgatggattttcgctgagccattttaccttttcaatcccttccttctatgacttctggcaagtagttgtaagactgttgataattatgtttctctccaggtatctcaaaatgtccttattgacattatatcatttgaaatcacaactgatcagtgtcaggtagatgaagaaggtgttattatatctcttccccagagaggggggtcagtggagttaactgacctatccaggcttccttagttccccggtgggacagccaggatgaaagatagagttttctttctccaggtctccaagcgtcctgtcttggtctgtgtacagaaccaagtggcttctgtagtctaacagacataccagacctgtaaatttgtgacttcaaaccagaatttcccttcagctgtaagattctttacatccccccactctgttctggttaatatataagttagatcttaggactggagccaggctgggtaagaccgaaaagccattggccagtaatcctgtttttcttttcatcattattttgcgatgttgctttcttttttgaaatcttaaaagtttcgcatttgtatctgcttctaaatctatcaagaacggaaagtttcttcccaggactggcacacacaaagctactgtgagccttgggcatgtgtccaggcctttccagaaagcttccctgcctggtgtgctgagaaacgctctgccgatgaggagggcagggctctgcctcgtgttctattgtgctgtttgtgtatgtctttccctttctctgtttcttcgtcctcctcccccttcattcctcttttgtgtgaaaatgcttttttctggctgattgagtatctgagtttgtggtgaactttcaaagccttcttaggctaagctacaggaaggtcactgtcacaaagagtaaaaaaatgtatagatcgccagagttcattaaaaacatcagattgaggaacacaaaatgtccacctaagggcaagtctaatgtggacgaaggctcctctttagaactctcctagttcttctgaggctgcagctctccatagaggtaagtgctgtgtgcccatcagaaatacccacacgagcatgcagagatggaggcaaggatgcacatattttgtagttgtgacaacctgaaaataacttaaatacctgccttccagtagaagaatacttaattatggtgtgtccacatcatgagaaacaataagatagatctagaggtaatgatgaagtatctgtaatatactgctcagtaaaaaagcccatgttgattttctttctatctatctatctatctatctatctatctatctatctatctatctgtctatctttttttttggagatagggtctcgctctgttacccaggctggagtgcagtggtgtgatcacagctcactgcagcctctatctcttgggtacaatcaatccacccacctcagcctcctgagcagctgggactacaggcgtgtaccaccacacctggctaattttctgtattttttgtagagatggggtttcgccacgttgccctagctggtctcgaactcctgggctcaagcaataatcctgtctcagcctcccaaagtgctgggattacaggcgtgagccaccacacctggcacatattatgtatatttaaatatgtatacatatccacagaaaagcctagaaggatatattctaacagttaacaaaaggtcctgggaatgggattaggatgaagggagagagtaggtattttgcttttttagtttatgtacatttgtaagacttacttttttgcaataaataatgagttttatcataataattaaggatcacaggcatttaagaagtgaataatatattagcatcactgactcttacctgtaattttgtgtttccgtctgggtgttcttttcagtgaaacactgtcttgttgttaggctgctactgtttttgacttgagtatatgatatgaattatcacctctccatatctgtttttccatcagtgtcatcataagagtatcttttcactgaaatattaagaaacattaagcaagtatagtggtgttaattagattaattcatccctctttttaaaggtgcaaaactctttttctgtaaaagtcaagctgatgtaaatgcaaatatcaggttttcaattaatttctggctttctggaagaaagtgaaattattgtttatcatttcatttaatctggactaaatatttggagtattgaattatttctatgactttcatttgatggtttcatgtatctactttagatgcagataattgaatattatagttccaaatgctttaacgttccacattagtgaaacaatgatctacaccataatgaaaacagtaacacatttattttctttctgtttgtacttcaattccaaaagttaagcattaaattggctttagtcatacttatgctttgatgatagtccagcttcttggtgtgaaatcaagatgtgaagaaagttagacacacctgtgaaagcccagccttcactttcacatatgtgggtaataacttagtccagttatagtttgttaactaaaaaaacaatttctttgaagtataattaggtgataatgataattttaaaatgtgctaaaaaattctttttggctgaaaaattttggtaaagtgtttagttaagatgaggtgttgtgtctctgtcaataaaagatgcatggattaatgtatagtccctgtcatcttctccagccttcagcagtgactattccgggaccgtatggggtaactggttgctaggcaggcagagtgttctgttctgttctccttgtctgtggcatgtgattgagtcaggagtgttggtaaagtcttctttgaagatgaagcatagaataatagcatgcaaaacattttatcctttttatccttcagctatttgtctctagccttcagtgagtgggtgccccaacctaaagacaacatgctgtgttattactaacatactggagggagctgtgcacatacaaatgaccctgtctctttttgtgccctggaaccttgtcttcccctaggtggactctgtgacccacagagccatcagaagaaatcacctttgcttatcaagtttttgttctttatcttttaaagacataacttctctacctactgtttctgctacttgaaacatattcctctcattgtaatttgagaaacaaaaggataattttatgaggacattttcagtgttcatgctgaagccctggtgatccttgtcaacttgaatttatgcatttatctttccacactcaggcacttcctttcatcagatggatttctggcctaccggcagtcagttatttcctaacatattaggtggcagattttgtgggatttaatttgagcataatcttattgtgtacagattgctttgaagtttcttcaggactcactaaaccttctacacatcaatttttctgccctgtatgggtttttccaaagtttagcctccttaaaacaaacaaacaacaacaacaaaaaaccttatcagtttcactgcagcactccacttaaaacaataaagtttagtttgttttcaagtgctttaaatccattgatgtttctaggaacttttggatgaatgatctgttgaccacccacccaagtttccaggggtgcccctggggtccaccctggtgtccagggattgctttgcctccccacagccagttgggtgcagtgactctccatttgtctttctcagtgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacagtgagtacttgtttgttcccagggaaaaggctagattctgattctccagcctccacgctggagaaaggttctccctgtgctggctaataggaaaccttggtaccctcaaaacaacatgctgctggaggattggcttgagtataaaattctcaagattactgaagtactaattagagagcctagaattttagacagagaagggtattttcaagactacctaatctggctccctcattttatggatgaggaaactgtggaaactccagctcagaaaaattaagtaatttcctggggtttcttctgttaccaagaagagggtctccttgatgaactttaatcttcccttatcaacatgtaccatgctgaacctgaatttgcattttattacctgtttaatggctccttctagccttccatcacaaccactcccgtctagcagtcaaggaatgaagtctagttctgatcctgccctcccaaaagcttggaaaaggtgtttgtccttcagtatggaaaagcatcactgtaacgggtcccctgccagtgcagattgtcatcatttagcatctataagggcctcatcaaaggaagtttctgcagctgtttttccctatttgaagattaacttcctatttgcaaggacaaaggaaaggccaccactgcaggttatgaggtgcttggaactattaggctttgaagaaagtcagaaagaggctgggacaggcttccagtgtgatgttgtatcctctcactggggtgctgggtgacagtttccatggtggctgacccacttggagcttctgacaggcattaccctgaagggatgcctgacttcatcagtaagggaaaggaaatgttcctcagcaccaataaggaaagctgcatcagctccaaagaaaatagacctaaattccaaacaatacctgctgaatttcttatggatgggggtcccagagagagggaaatgcaattgcatcattggaagctgactgccaaatactctatatctcagatgacttcatctgccaggaatgtttgaataccaggggcactcctccagctgcggacctcagctcccttcagggcctccatgcctggctttgtgctggagtgggaaacgctgtgttggagcccagctctccccactggggctgcccctggctctgagcctaattggggaaccggtgggaccagtcattcattgtttccaacacagggactgcaaggcagagctcatttggcaggctgaggcaggggagagggagattgcctcagttcccatgtgcttgttttacccaattttactcctgcggaagaagcaagctctcctatatgtttttaaaaagtaaaatcgtgcttcatgttgttacttatctctggaggagaatcaaaagcagaaaacagtgaaggcatggactatgccccagagagaaaggatcatgtaatcttcatgcacagcaacattatagacacacattgggctgctgtgtttgctgaatgaatgaatggaaagatcaagccttagcacataccctgctccttgactgaagtgggttaggctctgcattgcagggcaaatgggatatatgtatgtatttgttgacaagacgagggagaggccgtttctgaacctttatttgggatcccaagtttctaattacacctctaaattaaacagtgccagagttgtatggaggaagaatgatgaaattagattgcttaacatcctccatgtcatggggttttagcttcctttagcttgtacctgtttgtgtcgcagactccggggataggcagtgatccccttctacgtttttcagtcataacccaaccccattggcatctggaacttcaagtccagggtaaaggggcaatcctcaaatcacatacctgccaccagtataggcagataaccacatgctgccctaaaggggaagtggtgtagggtccactctcggaagctccttttccctggaaaatgaaggaaagccactgtgacttaatccaagatgcccaatagtctttaattctacaaagaaagaaagaaaaggctcaaaatataagcattctgggggagtagtaacatgctgatttacatttctgctaagatataactgaatgtaactagagttttctttccttgagaacaggtttgacaggaaggagtgtgaggggtgtgaaggggctgaggttgggaaacaacccgagcactggggaaaggttccaggaaaggaaggctggggatttaagtcagaaaaccttcatcaaattccagtctttcaaaatggagactggaggtcctattccaggtgtgggctcttctgctttttattcggaatcctgggtactgattttctcttcttcatgctgtgccctatgtaatttgctaattgatgatcttggctgtgataggttcaggtgaatttagttgaagactgttctgcttcatgcattcttagctttgggtggaagttgaaagtgactctgaacattttgagaattttgagggcttcgtcagcatttctaacaccaaaatggctcattttattgcccaaagtcatacctgccttcatggcgagtccttccaggcttctggttataagtcgcccagcaaccaaaaattgcatggttggggtttaggagttagttggattagtcctggagctgatctgatcaaaaagtttgaaagagccctagacaaagggctctctctagactttgcctatcctggctctgtccttggcctaggagccagtgatttgtcagagtgagagcatgagggctctgatcttaatagagaatctaagaacaagcagagatgggaagatctccattgttctcagatgcattgtgcttgtggttgtctccctgtggctgttctggaggattggccctcttcttcctaaacaaggagtaaagtctgatgactctataagcaagattatatacactggcgccaaattactaatcttttccatatgtgaacagatgggcttcccaacacgatctccttcagcctggaagaggaagaggaactggagggtggagagtcagcagaattcacgtgcttctcagaagatctcgtggcagagcagctgacctacatggatgcagtatgtcttctctttgtgatcagatgtactttcacttaaaacataggggagtgatggcactggtgccccggtgacagcagtgggataatgtgattttaagtcttcttgaatccttgagacaggctgcgcctgcagatacagagttaagatgtgtcttgaatcaatcatctgaataattcaggcctgagctcttcttgcaactctaggagaaggtgcttttggagctcaagacacagagggaaataagaattcgaatccctgtgaaacaaaatctgccttgttctgtgggtatttttctccctttacactcataaatatttcaagatctgaactgtttatttggaggattgtaaagggatcaaagtataagttagaataaaataaattcacagaatccacatgtgattgtatctggcccctcatttccacgtgtgctttctgtacttttgaagtttgaatatttttgtgagctggacatatttgagtatgtcagtcagatttcataggtcggtgttagatggtaaatacaagaggactgtgaggagttatcgtggtggctttagctcttctgctttatcacttttgacaaggcagtgtggaacagggtggagattttccttctagtgaacattatcgatgagtatattaattatttacttttgtctgttgaaatggacaccatgagacaaatcaagtagaaaaggattatctggccattcacaaaaataccaatttacaaatgacccagatgacatgctttgccatatgaaatgtctgtgttgtccttaaagtcagttcctcttttgttccagcaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgtaattgtcttttataaaatattctttgtgtttggtagatgcaagagactgctccatcacttcgtttaaatggtttagctgtttggttgaaaaggcagtcaaaagaccatatatgagagcccactgggtttttgttgttcttccagagtaagaaaaaagttgcctttctaaacttggcagcttatttattttcctcttttttaaaaaattggacccctgctcacttcttcccagttatgggctctcacactgctacctctctagagtgagacattctgtctgctttcccctttgtattcacgacaagactgagtgttggtttcagcaccatgttcagtaaatataaatgtatggtctgcatgtcaaaacagactgcccttcaacccagagtgattacctatgccccctcccagtacctggaggcattacatcttctgcagttttgaagagctggtacttcttcagagtcctgaatctcttttctaaaggactgagacacttacagagatctcatattaatctgaggtcatgtctcatattaatctgaagttggaggggaggagtctgttcctaggcctgactcacattcttctgagtgttggagtctagtctcttggatgaactgcttacataccataggacctccccttctcagcatcttatctcatgactgagaaaatggcaacagtgtgcagtcagtgggccaccaaatattttgtgaacttctaatgtgtgtaaaccacaatattctgtacttaggggacatactaggatagagcataattatttgtttgcaggaacccgtacacaaacaaggaagctaagatatactggaattatctcagcctgagacagtagaggagtagggccatgggagataagcactgtaaaagtgggggagagagaaatcatttctgatgggatgatcaaggaaggtttcatggatgaattgacatttgaaattaactttgagtaacagataggatttttggtatttgaagattagagaggtttttttttttctaggcaaaagaaattacatcagcaaaataatgattttgaaaaattattaatatgaaaatatcatattaatttgtgttctgggctctatgggtaaactctcaaccaaaacacattttgctttatgtccccttaaatatatttttccttgagcccctattgatagggcataatgttacattctcttttgctgtctttgattaaagagcagagacacaattgtgccagataatttgccttgagtcttcaggtggtctgttattacagacttcttagtgtattatgaaagtcagcaagaaacaaagagtgtaagttgcataaacaacttctatttctcctattctaaatcgagcttattgctcagcaagtaagagatacaaaagaagttgtgagtgagatatagtgtagaagttctctgtttttttagaatgataaggaattatttttttttttgccataagtgtcacagcatgtctcaaaagcagactgtctacccctaattcattcaactactttggctatagtgacaatatagcatctgtgtatgtgacatagtggggctcaagcgatgacttttggtccaaattgaatgtaaattgtgcatttatgtagtaataagaaatgcaagttgaatcatttgaagtatatttcaaatcccatatcatgtgctaataaagccaagggctcttactttttttttggtgatatcacttcctaatactgagtatgttgtatcttttacaattgtgtagggaaatgtaataaaataatgaggcttaccagtggtttgctaccaagatttattttacctttcctgcattcatcgtagtcaatttctattgaaaggatatttgaaaaagaaaatttttctgacctaatatgactatattttcttggactgcccttaatggtatgtttttacttttgcatcacatctcctggaagatgcctctttttctagaaatgggaccagatgccttttgtactcctttaaacccttagtttaaacctctttttgaataatgtgttccatgtgtttatttcaatttgcatgatgtatctgttcctgagttcctttttttattgcaagtttcctgatttttagaatataacttttgtgaacctttgttgaaccatgctcccataggcttagtttccagattgcaattcagaacatttctcttgttctctctctcttcccctccctccctccctcttttcctccctccctccctccttcccctccttcttctctctttctctttatatctttccaaataaggggaggacattgaggcatttaaaaagggtggacatgacttttattaagtactttggcatttactctaaagaaaatgtttgagggtttgtttggcatagttttcagtgtccagattttggcatgctaaattagagtgctgtttttccttcgtattcaggattaacatttctttgtgaaatgattctcgaagtgatttacatttatgcccaatcactctgggacttcttacctgagatactctacacaaaaccaaatacgtgctcacatggtgtactcacttgtaaacactgggcctagtacgctgtcatgtgcctgtatatgaagcatctcctttgacataaggcctggtccagtctcctcacgttgctaccttccccatgccagccaagaatgggactttctccctgtctgttttgctgtccctgctattcagtcacaggactttgactccaaggtcactaactgctgatgctacaggctccttatggtagcttaagtttaaatagggagcctctctccttacccagaaaatggcatccagaatgtttcctgttctctttctattttgttttaaaacattgccaaaatgaattttattttaaaaggccgagttattttggaagcattgaagtaccaaggtgtttttgaatgtttatggttgcaggacaagccaatttgaaaccaaatgaatgtgtataaaaatatccccccttggctaagagcataaaagccaaagttcaacttgtggtgaatttttattgccaaattatatacacctctgtggacaagggttggtgatgagatgttcaataccatctgacctcaaagtggctgctgcccagctcattttgggatctaaagaagatctaaagtgcatatttttaggacatctgtgtgctttcagcagaagaaagttgctctttctagcatagctctgtagacttacctccattagtgtttttactaggaaagctggaaactataaaactgtaacaacaacacaaaaaaatatattgacgagagaaaaacaagcatactgtgccaaaatctataaagtgtttcgatgactggggtgggaggaaggagccactttttgatgttcactatttatacagctgcctattttgtggtaagaattcatagcagctgtgatacctctaaaacaggaaaccaccaagtcattgtaatattgatagttaaatgccttttatgttttaatcactccccatgcaggaatgtagactcctgaagaatttttcctccttgagggccatcgtttcggcactgcagtctaattccatctatcggttaaaaaagacttgggctgccgtcccaaggtaagttcccaagtgtttgctctgcttttctttggccgggataattagtggttgtgatgagtcctcaccttcaaagcttgtatcgcataactagagaaacatatttgaaatcctctgtgtgtttcaggcagggtgcatcttacacataatcattaatgacttttgaggcagggctcctgcagaaatcaaactcattctaagtataccaaagccaagattattggctttggggatgatttgaaggatgtgcttattatctggattttgagggataaggttgtggagtgatgaagttacagcaatttgccattacttctggttatttttcagcctcactacaaagccctaagctattttaggactcaaggggtaatgtgtgcagataggacattagttcttgatgttcagtaggaaactatttagttgtccttttagtttcagcattttaaaaactatcttattggcattaaaaacctttaaatgttctttcctaagtacctgaaattattaactggccacatcctatgctgtttttcttcatatttcttggtgcaaccgttggaataattaacaacttggtttcctgatttttgcactactgccatcacttccatttccggaacttcactgtagatcaaagaactttgtgcaaaggaaggaaaggtgagggagggggcagttctgattctctgtcactacagatttagaggctggggattgtgtcatgagtacaactaggccagctacattcaacaagtttgcccaggtttgaactagtcaggaagttaggctatatcagggaagaatctataaattctgtatggtctataccacatgtggtatagtcagtttcagttaggaggagagggatgccagctggcttcccagccaggctgccttagtggggcagaatggaaggtctgggtcctcagtttcataagtttactcagagttgatcaagccctaagagactggcattgtttgaatttgcaagagccccaagctggtaaaccagagtttcataaatttatgctgaaaaatgagtgccagaatcctcaagcttgctgataagctcatattctcgttcaggggatagtctacttggtgtaagccaaattatttattaggtgattctttgatgggtaaaaagaaaaaaataaagtggatgtttataatgcctcatgttacagagctgtagaagccacagctacttgcactccaaagctcgtgctttgtttatgacatcaatatttatcagtagaagaactagcaggcttttcaaagaccaatgcaattttcttgattattattctttttttaggttctttcttctctattttgaataatcaaggtgattgtgtgtattaaagagagattagttggttgattttcctctgcacatttctccttaagaacgatggggtcatataaaatcattacttgataggccctggtgaaatgcgatgggaaaatcagaagcatgcagtgtccccacccttcacacctccacttcacctcttctttcccttaccaccactctccactcaactgtagtatagtatcaaaaacaaagggacagtcaagtgttaaaatgtagccttactcaattgattgcaaccttgtctgattgccacgaaaggtaatcctttctttgatggttgaaaaaagaacactaaggaaagtcacgtaaccagcctaagatttcttccacagcaagtttgagactaaaacatgagcaaaaaaaattaatggacttgtatcttagtctccttggctgccatatgaaaagatttattctagctggcttttaaaactattttctaaagacaaaggaaaaaccctctaagctgcattctgtgtaacatatgtttctggtttgtttcttagttggtttgtatgtgttttagcaaggacactacagaagtgtcacagttccttagagaacacacttctatatcagctttacatgttctccattgctaaattcaaggaacaggattaagataacttatttggacatggtacatctatacagtggaatattttgcaggcataaaaggagtgtagtactgatacatggtgtaacatgaaggaaccttgaaaacatgctaaatttaaaaagccagccacaacagctacgtatcatatacttggacttgtatatgaaatgtccagaatcagcaaatctatggacacggaatgtagatcagtggttacctagggctgggactgggaggacggtagggtcccagggtgatagctaaagggtagagggctgctttttggggtgataaaatattctaaagttgattatggggatgactgcacaactctgtgaatatactaaaaagcattggactgtatacttcaatgatatgtggattatatctcaataaagctgttattgtaagaaaaaagatatcttatttggttatcactttccctataatccttgacatttgtcgctttaagtagacaaagggaatacctatttatttctcttcatttagggccacatataattaattttgaaattattttctccaaatatgaatagcttaatggttttctttattatttagagtaatattacactcactataaaacaggctcttaataatggtttttttcataataatgaaaatgttgcatatatagtgatattgcccctattaattctttgtcttcagaatcatgcactcattaaccctggagggtgtgtagagaaaaccatgaggctcacagagatgtagtgtcctggaaagggagaggggcagagcagatgctttgcatatgtggtttcactcactgtcccagcagtcccataaaagcactgtcatatttcccttgtagaggtgagaacattgaagctcaggaaagttaagcagcttgtccaggatcattcagaaagtgagtggagagatgcaattggaactcaccacccctggttgcagagcccatccggttccaccattctctgactctgggagtagaaatagtggcctgtgagccagaaaatttggcttccatacctacaaccctcagcagttattcgtggaaatttgggaaaatccctggttctggcatcgtcatctctaaacttaggggcctggccaagatgacctctcagatctgtgggctctgtgtgtgtaacagtttttttttttttttttttttttttttgtttaactcactgagaagaacatgtcctaattgaacaacttgatgccccaattgaataatccttttttatgattataatatgcatggctagggaaatatacctctctccacaggggtggccaagtccaccttaaaagaaataaaaagccatcccgcataaaaaaaaatcatgggccttatctgtgcttacagtacccaccaaccctgagatcagcacagtccctccttagacatgagtcctgaggacagctgggccaaaagtgtcgggttattcctaactcttcattgttaatattttcttaatcccttttcatagggaccgaatgctgatgtttgaagaactttcagatatcttctcagaccataataaccatttgaccagccgagaactactgatgaaggtgaggctcttagtgaggctgctgtgtagtgctgttaatagctctggaatccattcaaggaagagtagtgtgagggctccttaagttccttcaactccaaagaaagcctaaagtaactagaaggcaaaaaatttttttaaatgcagaatctaagaaacttggggctgagaaaattctaagtccagttgagctctctctttctacctcccttagcttgcctgttatgcaagcagattgtgaaacttgagttcatatgtgtatgtacctccttaacaagctactctgcaaataccaagtgctggcagttaggtgggtgagaggccctggaatattccttctcagcaaaacatctagaatgacagaggccaagcctgcctgcaattccacatcctttatttggactaaattgcacaatctgtcagtcagcagtatttattgaacaccaagtaagtgctgacttctgaatgacacactaggtaaagatatagcttagttcattttatgtctccagacatttgttgaatgcctaatatttgtaaagctttgaacctgcttctagaaatatgaaggtgactaacacaaacactgtttcctggagtttaccatctaattggggtatatagacactaaacaacaagaataaatagtcaaataaagacaactaacaggttgtgaacaaccatcagaggggaactagcatagaccaaatattatcctcatagtctttctataaagtagattttatcatcatcattttgtagatagccaagactcagagagggtaataacctgccctaaggcatacaaccaataggtggtagagctaaaatatgaatgtaatgtggtgagactctaaaacctgtgcttttatcaccaagacataaagctatttcttctgacctttttggagtaaggtgcaggatggatcagatccagcttcatagagaaggtaaattagtagttcagtaaatattggttgagcacccactaggtattggggataaaaccatattaaaggcagtgtttgatcttaaggggattacagtctcatgtgggaggtaaaacatttataaaatagtgtgataggtcctaccataggggaaagtcctgaactgggcaatcaaaagttgtgattcttatccttaatctccttttctataaatgggagccaatcaaagtatttggtctgttgacttcatagaattgttttgaagattcactatggtaaaatacttgaaagtgctatgcaaatgtaagttattttttgtatttggtgagctatattcatgtaaaaccaaagtatgcataacaaatgaaaataaatagagaataagctgcatatttgagcttagggaagatacttggagtaggagtgaaaatcaggtagaggtggggttagtaagaaaaggcatccaggtgctaacccttaggttagtcgatcctataagggcatttgttaaggtcttcatgactgttcctgtcctatgtcctacttatccttcatgtctcagtgtagactcctccttttctggaagccttccttcattctcaggtctgtgctccaggagaagctgtcatttctctgtcctggcacttatcacttgctctgttgcaactgcctgtctctctactggtctgtaggcctcttgcaggcaggggctgtatgtatcttttcactttgtatccctaatgcccaaccagtgcctggcatgcagtaagtgttcagaagctattgtttggctgcatgaattgatgggtcttatcattcacatgactttttaacaatatgcccactattagcccttcttggagtaggtgatatgagaagggcagtatgtgctgatgtctgactttggatttggactacctgattaactgcacactaaacaatcattactgagatcgtgttactccctgcttcacatgcccctggctttgcatactttaaatggaaacccatctggctggaaggagatggcttagtggtctccctgtcagcagtacgaagctagactaactggagccacacattcaaatccaaacagtcctgagtcttccttccaaagtagataaattgaatactgtgcagctcattgcctggtagcagccttctggctgaaggcttagaagtgaagctgtatctagacattaaagatcccataaacctttcttaaatgcagaagttaccccccgtactctaaattaaatttcttatagatatgactcaaattccaaagaaatggaaaacttggctgtgaattcatgtggtctgtgcattatcattaatgatagtgaaatgctttgggcagtccatgtatatctgtaggtccttttccagtcatttttgttaatcattcttcatatgaagtgtctaattctgagtgtaaattgtcagcacattttttttttaaatggaatcacaaggtacttagtttctcaaaagagtcactaggaaaaactaccggcctctgtttctagtgttactcctggttttatacggatttatggttgggtaacaatataatagtttcattttattttattttttgtagatatgtagtctcattatttttctcaggctggtctcaaattcttggactcttagttttaaatgacctaacttctcttcttctgggaagatgtaacgtgccacttatataatatggcccaggcaacatgattattagcaaaaatctgtggttttccttttaattgtttttaaaaatgtttcatttcctctcaaagactatcttaaacctgctatgtccttgtgatttctgaaacctgggtaattctaagcaggtgaattatagtctggaaatttcaagacatcagggaagaaagcagaatgccagcaaatcttggttctcatgattcttggtaagaattttttcggttgactttatataaaggactgctagaaagccccagaaattcaaccctgatggagacgtatgttcagtgacactccaaaacatgctaaactcaaagttagagcaagagtctgttacaactgtgacagttctgagctataattgctggtagctactgagcttaagttaaccaacatttatggagatggatccagagtccagtagacaagttccatctagacctagtagaagagggccctctgaagcccaagaacagcatggatgagggtagctgaactctgctaaagatggttataaagaaaaggtgagacttaagcaagccatttgcactaagagacggagagggaagagaagggcagagggggagataaaaggagagagagagggagaaggagattgatggaggaagagggagatttggcatttatccaaacataggtgatgattaaaatcatgagattggatagtatttccaaagacatgagtacagcagaaaacaagaggataactttgacaaaaagaagaatcactaagagaatatgagaacagcagaggaggcagggggagagaatgagtgatacagtcacaaaaacctatgaaaactttcaagaaggttcaagggattggtgttgtgcgacattgcagagtaggagatttggggctgaggaaggaaaaactgaaactgctggatgtggcaggtaagtggattttcagttgacacctcatttggaataatagggactcgtcggtctttttagatctctagcagggatggaatctcattctcatgaaatcataaagtcatggaatcaacaagtcttgtagctccccatctcaggcgtttctctctcctatctaatgaggaggttgtcttaagtgctcttttgagatccctttcacctctgttattctgtgattcttaggagcctttgaacttttcagaaattctctttaggaattttagccatgtctacaataacttatgatacattattcctctgcccataactgacatactggagggagaccagaaggacctacacaccggaaagaggtgggcactcttattcaagtcagacataattgatttctcactctaagcaaattctcaagaatttcggaggactcacaactatctagcacaggaaaggcgcatattaggctgctttcttttttttagaggtggggtctcactatgttgctcaagttggacttgaactcctgggctcaagcgaccctcctgcctcagccttctgagtagctaggattacaggcgcatgccgccatgtccagtataggctattttcattcatccctgtgaaaaactatgaatgggagatcattaaatagtggctctctttattatcatttgtgatgggaagaacttaaataggtaatgagtcactgtgggttctgtcccagtagtgtacctgggacctgagttaaggctgagagatggaacatgttgatgctctatcactatcagcaaggccaagccactgaaaaaaacccttttgtggttgtacagtagtggaaggtcacgtgctatggtaatacataaatctcaggaaaagtgactaaggaaaaactagtgtagaagttatatactactgaattgtgcaatttacccccccattcatgcagttcctggaaaatgagaacttaacaagaccccaaaaccgcaaaagcacttaatgttcagtcagcaaactcatgattactcattatatagaagagtttgttgttacaatagacaggaggagagaaagggtagccatgtgtcctcaggcaccaggaggaaggattgatttgtaagagttccaaacctgagaggcaatttagaagaactgactgggggctggggatgtgtgaaagttcgacttttatggattggtcatgtagtacaatattggacttcctcagaaaacttccggtgcaaaagtttcatttagctaagaaatgctacagaagtagtccctttctttcacagaatgctggcacatccatttcaggccaagatcgagaaatcacaaaatgtactgaggaagtcgatctttgttttcaggatatctgattactttgagtttaatttgggatctgtaaaaatgtcttcatttatgagaattgcctggcttgtattgatgattgctttcataaccaaatcaggtgatcttcttacaaagtaaggggaaggccaggtgtggtggctggctcatgcctgtaatcccagcacttggggaagctgaggcaggtggatgatctgagatcaggagttcaagaccagcctggccaacatggcgaaaccccatctctactaaaaacaaaaaataaaataaaatataaaaattagccaggtggtggcgcattcctctaatcccagctactcgggaggctgaggcaggagaatcacttgaacctgggaggcagaggttgcagtgagctgagattgcgccactgcactccagccttcccagcagagtgagacttcgtctcaaaaaaaaaaaaaacaaagttgggggaagaacaagaaaatccaagtccaccagcctcgttataaataggcaacttgcaacaagccagccaagtatttgcataatatacatcgtgagagcctgctggaggcctcttcattttgcatggtgttccgagcgagagttatgcagggttgtgtgcgagaaactagatgcctctttacttcttaccattgtggcatcctgtatcaattccctctgtgtgcatttctgtttctcaggaaggaacctcaaaatttgcaaacctggacagcagtgtgaaagaaaaccagaagcgtacccagaggcggctgcagctccagaaggacatggtatgtctggccctcgtcttccctgacagctcacagaggagaagggccgtgtgcgtctgggctcccacatggcactggcaccttcagtcaacagggcacccaggctttcagaaagggtctcccattctctaccccatttgttctcagcagccctgggaggtctataggagagagatgattaccctcattcaactagtaggaagtaagcactgggtggcaaatcctgttttctggcaaagttgttttctgaaggtgagggggagtctacagcaggtcgacttcctccctcttgcagtctcttccgccccctcctgcacttagaagctgctccaccttggcctgagggcctcctgagcttcctactgtagtcagcttctgatacatggtgaccaaggagaaagagtgtcttctccacagggccctggtccttgtactcagagatcttttcatttgttctaatctagccattgcccagctctccttactaatcccaaggctaaccaaatctttatagtttttcaatatttaaaggagcatcatgcctccctcctgaagactgaaagataggtattatcaactttagcttcattttaaacttctgactgttagcataaagtgtggaagaccagagggaggagattagagactgacaaactctaaatattctgctttaagagggttttctctttctttggaaagctcaacgtaagtaagaaatgtttttgaatgataggactcttccgcaacatgaagcctataaaacattcacagtgttacaaacttttttggttgttcaaagacaagctaaaaatagctgttaccaaaaaaatagattattttagtacaggatgagaccttgtacacagaatgggaaggacacactgcagctgacagtgagttcctgaaggacaaaaccctccttggtatgaacctcacaaagcagttctggctgaggaagcagccagcctcatgtcaagcagcctggctttaccctgtttgaggctttgtgttctgccaaaatttccagaattggcttgatgagatttaggataagggatccatggggaccgctttttacttttcctttaggatgtttagtgccttggtggcttactgaagaagagagatgattttaaaggagatttagtgaaatgaatatagtgtatccctgcagttgtaggtagaagtgcctccaccttcatttccaactttttattctggaataagtttagatttacagaaaagctgcaaagctagaagtgcagtttccctcattgttaacatcttctaaaaccatagcacatttgtcaatactaagaaactgacactggcataatactattaactaaaatctagactttgtttggatttcaccagttttccactagtatcttcttatctgttccaggacccaatccggcataccaactgcattttgttgtctgtcacccctgtctcttcaggtctacgacagtgttttcttgactgttttttatgaccttggttgtcttaaggggtctatccaggtattctgtagaatgttccacagtttgaggttgtctgctgttttctagtgattagactgagcttctggatttttagaaagaatatcacagagtaaagtgcccttctcatcacatcacatcaaggagtgaatgaatggtttcagcgtgacatctggtgtcatgttgatggtgacacgaatgatgttgatctttattacttggttaaggaagagtttgccaggttcttcctcagaagttactgtttttctctttccctcctctattatttgagagttagtcaccaagtctagcccaaggggttatattaatagtgatgccccatgcttttgtggtacatacttctctgtgtacaacagccaatggtgaggcaatgactatccagtgccatccccaactaccaggaatgtccccatgctctgaaagagaacagacatccttctcacttgagccaaagcaaaacataaaccccacagtcaacacttttgaacagatgtgtatgatctcctggctttgaggcttggttttcatgatttcacaagttagatattagatcatggagtttctatcctatttgtgtagaaatttaaaaaatgttattcatggaggttagcaccactggcccgcagttaggccttgaatacatccatttgctccagcttgaagattcctaaaacccctcaacttttcaatgacaataaagacagttttgctttggatgctcttcagggtgtgatgcagggaactgtgccctacctgggcaccttcctgactgacctgaccatgcttgacactgcccttcaggactacatcgaggtgagttccatgtgggtggtgtgatcgggcctgcagccttcccactggataccctaaagagtagttaacttctcttagtatcttttgaaggtccaaaagtacatggcattgtgctagctgttaggaggaatacaaagaataacaccaaagactaacaccagaagtggctcaaaatccagtggaagtaattaatatatcaaaataagcagtgaacgatagtaataatcgaaattcaaacaaatgcattgagagaacatgggagatgacaattattattatttttttgagatggagttttgctcttgttgtccaagctggagtgcaatggcacgatcttggctcactgcaatctctgcctctcgggttcaagcaattctcctgcctcagcctcccaagtagctgggattacaggcgtgcaccaccacgcccagctaattttttgtatttttagtagaaacagggtttcaccatattagccaggctagccttgaactcctgaccacaggtgatccgcccaccttggccttccaaagtgctgggattacaggcgttgagccactgcacccggcccacaatgaactcttatgaggggttgtgatgaacagggctcatgaaggagtgggtttgggtttgaacaagactttaaggccgggcgcgatgtctcatgcctgtaatcccagcactttaagaggtcaaggcaggtgaatcacctgaggtcaggagttcaagaccagcctggccaacatggtgaaaccccgtctctactaaaaatacaaaaattaggctgggtgtggtggctcacgcctgtaatcccagcactttgggaggctgagacaggcagatcatgaggtcaggagttcgagaccaccctggccaacatggtgaaaccccatctctactaaaaacacaaaaatcagccgggcatggtgacacatgcctgtagtcccagctactcaggaggttgaggcagaagaattgcttgaacccgagaggcggaggttgcagtgagccgagattgcgccactgcacttcagcctgggtgacagagcaagaccccatctcaaaaaaaagaaaaagaataaataaataaaaatacaaaaattagccggtcatggtggcaggtgcctataatcccaactactctggaggctgaggcaggagaatcacttgagctcgggaggcagaggttgcagtgagccgagatcgtgtcattgcacgatctaggtgcccagcctaggtgccagagtgagactcggtctcaaacaaaaacaaacaaacaaacaaacaaaaaaccccacaagactttaatgttgagtaggactacttggtggggtagagagtcagtcaaatttgtgatttttcaaatatgcttttctttttgtattgctgcctgctgtggggtatttttctctctctctgtctctctctctctctgtccccttgtccctctttctctctgttccccctctctctacccctactcccttcatcccccatcttctctgaaagggaaaatacatgaaaactcagataaacaacttgttagtagcagcaataaaatattaagtgaagaagaaatttcaaatttgaaatgaaattgaaagattgcttgcatatttcagtatatactacccccttgttatcatatgcaaccagcctgcttttattgtatcttaattagaagaagtagaagttactttgcatagatctacctacctttggatttgccacagtgttgtggacacatttattcattttgcatctcctgacttctatgtctcttcacatcctctttctcagcttatctcaggaaacacccatcagtgttggggaattctggggagtaaccaaagatttagaagttaaattcagcctactgagaataggagctgaggggatgaagaattgaaacttaacttttcatgatgctatggagaaatgacttcccttttgataaaccgtatgagtcaatgaccatctgttttagttgcttttggtaagggaaaaaagtgtaatggaatatttactcaagcttttatctttactggttctgcaagtgtctttggatcctgatttgtaattatttatcattactattttagttggtttcagacatttcaagagaaggctttctgcttatcctgccttataataatactttttttaaaagcaaaacaggactctcttcttccacagtagtcgtaattataggatcattgataattgtgactttatcacccctttgatctattttaatgtgacctacgacaacatatggctgtgttttaaagtagcttggttgctcactctttttattaaaatttcttttagggtggactgataaactttgagaaaaggagaagggtaagtagagttgttggctgtgtttcctttgtctgagcatgaaaaaaatgaaagaaatggggacttaagtttttttgtagaggcagaaaaaaatgagttagcacctactgaacgtttatcatataccattttgcttggcattctcctatacattatcccccactagccttatgaggtaggttttatcatcctcaattcaaaggtgaggaagctaggactcaagagattaaattactggacgagaatctcttggtggcaaagccagggttctcatcctgtcctgatgccccaaagcccacatttcttccctgcccactccttatctcctttacaattagcttcagcaatagcaggcttgccacttaattaataacaatgtattttatacttgaagattactaagagtagactttaagtattctcatcacaaataaatatgtgaagtaatgcatatgttagttagcctgatttagccattccacggtatatacatgtttcagaacatcatgttgcacaccataaatacaaacaattttttaatttgccaattaaaataaaaaccaggtttaccctattaaggataaggggtttctgatgagtaaatgacatagaagagttaataaagatggtaaactctcgtgggtatactcgagagaggaaaggaaatggccttcgtcttcggtgtaggtagttattctttccctttcgtgtcagcataggaaggtgtgctcaacatcaatttcactcttcctgtggatagcacagttctgaactgtgctattcaagataaaacagtcttgaaatttttctgtgattttcatattcaaatggcatatttaaatagatatttaaaagactcaaaggaaaatgagtgagcaaaataataacttcaccctgtagtactctcgttatttttcagtactttcacattccacaaatattgactgtctacctaacatggggggggtttgggaattacagcagagaaagaacagagctgcctgccctcgtaaagttcacaatccaggagagaggtagacaaataaataggcagttataatacaacctgaaaagggtttgtgagcagaagtagtgggtgttagagaagtatataggtggggtatctatctccaacttgtagggccagagaaacttccaggagaaaatgacgttgaagttaaaaccaaaaaggcatagaggagctaaacaaagctgggcttatcagaacaagatactaacctggacaaatgtaaattttttgtcccatatagacgatacttttttctttagcatgatggtaaatattccttgaggatactgagaccaagggccgaggtcactggatggcaagttgagacttggagaatctaccagttcttgagttacttctgtcatgtcctgtaatgataataaattcagttattgccccctcagttcccctctctgtcatttaacttcagaataactgtggttggtaatctctttcctttttagactaggatattaaacttctggaaagtttgactgtaaaacctaaacctaaagcttatacccattgctgacttaaattttttttattgaaacatccaaataagtataaataattttcaacataattatgtacttgcctctctgtgagttttaaaagacttagttaaatgatttagtggcgtagtaaaaacccaaggattcaggaaatctaaacattcaattttatgagacctaggactgtttagatactcagccctaccaaaacttatttattgaggggtaaaggttgaggaagatggggatggggatcttgggagctccctgacttaaagtatttcttttcttttttttaagaaatatgaatagaaattaatatattttatgaagtacttaaaaccttaaaaatcatttttctattccaaggatgaaagtgaagaagagaaaaaggaagccactgtaacttaacgtagtgactagtttgggttgctttggtagcttgttttatacaaattgctttctcaaggagaaaagaggattaaaaattaaagcatacaaggactttggagagttctagttagaatttttaagagttagttagctcctttatttttaaggaagcagtatttcagaatcctcctagatggttttcttcatcttttatcctaatgtggtatattttcatgttgaaagattctatatttggttggccttattattcagtcttttttttttaatttttggtattctgtctgctttaggaatttgaagtgattgcccagataaagctcttacagtctgcctgcaacagctattgcatgaccccagaccaaaagttcatccagtggttccagaggcagcagctcctgacagaggaggagaggtgggatcacctgtcgttcatcggggtagaactgaagtgttggcaagaaaaatgctgcatttaatacctcgctgggtcatttattcaacaactatttagtgagcagctgctaggttccaggtccttggttttcaaaggcgcatggtgtggcaggaaaggctgagttgatagcatcaagatgtactttcagactcttgcttggccacttatttatctttgtaaccttgaacaagtcatttgttcttccctatcttaaggatgctcatctgtagaatgtttgtgaggcgtaactaagatcttatgtgggaatgctttgttagaatgcttgtcctcagcgttgtcaccaccaccactgtcactgtgtttgtcattcctgttaattgatggtagctttccaggaagctttcaacctagaggggttgagagactcatgaaactttgaaatatgatgggtaactacattcctacaaaacctatgggaagaattggggaaaataaggaaaatataaaggcattaatatttaggctggctgtaaaggagaaacaagattttgccataagaaccggaagagaacattccagaccgagagagaacacaagcaaaagcttggtggcctgacatgtttggcatttgaaggaacagtgataactcaggtgtggcagggacacaaagaacagtttaaaaatagtgggatgggcatagaaaggcatgttcacttgagtgccctgcctgctggctcagcacgtccctgtcctgtagcctgctcgcttgttggcagattggtctgcaggccatatgtggcccactgcctgtttttacatttttaaatgattggggtgggggggaacaaaaaaagaatattttgtgacacgaaacagttatttgaaattcagatttcagtatctacataaatatggttttattgaaacacagcccgttcatttacatctcatctatggttgctttcatgctgtaaagacagagttgagtagttgcaacagagaccatatggcccacaaagcctaaaatactatgtgatcctttacagaagaagttggcccatccctaccctagcccaggggatttctttggaagtttatcataagggagagtgaaattgacagcaaaataagtatttacaaaaaaaaaaacttgaggtttagagaaatatttgaatgaattaatgacagcatttggattcaaactcaggtctgcccggctctacagcctaagctctgaagatggctgtataatgttgggcacccttccccacctactcagtaacgaaatacatctactgtctacagctacaagctttcataaaaggcacttggaatcacatataaattcctcttgtgcttgtgtcagttatatctgcctggcagatagaggtctgaatctggagcatttttaatttaggaagttttggcaattaaaaatttaaaaaagtatttgtaggccaccctggccaacatggtgaaaccccatctctactaaaataaataaatatatatatatatatctttatcagtaatgtaattgcctatgtctgttcattgacgatcagatagattacaaaagtctcttcattttctttagataaaactaagtcatttgtgcatgtgcacaaacacacatacaaaatagtaggaaggaggtaatagagaagaaataggagggggaggtagtagaggaaggaagattcttccactggcctagcagtgggatgagaatgatcagaatggagttagtttttgatgctgccaaagtgcatatatccttgtatttgaaacacgcagaactaaatagcctcaatccatatgccagtggaggtgagggaggaagcacataagataaatgtgtcaaatcgggccgtgaagtcagtaccccctgacgtttatgataggacaacgtttgtatatatctttactttgaacaattagagccttctctaaaacaaaaccaggacatcatgtgaatttaagtgtgtttttcaattctctaactttgacctcatggagcccccttctctttctcagctatgccctgtcatgtgagattgaagcagctgctgacgccagcaccacctcgcccaagcctcggaagagcatggtgaagagactcagcctgtgagtgtcccctgggggttctggggctccaagagggtgccatcagagtcgtgagaggagatgtattcaacaggatgaccttgagccagggtgaaagtgaagagcactccgctcatttgttaagccgtttatccttctgtcatgaactcaaagcatttgctgagtccattcttctccactcccctctctgttgtgaatcaccattctctcctgcctgaatcactccagtaacatcttcactgtcttctggctgccccttacccaaccattcattctccactaaatagctaggttgtcttttaaaatgtacaccagattatgttgcttcctgtataaaaacccctatagcttttattttaaaataaaacccaaactctgtatcctggtttactaggccttacatgacttaacctgcagacttccctctcttacaacattgccctctgttcaccagtgttgaagacgtttgcactggctgtgcctggcctgaaatgctctttcttcatgactggctccttcaaatattagcaaaaatgttatgtgccaagagagaaccctttctaatgttgctgtccacccctcattctcattcatactagctgcttcctccagtggaatgtaagcaacctgagaacaggaaccttgtctatcatgctcgcagttgtattgcctgaggccaggagtttgagaccagcctggacaatgtagtgagatcctgtctctacaaaaaaatatcacttaaaatattagctgggcatggtggtgcacgcatgtagtcccagctacttgggaggctgaggtgggagggttgcctgagcccaggagttcagtgttacagtgagctatttttgtgccactgcactctagcctggatgacagggcgagaccctgtctctaagaacaaaacaaaacaaaacaacaacaacaaatatatatatatatttatacacacatatatatatacacatacatatatatatgcagtacctagctctcaatatgtgcctgaaaaaccaccattatttttaatgaaatgaatcagttaatatctttttgaggatttggggggatcaggattctgactgtctttatgggcatttgatatttcccagcactgtctctccacctacttcagtgagtcacattgagacacaggcagggatggcacatgaccttgagtgttgccatgtccccggtgtaacataaagacctctgctggatgtggatagcaaggtctcccaccatcagcggccacgcaggctgctatctgccatcaggtgatatgggtggtatgaggcattgtgggtgggttggaacatgcgctttagtagaaagcatctggaagatcatcctgtgttttgctcaccctctctttgttcagatgactgtcctggccctgcggaactctagatttatgagcttttggagtcagctcttgaggagaatttttcatagtatcttgctgtcttttcatctttgcagatatgggggaatgaactactgagataatctgaggggcctgaccaagccttgtcagctggtaagactggcatgtgcacagggaatcagctccctgatagaggagtccagacatgcaggggatcctgggtgtccactctgctcactgaggcagcagaaggaattgggagcttctggacccactatggcagtcagaggttcttaaggaaaaaaacaaaaattctcaatgcaggcaggcctaatcctgcgtcctgctacctctatcctcctgccttctccccatcctcatttctatgctactgcttctctgtactcctctccaagcccgggatctatatgttttgtggtgggagttctaatacccctggatcctctgtcttcactgacacagacaagtggtcagtcctatgaaaacatttactgtgaaatccagagagggcaggactgtgagggtgctatgcccttcacaaagtgtggtaggtactcagtacatctcttactagtaaaatcttgctgggataacccttggtatctgcagttgagtttgggcatctattatgaaagcagttcatatgcccccatcttatttcttgtacatacaagggtgtttgcataccattatttttcaaaagatttcatgatcttcttagcatgtttacaaatctgggaaatgcatttttgctgttcccacattcaatggctcatcattccaaagaggttggagaaaactttgggtgcttaggcctagtttgaaagttagagatgcctactactgagccagaatgaaccttcacaacgcaggacaaagcaggaccttactgaattgtagaaatggaagaaccctagagactctgagataatggatggaggaccactagttgacatcctttcaagatctacctttgtaatttatgaagcagtaagaaagggcattatttttgcttctgtgatcagagtttagctcatacccctatagtccctgtaatgctcctgtaatgcttgaagggtcataaaaggaagacagggaaaatggggctggagatagcagggtagagataaggcagagcaaaaatatgcttgagctcttggaattcaagcatataattccgaaaatatttaataaaaaatcaagttcaccttcattgtttctattattgttgttattttatagtcagtacttgtttaggttcagcccacgtgctagttgccttgcatgccgttccttcttaatctgactcccgccctccttttaccactacttgtggtgtaaatctgttaacggtaaaccttctcagtcttagtctgagaaagtctttattttgccctccttcttagaattatattagacgggtatagaattcaatactgactgttactttcactcagcactttgacgatattattcagtgtcttttgacttccatggttacttttgagatgtgtggtatctgcttaattactattcctctgttttatgttcccactcctgttgcttttctttcttctttccttccttccttccttcctcactcgctctctttctttcaaaagagttttgctctgtcgcttaggctggagtgatcttggctcactgtaacctctgcctcctgggttcatgcaattcttgtgcttcagcttcccaagtagctgggattacaggcacatgccaccacacctgggtaatttttttgtattttggtagagatggggcttcaccacgttgcctggagtggtcttgaactcctgaactcaggcagtcagcctgcctcggcctcccaaagtgctggaagcactttgagagccactgtgcctggccccctgttgattttaagaatttcttttgtctttgatataccagtttaagtgggagtttagtcttaccctattcaggacatggctcttggatgggaggattcctatggttcaccagttctggaatcctctcagccaccatctcttctgatatgggccttcttccatcctctccatgtcttctggaactcctcctacacatacctggggctttcttactgctttctccatatcttttcactgttctttctatgtctttatcttttgatgatgatttttgaggattttcttcagatctgtcatctagttcatgatttttttcttcaagttatttaatccttccactgaggttttagtttaagtcaccacctttttcacttagaggtgaaatgtttttcaaattatcttcttcctttattaggatgtcttgctctgagctccggttttcaatttcttcttttatgtctttaatatttcctaacatacttattttgcagcttggcttatagtagacatgcagatatttgttggatgaataagcacattattagttttgttctgacagttctcaaatttgaagttctcaggagtctaagcctgctttttgttatgcctgttggctctctctttcagtggaatatttccttgtgtgtattttgtaattttgtatcacgagtttatctttatcaggggattctctgaagcctgggctgaaggtatatccctcccgcaagattttctttttttttaagaaaaaatctagtttactagcggtgtcaccggttgagagtttctaaccccatagaccacataaatagcaaattggagtgaggcacagacccagctcacacatgacttcataggagacatttttcttctttccatgctcaggcaagaacagtctccctgttgtcttcctatgctagtagaaagatatttttctggcctatctttttagtaagggtatagccctttgtgggccctggctgtatatagttttggttctaactcctcaccattcataaacagaaaccctcatctttgggccctgggtgtgcattaaaacccatatcactattttgccaagattggggcctcccactcccccaccagagcagctgcagaactagctcgcgtgcttctggttttcagttcctttttcacttaaggcctgtagggatttcccttcctatcttgcaagctcaactaaaaagagtttttaatatttcttatctagctgttttatagaggaagcatttaggatactgtagttcacagattgttggaaatagaagtcttcctccttggtttcttacccaaagcagtgccatcccttctttgcctgtgaagatcattttatggtaggaagtgatgggggtatgctgatggtatcttgatcctgccaaggtggtccatagactgttaaaatgtagaggaccattgacctagaaagacttcagattagtactgaataatctatgtgttctttgaagttggaaatactcttttgggacaagatgtttactactatttgttagaaactttatagcgaatgtcctcctaaaataataatgacagaacacacaagactgaaaaaacatcaagggcttaatcaacacaaaatatttgcctaatcatggattccagatttgtaacagcccaaatgcttggcattctgtttttttccagactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaaggtatatactcaacccttctcataattcctaatgcaggcacctacatgctctttgccacaccacagcaaggaatgtctgtttttaagtggatcactctatagtattttgaaagtcatgttttgaacaggcatcaaaagaagagttcaatttggggacatactactaatagaaacaggtgtaaaagcactaagcagtttcgtttattcatttggcctttgaaatattgttctatacccacctcttaaggcactggagttatttaggggaagtaggacttcttagaaagagcaaaaagtcagagatggagatgtgtcaggttcttggtgccatgttttgtcttagccaagcatttatcacaataatgttgcattgcatgccactccaaaagtcagtgacttaaaacaaccactatttatctctcttatgtatctgctggttggctgatctaggttgggcttgacactaggccacagatttggtccaggtctgttccacttgcctctcattattgttggagtaacgggctacccagggcatgcccttagcatgctaagacggacaagcaagagggcaagcccactcgcaagcatatgtcaagcctttacttgagtcgtatcaaccaacattctattggctaaagtaatcatgtggccacattccacataagtaaatgaagcagagaaataggctccagttttagtgggaggaactctgaaatcacagtgcaaagggcacagctgcaggggaagatgagggattggtaacaaggatacattctcccatgttggaaaaaaggaaactgatgagaggtgataaaagaatttccgtcgagtttctattttctgtgactgcataaataaaaatttaaaaaccaaaatatcttaatcttaagatcttaattaagaccagtcttcttttttttttttttttttttttttttttgagatgaagtctcactactctgttgcccaggctggaatgcagtggtacgatcttggctcactacaacctctgtcttctgggttcaggggattctcctgcctcagcctcccgagtagctgggattacaggcatgtgccaccatgcccgcataatttttgtatttttagtagagatggagtttcaccatgttggccaggttggtctcacacccctgacctcaggtgatccacccacttcggcctcccaaagtgctgggatgagccaccgcaccccaccaatatcagtgttaatcttctgtacacatctgcttcaatctgttggttgaagggtttggatcagaaagtcaactatgacataactagaatttgcaccatttggggaaggtttctggctaaccaagcttactcaatagtgacttctggctccttagcttatggttaggtcagtaaggtagaatgttggcaatggtttcatcccttggtttatatctgctgctcttcaaggggacatgtgtgttgcttcacatggtgttaaaacaacagtggtaatcctggaaccctcaagtgactttgtcataatgtagccaatccaggaaaagcatcatattcaggattcatcaaactgagatgactaatttgctgctctagttggatttcttagctttctgctttgaaatccaggggatacaatcattcatgctctaaatattgaaagaaagccttcgtggacacctacggactggccatgctctcaaaaggcatttttcctcaacccgggatgtagtcattcttcgtgacttgacatacaaattagctttgtcaaaatctggaatgcagtctcatcattcactttttcacagcctctgaggttttataggctccatttctgatggtagacattgtaggaaagtaataactgaggtattgcccacattattgtgggatttctccctgtctctccaggaaggagatggaatcacagtcacaccttgtggcatagtggaaatgtacattggtccaaatggtaccttttaaaactatgcagaagcccagtgtgctttctcctgcacatcccttgcttcatcttttttgtctcatccctcatcagactggctttttaaattcttgcagaagtcatggctctttattctttggatgaacctttctcagagtcatacatttcttaaacatcagtgattcacttggatgcaagtagctcctggactgcacaatccctgcatattagctagaaaggctcgtgattctcctgcttggcacatagctggactgagctgacctccacacttccttcctgacctgagagcctgtgacagccgccttctccaaaagtcctccagactgtcattcttccttttccacaggctgcactgtgaggttgctcttaagggtgaagtgtaatttatttgcattcctttcttcattccccgatcatgatttctaaatattgatttttgcacttgctcctcacttcttaaattctcaataggaatttgggggctcatcaggcagtctgtttagagctgctataacccaggcatattctaggctttatcttaactataaatgtcactagaatcatagaaaaatctaacaaaggaaatagagtttggatagaggaacatgaaggcgaaaaaattgaatgaataattggaaaatgcacccccttaactaatatatctgcaaagaaacttatgctattaacttatctatcatcagttagtcctcaaattgagccactaagttgattcatttgggaacataaggaagaaaaaaacccaaaaaccaaaacaaaaactaaaccatattatgatagagccacaatcagacccctacccatgagaattgtcacatcagctggctggctgtaaactaactgtgcaatagaactgaatgtataattatgccacaggaggaaatctacaggaaataagataatagactccattttaatcagaagcctgataaccagaaagctcaacttctatactgtttccatggaaaggcagataaatatgaaagaaatgttatttattttataaatgacttccagaatattttataggattaacatggtataatttagcttaagtcattccgggaaattctttataattttctacaataataatgggtattttaaatggttcaatttaatgatttttaaaagtacctcttccaataacttctttctttggttattggtattgcatggatgagaaatgtgtagttaatcagaaaagcatattaactgtagtactccatttcttaattgtccttgatacacatcatgaaaatgtatacagttggctctactagcaaatgtggaaagtggtgaagctgcttaaaggctgtatttcccttgagcaagtcacttttatattctgaatcttattctcctcgtctttataatgctctgcattttgttcacaagacagttgtggaattaaaatgggataagataatatgaaagttcatgataagcctcacagtactaaacataccgaggtagcagcatactatgttgattcatcttattgtcatcagccacaggctgagccttggccatgtgcttgctctgggaactcgacagtgggaatcagggagcttgggttcctgttctaggggtgctgtcaactagctgtgtggacctggagccccagttttctccctgggtctcaggttcctcagcagaacaggtatgggactagttgatgtccaaggcctttctagcactaatattcaatgcagagccgtataatctggggtacttctcttagaaacttctaaaaatacagaactttctctctcactacgaaatctgactgcagtaggactgaatcaactgcgttggcaaggctttcctccagccccgtaagcttctgacttctttgggaacccatattgcctccagtttctggtgtctgctgccacctgctggttaacttctataagaacagctaaaacctagggaaatagaactgctttgcctcacgtgcttatagagtgattaggtcacactgagtcaccgataggcatctaccactgatggggactcagagtacttacaccagggatgagacacatgtgtgctgtgggctgttgtggaggaaataactgcagtctatcagtcttgatatctacctctgctttgaaaattgcaaagctgttggccagcgttctaatctgttttcttctggggtgtgtttactcttccagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatggtgaggagcaagccctgacccaggagcgggtttccatttagattgtgtgtctgtgtctgtcggccgctcagactaatagccctaaatatgcacactcaatattagcatatacatatatgcattcacacagaagggatgtgtgtcagttccaggtctccctgggcatagatgctgaatgatatatgtatataaaatatatatacatatatatgcacacacatggtgtatataggatataattttcacatcttaaagaaatgctaaaacttattcgtttaggtcagtattagccatttgaaaattctcaatttgggtgacagtgtaaatgtgctccagggaggatgacacaacctcacacatttttggaagccttcctatggaattatatgtctggttttatcattgaatttccacacattcttagcagtgtactcccctgatggcagatttttgtcatttagtcatttggatcaaacctagttaataaagtggatgatcaagctagaaatacagtttgggttaatgaggaacgatgcctataaaatgagactgacctttttgagcttcttgtaaaatctgtgtgtttctgaggacaattgcaaagatatttttaataatggcagtcttttgggaatacacacagagcctctcatggcgataaccttgggtatgtgaggtctggtaggtttatcacaagaatataaactccttagtttatgggagataatcatgtattggaaatcactttatcctttgcagcaaaatcccacagctaattccacatctctcctcatctttatcactcgcctctttgaaggcacactcagtgcttacaagctcaggtctgaatatggcataagtggtatggaggctccacataaaagctttgctaaagcatttattgagtcaacaaaatatcaaacatttattgcgttctagtcattagatcaggctttggggatagggagatgagtgagacatttctgcctttgaggaacttttaattagaaagggagcccacaaagcattattcacaatgtgcaaaataatagagccaagatcaggtggtaaagggccttgtggcccacacagaggagtgtgttaatcccgcaggcaatagggtcttgttgaaggcttttaagtagtgatgggatttgctcattaagaaagtcatggcactgtgtttgctggagtgtcggggtagactggaggcggggaagcaagttaggaagctgctatcatgttccatgtaggagaggataagggcttgaatgacggtcatgtggctggagatggtgaggatttttgaaagcttttgatgaggtagaattgtagaatccattcatttagttaccaactttttggttactgttgtggaggactagaggctgtctgggtagttggtgggtctgtgagatatgaactaccagaggaggatattcagggacatttaaatcagaggtaccagtatgacatcagatggcattgtctgatagatggtcagaaacatgggctggtgcaaggctggtgctgagatcaaatactgggagttgtcaaaccccacaggggggacgtggtctcgcgagactgagtgtaggatgaggcagaatgcaagtggtaatgagggaggggctaataaaggagcacccgagaggtagaggaaacacagggaagccaaggtcctccatgtggttactgcctgctcagcatggtctgttcacctggcacctcttacctgcaccaatcagagagaatgtccactgcataactctacagtgtctctgaattatagcatggatttgtacaccaaacagttatgttttgggacatgcctggtcagcgtgcactctgctcagtctggggggaactgtgagtggttggactgcacaaacctctactgcccaggaggagtcacaggttgtgcatgctgtctgagtgttgggagggtagtgagcagaagatcccctgccccctgctctgagattcctccttccccagcaaatgggctgcctctgtgagaatcacctctcctgccaaccccttcctgtggccctttatattgcaccaggtggtggcactcacctttcatgaaaatcctgccagcgcatgtcacaggcttattctggagagacgacacactgctctcgtgctctcattctaatcgttaggcctctcaggagaaaccttgctcacaggacgtacctttctgaaatgtattatgctgtgtgctgttgaccagaagatggaaataaatcagtccaggttcaggcgagactagcagttctcaaactttttgttctcaggacccctttatactctgaaacagcattgaatattccaaagagctccagactatgtgggttgtatctgttgatatttaccacattagatatttaaactgagaaactttcaaaatgttgattaattcatttaaaataacaataatgaacacattgcatgttaatgtaaattttattttttaatgaaaaatatctatttttttccaaaaattattgagtgagaagtgtggcattgttttccatttctgaaagtctgttaaaatgtgagtgagactggctttgttttgttttgtttttgtttttactgtgagtacagggtactgaagaatacagtgacagctagtagatttgtagttagaaaccactggaccgatttgtgctgttgtgccagcaattccatccaccatagcttctgcaatacctatgcaaatgtcaacacaaagaaaagacaaacagcatcttagtattatcatgaaaataattttgatctcatggatcccctcacagatttcagggaccccacgggccatagattgcacactgagaactggtggcctagagaacttgctttgcaagagcaactaatgtccctggaatccaaggcccttccatagaagaagagacagcaattagcccttgtaaaattacctcctcagtgaccatggaaaaatgtcttctaccactgaacccatcactctttcgaaatgatctttctctccattgtgtcaatcacagagtcagtctcccaagatcccttacacagggaatgcagtatttctgtcacaggaaagtcaatgagggcgacaccaaagcatcgttcagtaccgcgcattcagtacagcagccactggccacgggtggcgatggagcatttgaaatgggaatactccaaattgagatgagctgagggtaaaatatataccagattttgaacacttagtacaaaaaagtaaaatactgcattaacaatttttgtattgattatatatgctgatgtaatatttggggtgttcaagttaaatatcacctttcaaaaactttttttttttttgaggcagagtcttgcactgttgcctgggctggattgcaatggcacgatctcagctcactgcaacctctgcctccctggttcaagcggttctcctgcctcagcctcctgagtagctgggattacaggcacccacgaccacgcctggctaacttttttgtatttttattagagacggggtttcaccatgttggccaggatggtctcaagctcctgacctcctgatccacctgcctcggcctcccaaagttggtgggattacaggcatgagccacctcacccgtcctaaaaactttttaattgtggctactagaaacttaaaatgaaatatgtggctcacattcgatacctatgagtgctaattcagtctatcagcataaggatgcacgcttgagctgtgaatactcattgtaatcataagtttgattcagcatcgctttgatggtacaaagtaataaacacgcaagggaaagcccttggtcatcttgtcttcattgggacatacctggggaagtttaaggaaaggagaatgaaggtagcctggctgtctcatatgacttacccaccttagcctgacatgcatcccctgaagggaggtcttctcctttagctttctgctactagtccagtgtgacccagctttgggagtattttcttcatactatcaaaaacatattttcctcatttagaattttgtgtgcacctacttttcccttgtaaatgaatatgccagatgttttggtaacagacacgtgaacaagatctttgctgcttacaaggacccctttgtaatgcacattgtttatggaatcacaaacaccagctgctgccccagatcagagtgaggcatcttggcactgccatcctcaggcacacaatggcagtttctgggaggaaatgagacttctgtatgtgtcgaggggggtcgtggggggctttctttctatagtcctcttgccccctggtgagaacagcttttatttttaagtaagaataatctgagttttcattcacttctttcaaacttaaagaaatcacccaaggtatggtacataatttagctttcttttcaggttgctctgcacaccctgcaaatagttggctggcaggcagtgaggtgaagggaagaacatcagaattggggacgagggaaacctttaacttgtgcttttaaaacacttacaagctgatgtttattgaagcataatttgcatgtagttacatatgcagatcttaaatgtttgattctttgagttttaataactatatatatctatgaaactactaccccaaatctagataaagaacatttccatcctgcctgccagattccctgtgccctttccaatcaatcccctcctaacctagaggttcattttctaatgccacagattttgtttttcctttttttgaaagaatagactccactggtatgtaatcttttgtgtccggtttcttttgcctaagatgatgtttgtgagattcacctgcattgttgcatgtgccagttcttagttcccttcagttgctcagtaggattctattatgaatatactacgatttattctcttttcctgttgatggagattcagattgattcagtttttagctattgtgaataaatctgctatgaatgtttgtgtacaagtccttttgtggacgtatgtttttattccgcttggtaaatgcctaggagtgggactgctgaatcacagggtcacctgtactttttgaaatggtcaatgggcagaactgcgaccatttttatcccgtgggttgtaaccagtgccatagaagcagttcaacatgggaggataattttgggccaggactaataatgctttgcatttttcacaattccctcatatatattctttcacgggaacttcaaccactgtggaggagataggcaaggaaagcgttctctccattttaatagcggatgacgctgtgactcagagattaggtgactcgcccatcatctgtggctgctaagggtagaaccaggactagaaaccagggatcctggctcttggtccagttccaattccacgagtccgttctttctggaaaggcatcacaacacaagacagcaagaatgagagggtcaggagaactccctcaggaaacgtgaagctaagtactttacaaacctgttcattgtctttgcagttgacgagccaggataaaacccccgctgtgatccagagagccatgctgaagcacaatctggactcagaccccgccgaggagtacgagctggtgcaggtcatctcggaggacaaaggtgggcatccttccgagacaggcatgttccttcccagggcaggtggctagcacatgtccacagtgctccgcgtttagaaggcagaaaacggatacgtattgttttattgggacctagtggtggtttttgatagtgcaagggtgaacaaccgtgccatcacctcacttgtggaattaagtatctcaaaccgctctccgattccccagctcttgtttttcctgcgattttgatgagtatttcttctgcccagtctttctgagctcttcaaacacttttctaggaagaagtgtctccctgtgccaggaggcagagggtaggggagtctgttgggcattgcaggtggccacacacctcctttacccaagaatgtgtttctaagttgtgtgtgaatctgaaatttagtggttcctgtaataatttctcatcatttcaattaatcatgtatgaaaggtattttctttattcatgatcaattttaaaataacacaaacctctaacttgaaggttatttacctcacatttattgaggcaaagaactggtaatctatgaaaggcttcaatatgcctgggaacatattatttaaagaaatctcttttatgaaatactttttgggggaaataatcacccttgcatgtatctgtctgctaatatgaatttggggattgtatttgttgagagaaggaaacaggctggtagaaaactcctctgtaccttgtcacttcacagacagtgactgtcaggataggtctcttctccaagtgcagaaggagcagcaaatattgttgaccgaagccaaccctttctgccgccagaccccaaactgtccattgcagccaccttaagtagtcctctgctcaccaacaagcagtgtcccctataagtgagaagcattccacaagctaggctatgggatcagcatgtcacccagggctctattgctggtttagaggagagtggctgaaattagaatactaccttctcctagagattaaaagctacagcctctgggaaaattctttttcagtttcctcttggaagatttctcattcattcagctgagccttaggctgtggggcaacactttctcagttataaccttttgatgtaattataattataattctaagcctaaaagatggtctcaagttgtaccattttgcttacaacacagcactaaggtgaggctggtgggtctaaaggtccaggagtctcgaggggtagccaggacccagtgttgcccaccagctgtgtggtcctaaatgcaagctgctggacccccgggccttggtccttaattagagacaataccctgctggttcctcatatatcacagggcgattctgaagataacaagaaatcgtgtacctgaacatggggagacactaagtgatatataactgtgaggactattattactgacctgtgagtatgtgggcagcagcatgggacactttgaggggattgttctccgctgagcctttgtgcacagaatgtacaggagtcacttggaacctgctcatatcagtcttgttgttggatatcaatgtttgaagttaacttaagactcaatttgtccagttttacaaccatatgcctctctggttgcctccccgaccccactaccacagagctagacttgcacattttaccttttttaattctgtttgttttttcaaatactcattacacttgagtgctaaatactgtataccttcttgtggcgattactcaaggatctagaaccagaaatgccatttgacccagcaatcccattactgggtgtatacccaaaggattataaatcattctgctataaagacacatgcacacatatgtttattgcagcactattcacaatagcaaaacctggaaccaacgcaaatgcccatcaatgatagactggataaagaaaatgtggcacatatacaccatggaatactatgcagtgataaaaaaggatgagttcatgtcctttgcagggacatggatgaagctggaaaccatcattctcagcaaactaacacaggaacaaaaaaccaaacactgcatgttctcactcataagtgggagttgaacaatgagaacatgagaacacatggacacagggaggggaatatcacacaccggggcctgttggggggtggaagactaggggaaggatagcattaggagaaatacctaatgtagatggcgggttgatgggtgcagcaagccaccgtggcacatatatacctgtgtaacaaacctgcacgttctgcacatgtaccccagaccttaaagtatagtaaaaataaaataaaaattaaaaaacaaaaataaaagtgaggctgggcatggtggctcacgcctgtaatcccagcactttgagaggccgaggcaggtagatcatctgacgtcaggagttcaagaccagcctggccaacctggtgaaacccgcctctactaaaaatacaaaaaaatacaaaaaaaaaaaaaaaaattagccgggggtggtggcacacgcctgtaatcccagctacttggggggctgagacaggagaatcacttgaccctgggaggcagaggttgcagtgagctgacattgtgccactgcactgcagcctgggcaacaagagcaaaactccatctcaaaaaatataataataataaataaataacttaaataaataaaataaaactgagtcaaaataactttgctttgatgatttcatattacacttggaacaatccttgttcaaaaattacagatgtctagttgggaatcattgaaattgaaaatagtttaaatattaaaagaaggggatatttgctgcaatatttgctgctccttctgcacttggagaagagacctatcctgacagtcactgtctgtgaagtgacaaggtacagaggagttttctaccagcctgtttccttctctcaacaaatacaatacccaaattcatattagcagacagatacccaggaaggggagcatcacacactggggcctgtcagggggttggggaaaaggggagggagagcattaggacaaatatctaatgcatgcaggacttaaaacctagatgacagattgataggtgcagcacatgtatacctatgtaacaaacctgaacattctgcacatgtatcccagaacttaaagtaaaatactataaaataaagatatgcacgttcagcacatgtatcccaaaacttaaagtaaaatttttttaaaaaaatatacatactttcctacatgggaaataaaatactcgtttgacgggattacttcaaaaaatatttcaatatttcaagtagaattctggagtgctgtagattttctgttttttctatgtcattggattctcttagtctttgagaaaatctgcatactggggtggaaaatggactgcaggagaaacgaaacccgagttcaaatcccagttctgctattcactagctgccatcttgggaattttctttaacttttcttggcctctgtttcctactgtactttttttctagttttaacattttctattggaacatttaattcatggagcgaatttctaaaatctcatttgtactaattttttaaattgggattgagaagctggggccaatttttggggtagtgatggtgatcactgtctggttcaggtcacattccagagatgaagggccgtagtcccgttcttgtgtctgggcaaggtttacagctgccgttgtcagtactgagctgacctccacaagctgaccatcttatctttccttatctttttcagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaagggattgtatctggattattaaccaggtgggttttgggttccagtgtgtcagtaagcttttgggaagcccgctgaattggttggaggagcacagggaaagccagtggcagagttaggtgggatcctccccactggcaagtgtcacaagcctttgggggaaagaatgacttccttaggagactgcagtcagagatgatgccgttgctagattgctgttcttagggatggagtctcactctgtcgcccagactggagtgcagtggtgcgatctcagctcactgcaatctccgctgcaccagttcaagcaattctgcctcagtctcctgagtagctggtattacgggcgtgagccaccacacccagctgatttttgtatttttagtagaggtggggtttcaccatgttggtcatgctggtcttgagctcctgacctcagatgatctgcccacctcagcgtcccaaagtgctgggattacaggcatgaaccaccgcacccggcatggggacacttaataatccaacttagagtgagggtccaagttagcattttgtcacctttctgagagcctttccccgcattttgtgatggataccacctgcataattcttgaaaccgcccatggtgccttggaagccagggggacctccatggagggaggaaaggcattcccgaaagaattacacttgaaatccttttaaactgatccatgcagtttccccaaaggcattacgtctgaggccagcttcactggacagatgcacagtattgtcatttatcatactgttaaaaagttcccaggattattttctagtagatttctaaatggatccaaattatcaaatgttctgtgcccttgtggaatttttagaggaagccaagtagaaattttaataataggaaattgataatatggggtagggcagaaaaaaaagggaattttgtctttggtacttgttttttcaagatcattctaaaagcctgtttcccttgttttgcctttttctagaaactgggcctggggacagtctgcctgaaggaataatgtcttaaacttgtcttctttggaacgtttgtaaattctccctgcagcgcaggatcattaggaggcatacaatactgctttacgtgtcctgatttcagggggactgaggaggttcctgactcaaacctctttttcttcagatgcctacatttccactaggcaaagttatttccattgcattttgcattgcttttccccctagacatctctcttaaaattaaatacctttggaagggatgtgttaggctaggctaggctggaccgaagtaacaaaccaagaaatttcaacagcttaagaccgaggtttattttttctttcacgggacagtgtaatgcaagccaggaaactccttagtagcttttctctaacagcagctcacagatccaggcagcttccatcttgcaacttcgccatctcggtgtttcccttccagtcacagtgatgataaagagagtaaagagaactcacaaactgttcccaactgccttagaccaaagcgacacctgtcacttctgttcacagcccatcaaccagtccccgggcccgatgtgagtacaggggaggtgggaaatgcaggagaaacctggaggagttgatgaacacgaccacctctgccacagaggggtaatgccttctcctagggtgcacgggtttgttcaccgttggcagtcatcagaaagtgtttggaagagatggcagtgaggacttgagaggaggctgcacagaacagaggaagagttgaagaaagagagatgctgaaaggagaaaatactagaaagaacaatttaattttgtctagaactagccttgatcttattttttaatttaattttattttttggacagggtctcactctgtcacccaggctggagtggcgcaacctcagctcactgcagactccgcttcctgggctcaagcgattctccaacctcagcctcatgagtagctgggactacatccgcaagccaccaatgccctgctaattttttctttttctttttttttttttttttttttgtattttttatacagatagggtcttgccatgattcccaggctggtctcaaactcctgagctcaaagcgatctgcctgccttggcctcccaaagtgctgggattacaggcatgagccaccacgcccagccaatctaatttatttttaatttttaacatacagtcactcaccaacaatttattttcttctgatgtggttcctactttgatgacactaggagctactttacagatgtagttgtaagtcaggttaaaaaaagaaacctaggaaatgtaaagtatttacacaaaacccaacagatcaaataggagccaggcaaatttaattattttagactcacaatttggcaaccattattgggtgtggtttctcaacatctctacccagaaacctttgtggaagcaagtttcttacttaaaatttcaaggaatccaatgtatgtaatgttttcttaagagtttgaaggcaccttacaaatcatgtagtcagtggcctcgtattatagatatgaggctgagacacagaacagttaagttgcccaagttttagggacagagctctggatcatcaaaccccactctgagcatatcacactgggccaggcactgaatggaggaggctctcctgacagacacttccacagcctcacggaactggagagaatccctgggatctgtgggctccatccccagccttccagtcacatgaattcccacaaactatctcggtcagctgggcacctggttggttctttgaagtgtctgaggaacattctactgagggtcagagcactgccacctactatcctgagcatcatttccatcccacagatgaggaaatggccaaaaagatgattattgtgagttagcaccccagctggattggaatccatttctgatctgtagtctcgggtgttccccgggggtgcctgcagcgggagaaactcctaggagaggcatcaactgacaggagttaacaaaggaggagcagatgggactggggcttgagtggcgttcaggagagccagttttaagaccacctggatcagcctccctgtaagccagttatcagtatccaagtgctttaacacaggcttctcagaagaaatcatttttattcctaccattatttcataccaaagcatcattatgtgctacagttccaatttcttacacaagaatgaaaagggttaccaatgcagcaagttaaaaaaaaaaaaaaagaagaagaagactgaatgatttaagctgtttctgaattgttcctgccataaaaaaaaaaaaaaaaaatcaaggcaccagttttgaaatgggagaagcattctaaatgagactgttagcttgccctttgacatcgatttctgatcctcatttattcagtatctaacatccaagtctgcagaaatatgttatctgagagtttgcagtatgaccagctgaataatcagtatatgaggtttcacaggggagacagacatgggttagaagtgccagctttatgtatcaggctgtgtgtgtgtgtggtgagacagagtgcaagagtgagagattaaaacattaaattttactgagaaaacaagaaatgagacacattatcccccagcagcttggaagtggatgcagtttggtgagatctgactgcctcggtctgactcccaggccacttactaccttaggcaagttgcttcccttagctctttgccttatctgaaagatagagattaatgaatagttcctacttcttgaggttcatgctgtattaaactacacagcacacgtagggaaagtgcggttcactttggtgcatgatacaagagttagttgctgttattcctgggaagcttctggcctaagggaagtcatgtcttcaaagaagccctccaacctcctcccgggaggagccaaatggtccagacgtgaaactcttagaggtggggcttccacgtgtggaacggcaccctgcgaaaagctaagcctgcttgctgctctggggagagactgactcacggagctggagggcgtccagggctcctgcagcttgttccacggctggggtccaaaaaggctcacagagacggggatgtgggcccggcgcagcctccctggccagcctgcaggctttgcagtgggcactctcgctggacgggctgtgacaggagaggctggctgatgtcaagcagccctgggccggagtgtccctctcagggcctgagagatcggccaccacacagagctggcagcgattcccatgagtccccacctccttgggtggatttttctcaccagaaactctgctccctgctcctgggtacccccttctgtgtctgtccacagtccctgtgtctttcctacaggaaggggttctcgactctggttccagaggccctgtccagggacaatggagatgcttgattgtgagttattgctcttccccaagcattgggggcactggacatttcacttgttcctgtgcaagcggttcaactcaacaccaactcaatctctcccatagttgcagacttaaaaggataaaactctaaggacaaggctgtcaccacttccatttgaagcctccctcctaccacactattttccccattggttccctctcctctttcttggcctgtgcactggcatcactgtctccagcgatgggcttgcattagtctcttctccccactccttgcacttctctcccagactgtgctctgagcaccaggactttgctccgtgtgtggtgcgctagaagctgcctctttcctctcccctcggattctcaacaggcttgcaccactctgtcccttgcactcaactctgctcatggtttcctcccctgagctaggcctgagcaacaatatcatccccttcaagtcttcacaatttatgctagcaatttttaaaagcagttaaagcccttcaggccacaccatcaaaatgcctggacaactgaactcctgtctgggggtctgttccaaacttctcatttccttttgggagaagaaactgtcgctgattaatttccaagcatctaagaacagagagagagagagagctgcccactccactttgaaaatcaaattcccccactagtaagagcccagacatccacccagccacccgtggaataggaaacccccatcaaagccttgccaggtccatgggggcagagctagtgctctgtgggccctaggattgctcagacatggtaagtttactaaagcacctgttccagagaagccaggctggagaattacagggacgggcataaaaacaaactccataaattaaaaataaagagaaggcaatcctcagagacgattcttcattctttccactctttttgagggcagatgggaggatggatggctttggattggaagcaacacagctggtgtcacagaggctactgaacaaagatcagctcacatattagcacatccatgggtggaagcaaaatactagggcatttcagtaattcacagagcagaaaggaagccactcttctgcccagcaacaaagtttaatggagccattccaccacttaccttggaaccccattcagtgtctgacaattctgtcaatgaattcttcctgaaagctcacctaaactcctcttgctctgtccctgggataagagggagcaccatttttcacgtaatcttttgtaatataatgtactaaaatctaccatcattacttctctcttctccaagcaggtacaaaaggacattgtccacactttggttcttgtctcagctgccctacactgacttagggccgcgggctcacagggaagcccctcatatgcccctcctctcctgctggccttcctccctcagctgcatttaattgaaggacagccggttcccctgaaataataaacatcaccacaaaacatcatgtgggcgtgacatttccaaagctgtctactcttagttttcagaacgtgtcaccccttacatgctattttcttctcatatagccagcctcattttaactttactttgtcattatttaactccttagtgaattaacttctgtcagggagatcacttctggatcatttctttcctctgtttagttggcaagaatgtctcaaaagcacgttatagaaagcctcctgggaagacacatctttattttatagttactagcgggagggatttgctccaatcataagggaaaaaccataagattcccaaatttgtagctgagtgggaatatttcttgttttggacatcaacattttactggaagcctctgtattatctgtcaagatggtaaccaaacttagaattctcccagaaatgctgggctctgtgcttatgatgagacagccctgagaaggagacagccctgagagggaggcagccaacttgccttgccagcatgattgtgtctcagtcttgtttgttatcaaccccaacacatgcctaactcttctgccctactgagttcccatgaatcccactttggccctttcatagtcctgtcaggcaatgcctggacagcatctccacccactgtgcccagccctcctccctcttctgaactccaattcatcctccaaaacccaacccaaatgtcaccttctcagcagagctgccctgacagtcctcctctgcccattttgttcatctctgaaataaaaccatcctgtttggcagccacctgctttatgttgctcctccattggactgcgggccccacacagcagtagggaccttacctacttctctgagcatctcagtgcccagcacaaagcctgcagcaaggcagtgttcacagcctggtttttgagattaggggtaagcttgatctaaaaattcaagcagtcactgagatcaacaaggattttctttttgttgctgctgttatttttccccaggaaaaagctctttggccttggactggtatcacagtatctcagtatcttttgatgaacggataggctgacctgtagcacaaaatgcaagatggacacctccactccctcccagtgggggctctcttccatctttctgtaccttggaatccttttcagcttacataacagtacccatcagtttaaaacaaccctcactgcacagtaagggcagcaaccaccctcccctcatttgccatggggatcacacagcagtgatggttccccctgactctgacatccttggtcaagggcagacctggtaatctctgcagcgttggccattgatcagtgcctgcggaagcaattgacaatcatatctttgagctaagtttttttttaatttttcacaaagagctccagaaggcaaatagtttatcacttccccactctgaaatagcacgcaagacagatgatgcaggggaacgggtgtccactctttcttgttctcagagctcctgcagcaggcctgaatgaaccgcaagcggggcccatgcagcgtgtcctctgcaaagtgcaggtgttcagtccacacacagcagcaccagcactgctgatgtcacggttgtctgtccagaagatcccacgttagatcccaagagaaatccagacagggtttagcctccagaggcagagagcgggtgccaggcccagatgcaaaggcctctatactgacgccctcacatgacactgcaaaggtcaaatgtcaaaggtcaaatgtcttggcttaggactataagggagagataggacaaataatgaggtcaaggaacctctggattgctgaagagatgactttaaaaaaaaagtcacatctgcggctcacagtgttcaccagaaaagaacactgcttgggattctagacctgagcagggagaaacaaaccgggctaaaggagacagaactttcttcacagtagaacagtcctagtctaaaatgctagaatttaagtccaaagtcttttaagaatgagagttcttaaatctgtcagaccagctgacaggggaacaggaaaaaaaaaattctctattaaacaaaacaccacaaaaatcaacccaaacttccttcaaccccagcaccccagccacctcccaccccattaaaaaagtcattaaagtcatgcacacatgcacacactcaaatatgaaaacaaaaaccagatacccaaggaaatcttaggaatcacctaaggaattttcactcgctccccagatgctctttctgtttttctgggggtgggtgggaaaggaagtcacactgacagctaagtctaagcggcacaatttagagttgggtgagttccctttcctccagcggcctagcttgctggtcagtgtagaagggtacccacagtgagtcgggaaggaaggccgaggctggcgtctggtggaaggcaagctgcctcttgtcctaaagtggggacccgcccctcacctggggagatgaggctgccttgactacctatttggtgatgagacagcttggtgatcactttctctagactctgagccatgctgttcaaccttaatgtggcaatcagtatcacatgggcagtgaactgaagaattaggtgtctggcttaaagtgtatcttacactcgtacactaagcttgtgtatgtagcaccacccgcctgtggactctgctctgaagggccctccccatgagtttaagtgtgaagctcagggtttggggtgtgcacggccccccatatggctgcatggtgcatggacagtgatgaggaacggtgctggtatgggatgcctgggagggtttttctggagacaaaaatttacagattgagggcatgagaacataaacttgagggaaaccaccatgatctatactaggatgacagattgtggagtgggaagaaatcgtgtagtccaactctgcattttacataaaatcaatctgtgaagaaagcagaaaggactcttaggggatatcttttgagaaagggtgtccgcctgggattctaagagcttccctggttgctggcctaaatcaggtgaccagccctttgtttctgaccaggtttctcacctgagatagagaatcatttgtttccaaatagttcaaatccccccatccacaggcctccccacaagagcctggctgggaaattcaggagaatcagattgccgaaccaatgtgtccacacccaccactcccccgggtgccgtggaagtctgcaacatctgtttctctgccttatcctaaagacaatatcttcgcccattttgtaaaataaataattcaaaatataatgaaaaaactctggcaaggatagttgctggcctgaaaatgtgctctgtctcttagcagtgactcacagaactcacacctgcggtgggttcccaggctaaggggtggagcggagagcgtgaagctctgtagcagcgcgcaaacccgggacagggcaggatgcacagccagtcctcaccctttatatattacatttatctttataaatagagcatcctgactcgagtggccataataaaaaagccaaacattgagttttttccctcaaatacctacacaaactgtcaaatatctactaaattatatccacatggcaaactggtcacctctatatgagaactccaactgccatgatggtcacaggccaagtctcagtcggacccaaatacccacccctactggataacagggactaagattttttttttttaaaaaatctacttttcaataagacttgtgacagaatcctttaaataaaaagccaaataaatatgattttaagtgattcctgtcccccaaaagttgcacacacaagttttcaatgtcatataaaacggacaaactagaccaataagtgtggtctagttggcctggctgccttgactacatatttgctgatgtgacagctcggtgatcactttctcttgaacaagactctgagccatgttgttcaaccttaatgtgggaatcagtatcacatgagtagtgaactgaagaattaggtgtctggattacagtttatcttaacagtttccaaaaaacctgtctttcagccgtcttgggaaatttgggttgaatttccttatttccttccatggtcaaaaatatgttaatttcgatctatcacactagatcactttggttagatgactgtgaccactaagaacaaaacaaaacagaaaactggagcaaacagatgaatagccctttagaaaaaccagaggatgttgaactgatgtgggccacactcccagggagccttcatagctcatcccttgaaggcacagtgtccagggaggttggcggtggcagggcctctgtgttcttggcattgctgtagatgcggctttgcttccgggacttccaggcatgtgtcctatcccagtcggtggccactgtctcattgtcccagatggtggaggtctccgtgtcactcaggtaccccggctggcctgtgtagtgcgtagggtagatgagcaagggttctgcagagaaggctttcaggtccctggattcataatactccttgtactcggctctgaaaacaagaaggtggccggacacatgagggggcggaaaggagacttacggaacagggacaaagagtgaaggaggcctcctggttacctcatgagttcatttcattatttcaattgtgtcatttgtgaaaaactttagcctacaaacacaaatatttctttaaaagctttccaaagacaagctcccaagcaaaaagatcaggacatttctgacgtatttgaatagactagtttaaaagatgaatttcaggtctgactccaaaagttaaaaagtaagccctgttagaccataatgataaataaatacgatcacttcaccaaaaatgccctgctttgggattaataaatgagacacctcacatctggacagcagtgatggggcatgtggcacgtggaggcttagaggcacgcaggcttggctttgtgctctagctccctgctcaccactccggttccaacaggtgtaaaggagacggatgacttggcctccctctcagggctcctgtgcagagtacatgaggtgacatctgaatgtagtaatttcccttttgtttaggggataatggtttgacctccatgtttctgctaggacacagagataaagtcagtctctgacatgttatatacaagagggcacacaactccatttttactgaggacaagagacaaaatgaactggtggcagcacaggaaatctcaacagctaaaatgagaccatctagtgacgagatcacccagcaactgagagaaggggccaaggttagaacgaatgctgctccatcaatgaatttaggaatcattcattaatgatttaggagctgctgttatgtgtagcatttggactaggctctaaggacacagaggcataagactgttactgccccaaagggtttatagtttattggggagattgacaggtaaatcattaattgccacaccttttgataagcgctaggtcagggtaagctcctgggctatgggagccccaagcatcacactgcccttcttccatggacatcatgctcaggtatcaggtccacactccctgaacctcttacacacccctgcgattgcaggaatcacaatatatcatgatgatttgttcatgagtctgggttcctgaccagattgtgagctatgcaaaaatgggtatctctgcttagccaacagtacccaatgacctgagccaaaggaactggaaattttgaggtgcttaggaagatggccttcaccttgaggtgtatgaggttatggaaataagaagagcaaagacaaggaggggaccaagcacattacattcagttcaactacaaactggatattacaagaatctctgggcaggacactcaccatctctgcctcaccttcccatctgtacaaagggataaatcacctgagttaggctctcttaatcataattatgagaagatcatttaggaaagcagtacaactttagaaaatatcaagtactaccagaaatggagagcataattcatgaagaggctgtgcccaagggaaggcaggcagttcagggagactcacacgggatgcttgttgtacatgactggcagaaactcatccactggcagcatcttcccaaaaggattggctccaaccagcttctgtgctccttccagagagatgacgtagcccagggtccagtaggaatagtcggcttcgaccaggtttgccacattgggcactgctttctctggctcctttacttgcatcctcttcctaccaatataactgtaaggaaatggcagaggagaaaaattccaccttgactattatgccatgataaggatgaagcacagctttggtttacatagatacctctgaaatcctggactgactctgtctgtcattaaatgatgtatcacatccaaaagtggatccaatcgccagtcaggactgccatctgccatcactggggccattttgctagctccatttatcaacacccccactattcctgcctagtggacggttttcaagacggaaagtaagatgtcgtaagattaaaagatctttcagatcatttcttaaagatgggatggggcttccagctgtgtttacagaggttggaaaggcacaaaaaaaggccagatgggagaatcctgaggctgctgtcttcaggtccccagagtgtcagccttggatgccttctgcacagcactccgagtgctggtgggaaacacaggaccaaataagctgggggaaagagtcagtctgcagtgaaggttctgggaacccaagagtggccctaaggggttccttttggggaggatgaatgacagctcctgacaggcattctcctgcctcacactcgtccagctgtggccaggcttcctcccagacatgctgctctgagaaaggccccccaggcaccttccgtcctccgtgaacaacttctacaacacaggatgcacctttggccactcccatcttccctagtctacccatggatctgtgctccattacttttgtccggaacctattgatttgggcttgactggagcaacctgaggagttgcctccttcttgcctgccaggtaaagcagtacttcctctattttgccctaaaacaatctctttcaacattcaagggattcccccttgtgaaagcatcccaggatttgtagaacaagtctatgttcaatcttcagttcttctgagaacaacaaacatatatccccagccactctctcttcagattacggagtctgagcttctctcgtgtctcatccagtggaagggaaactcttatcgagcacttgagaggaactagagtgatagaggtgctgagttaatgctctaactttaattaatttaattttaaatgttgaagctgtgtgaaatatatatattttttccatgaaacaagttcattgttttggtaggacgacagtttactttttttttttttttatggagccttgctctgtcgcccaggctggagtgcagtggtgcaatctgagctcactgtaagctccgcctcctgggttcatgccagtctcctgcctcagcctcctgagtagctgggactacaggagcccgccaccatgcccggctaattttttgtatttttactagagacgtggtttcaccgtgttagccaggatggtctcgatctcctgacctcgtgatccacccgcctcggcctcccaaagtgctgggattacaggcgtgagccactgcgcccagcccagtttacttaaacagctgaaaatttagcttctggattgagaggtgttctaagtgtaaaatacataccagattttgaagagttggtacaaaaaaaaaaagaaggtaaactatgtcattaatggttttaaaatattaattacataccaaaatgatgatactgtttggatatttttgttaaataaaatgtattaaaactaatttagtctaatttatttttacctttttaatgtgattactagaaaactgaaaatgacatatgtggcttgcattatatttctattgaacaacactccctcaatgattccaatgacttgttctattcttcccttttattattttcttttcctggaaagatgtaatgtggcaatcatgaacagcttattacctttcatgttttaggtttaagtaacatttgtttcttttttgttttagaaaataacaggtacaatttaaaactgttacagttctttaagactatataatagattttaaggggatattttgacttgatcaacctgtgaaatttagaaaacatttttttcctgtatccttatcaagacaactgttcttccttcttgcatctgtcggtactttgtcctgagaaatgcacccaccgaactacatgtgaacgggaacgtatgccagctctaaaccttagattctctgggctcagtcttctgtgattatgaggcttaagtgaagttgcctttatacaagtcacgtggacatcaagtagcttccaggcctgtgaggccttaaccacaggctgcggagccatccattgagaaaggctgaagtgcagcgacttctggaggatataggaagaaacagtgatctcaagggactgtgcagaatgccaaaccaaaccacatgaccacatgactgaaatctgacagggcataggtgtcttattacacagtgacgcattagttgagccattgctaggtttcttctgagctcagagtggcccattttctgagggaacaagtattccacctgggcccacagttaaataccgcctgtgggtgggagaagcagggacagctcctctgctgcagctgctccaaagaagcaggctcagagttgatgaattgcctttgacacacagctgggagcaaacacaatgcttgggaactttctgcttcattggagagaaattgaaagtgtcatttgttttaaaaagaaaatgagagagagaaaggaggaggcagaggaggaagaagaaaaaggaaagaggaagggagagagggagaggaaaaatgaaagggaagggaaggaaaaatgaaagggaagggaagaaaaaagcagaagccactcaattcccagagagtagacaaagaacattaactaaatgtcagctcagagccagcactcccttggtgagcctggttttcctgcatcagcctcagacccttccccaaatctagttgtccatgttcttcatgtttgtgcagccccatttcccaacagaggagctccctggctgaccctctaacctcccaccttctcggaagctgcagaggcaacctgctgtcccgggagctgagtcttaaatatgacacaggactttagagcttgaataaatggcctcttctccagcttcacacccactccatgtgccacgttaattgagggtgggatttctgctgtgctcctaagtaagtgctcagtgccacaccttggttctgtctgaaggtccctgatctgcaggccgactccaggtctcagacaatcttccacagtttcccaccctgaagagtagaaggatgcaaaatccagtggctaacctctacccatttttatttctgagaacatttatggaaagaaaactagataagtggaagcttaagctgtatctcctactggctgtggaggtggggctctctgcgcattggaaaggactgagtgcctctcagagccctctcgtaagatcatcttgtcactcacatcagttcccagtccagctgagcctggtcaatgttatccatcagcttcatcagcttcttcttaaactgatgctcaaaacgcacatcgtcttcaattacaagagtcttctctagctctcgatcaattacctgcaaaagtcatcagtaggaagataccctatgaaaagtttgaaacccaatttttattagataaataagtattaaaaagtcacgagtctagtagcacagattcataactggaatctaagcaaatggccatcaacagtagaatagataataaactttggaatattcacagcagtgaggatatatgatcacaattaaacgcaacgttataggtgaatctcctaaatgtcatgttaggagagtacacatactgcatgattccattcatataagggaaagtacaaacaaaggtaaagctattcaatgcctttagaagtcaggatggtgactgcccttggggactgatgaccagaaggcagtacggggtgggggggtgcttgtgggatgctggttacctgcttctggatctgtgtactgattaacatgggtgtgttgtttggtttgtgaaatttccctgagctgtatcttttgatctatatctttttatacctatttatcacatttcacttaaagtttaaagaaaacaaaggcaggcatagactggatcattaaaagagaaagtgttcaaggggcctttcttcagggactttctttttggttgtggaaactgactgtttatcaggaaccccacacaccaatatctgctccagatatgtcttgatctgtaagacaggggttccacttctggctctgccacttcttaccgggtcaagctacttaataatttcttcttcggtaaaggtggtctgtccttcccaacccacctcacatgacttctgtgtgatttcttgtataaaatcacttaataagtgatgtcataataggtataatagaaggcattcctgctaatgatgataatgaattaataagagtgtggcacacaggacatgggtgtctcccccgtcaccaccccaagtggcaccaaagctactcctccttgcccctttgttgctggtcttgggtcagagggagacacaaggcaggagcagctctcatgcacatttccagaacagttgcgggctcactttacatctggccctaactcacctacgatagcctgctttcctttctcctcatcataaaactgcaatctgaataaagcattatttacctctttccagactgagtagtggctgagaaagcagccgatttcaccccttgttagaggcctggaggaatagggatctcgatagccaggcagcatttcaatattcagtgccttcagctggcttgtgttgagtgccctgcatcacataaaacacgtctggagattaacaagtcaaaggtccccaccacaaaggccagagaaagagagagttagttctgcaaacacccctcccccacacagacaaagacagagaggcttccctttattccttagaagttcctccaggctaatgtgtcacactagtattatgaggtctgggaagacaagagggtatcatatttttgtgtatccctcatagtgcccaacatagttctaagcatcatcagttttttgacaagatttaataagtacactcctatggaaattagttaaagtactgcaataatccaaggagtgtttgatcaagacctactgctgaatctctgttaacacagtgagctttgtgaagttcacagctgccctaatcctaacctgttcaccccagccctacaaaagccttgaaaaccagtagcctcacaactaagagagcggcaaaccccaccaacccagaagccactggcagggacaaaatggactgagactcccttaaagacctgcccccagaaaataatctctattcaacctgtctagtagctccttgaaaagctacattctcagagcttgtcttgatttgacctgactcagagttcattttctgtgaacagcactatctgcaggtcatttgtcaaaacccatgagcaacaactgtttaacattacagctgtttgagaagcattatcagctgatgctaacaagaagcccaccaaaaaacttaaaaggaaaaaccaaggaataagaggtccatagggagtttgatttgctccaaaatatccctgagaatctagaaggccccaggcatattcagggctgtccacacgcccaggaaaaacttgagaagtccctagtctctcacctctggctgaccttaaggatctggaaaaaaatgtagtgaaggcaaatgaataaaacactgcaatgaaggaagaatttggcatagtaagttttaaaaattaatacaaccatgtggtatctataagaggcagcctttagattaaaagacaaaaataggttgaaagtaaaagaatagaaaaagatataccatataatcagcaatgacaagagagctggcagagctatgctaatattgggcaaaataaatctcagacaaaattcatgctagagccaaggaaggacattttttaatgataaaaaggttaatctgggccgggagtggtggctcacgcctgtaatcccacgactttgggaggccgaggtgggcagatcagaaggtctggagatcgagaccatcctggctaacacggtgaaaccccatctctactaaaaatacaaaaaattagccggccatggtggtgggtgcctgtagtcccagctacttgggaggctgaggcaggagaatggtgtgaatctgggagctggagcttgcagtgagccaagatcgtgccattgcactgcagcctgggtgacagggcaagactccatctcaaaaaaaaaaggtcaatccatcaggaaggcataacaattataaatacatatgcacctaacagaacctcagaaccatgaaactggaagaattgaaaggagaaacagacaattcaacaataataggggaagacatcaatatcccacctgcaataatagaactaggcaggaggaagacaaggaaacagaagacttgaataatatcttaaaataatcagacctagcagacatctatagaacattccacccaacaatagccaaatacacactttcaagtgtgcatagaacattctctaagaaataccattttttagaccataaagaccatataggtcataaattaagtgtcagtatacttaaaaggattgaaatcacacaaggtatgttctccaacctcaatggtttgaaattaaaaatcaataaccaaaggaaacttgggaaattcagaaatgtggaattaaacaatacactcctaaccaatgggtcaaagaagaaattgcaagggaaattagaaaatattttgagatgaatgaaaacacagcataccaaaacttatgcgatacacttaacatagtacttggagatatagttacagctgcaaatgtctctagtaaaatagaatatctcaaataataatcctcccatccatcttaagaaactagataaagagaaaattaaacccaaagcaaacaggaggaagaaaataataaaggttacagtacaaataaatgaactagagaatagaaaaacaatagagaaaaatcaacaaaaccaaaagtcagtcctctgaaaagatcaacaaaattgacaattatttgcctaaactgatgaattaaaaaaaagtaaactcaaactattaaagtcaagaatgaaagaggggtcactcctactgaccttatgaaagtaaaaaagattatatgataatactatgaacaattgtatggcaacaaattagataacctagatgaaatggacaaattgataggaaggtacaaactaccaaaattgactcaagaagaaatagaaagtaaataaataacaagaaaagaagtttaattagtaataaaaaaaatttccataaagaaaagcctagaaccagatggcttcactaggggtttctgccaaatgtttaaaaattgttaacacgaatctttcacaaacttccaaaaaaaaagaggaggagggaacacatcccagctgattttatgaagccaatattattttgatacaaaaccaaaaacattataagaaaactgcagaccaatatcacttattaatatagatgtggaaatcttcaagcaaatactagcaagagaatccagcaatttataaaaggaattatacagcatgaccaaatgggtcccaggattatcccagggttgcaagtttggtttaacatgtgaaaaccaatcaaagtaacgtaccatattaacaggcaaaagtcacatgttcatcttaatagacacggacaaaccatttgacaaaatccaatacccttttatgataaaaatactcaacaaaataggactaaaagggaccttcctcaacccagtaaaggccatctgtgaaaaacccacaattaacatcatacttagcagtgacggactgaatgctttccctctaagatcaggaacaaatcaagaaactgcactcaacagttctattcaacattgtacttgatgatccagcaagggtagttggacatgaagaagaaataaatggtatccaggtttgaaaggaacatataacactatctctacttgcatgtgacatggtcttgtatgtagaagatcctaaggaatatacacacacaaaggaaaaagtactattagaactgataaaaagggttcagcaaggttgcaggatacaggatcaatatacaaaaatcaattgtattcttattcatttagcaatgaacaatctgaaaatagaactaaggaaatagttccatgtaccatagcatcaaaagagtaaaatacttaggagtatatttaacaaaataaatgcaagacttgtatactgaaaatgacaaaacatcattcaaagaactaaagaagatctaaataataaaaagacattccatgattacgaatcagaagacttcatattgttaacacggaaatattctcccagttgatctacagactcaatgcaattcctatcaaaatcccagctgccgttttctttatttgtggaacttgacaagctaattctaaaattcatatggaaaaagtaagggacccagaatagctgagacaaactcgaaaaagaataacaaaattgaaggactcatacttcttaaatacaaagctacagtcatcaagacggtatagtactggcataaggatagacatatagatcaatcaaataaaatagagagttcagaaataaatccttacatttatgggcaactggctttttacaatggtgccaagacaattctacgagggaaacgaaagtctttttaacaaatggtgaagggacaaatggataaccatgtgcaaaagaatgaatatggatccctgcctcatgccatatacaaaaatttactcaacatagatcaaatacctaaatgtaatagataaaactgtagaactctcagaagaaaatttcatgaagtaaatcttcatggctttgaaattgacaatggattcttaggtatgacactaaaattactagcaacaagaacaaaaaataaattggatttcatcaaaatgaaaaactcttttgcttcaatgtataccatcatgaaattgtgacaatcaataatgcataaagttaaagaaaatatttgacaattacatatctgataaaggacttgcatccaggatatataaagaactctcactactcaactagtttccctggtccatgtggtctatgaatgggactggtgttcttggaggtatttgaagcagtggttcctaaactctactgcacccaagaatagggctgacagatttaggaagtgaaaaacacaaaacactcagtcaaatttaagtttcagataaataatggataattttttagtataaccaagccccatgtgatgtttgggacaaatttaactggctatccagtattttatggggcaatcctgtctaagaatcaccttgaggcttcttaaatgcagatcctgggtccagcctcagagagcataattcagcaggtctgagatgggactgagggagctgtccccttaaccatccgtggggactctgatgtgagtgtccaggtcacactttgggaaacactgatgagattctctaagggagtcataaaaacttcaacagctgctagccatactccttagttggagttatgcaaatagaaaacaaagctactgatattctaaaccaacatataacatggaaaggcacattttataaaaatctatgccttgaaatagtttagggtgtcaaataaaagggcaaagctgaacaaaataaaaaaaaaaaaaaagaagggatctaactaggttccctgtgttactttcctgccatatttccaggaaaagtggccactatgatcggtccaggcagattgtggcaggcatctcatgcaacaggaaatgtacacctttatgcattttccatctattttcttcagattgaccaagtttcagcactttatgctctaattcagctctgaacacaattctgaacacattccttctgttacactacagaaggctgaaaaccaccacaactgttgcaagaacccccagagacgggacaatcacatccaatgtgagccttcagtgtaatgaagaccaaagaccactggctggtgagtggatttcaggcctgctctacaggatgaaattaacttaaatgctactacaggtggccgttttgaaaataagactatcctctaatgaccgaagagacttagagccccacctgggactaactctctgtcagagaagacacatccacactccaatcacatctgcaatgggagaagaaacccaactcactttccatccacagcctcgacaatcttgacctcaatctcctgttcatacagtgtgcgcagcatccggtcccgcctgtcctttctgcgtttgaggtttatcatgaaaatctaatgcaagaaggaaaagggaaaagacacataaattactcaagtcttcttttaggctgtttgaaaagtttagtaaatgttttagatagaagaaggagtggaaaagataggaagaactgtcgtgaaaattcatttctatctcacatcagtgtttaaggtaaatgatactaattcaaactgaattattttcaaaactcaactcttcgtagtgacttaactctctttgtttttctgatgttcattgataaatatgttctcccttctcttgaaataggaaagtttaaaaaactactctttaagaggtcaaaggacaatacgatcctatgtttagaaaaacctaaagatgccaccaaaaaaccattagaattgataaacagcttcagtaaagttgcaagatacaaagtcaacgcacaaaaatcattagcatttatatatgctaacaacaatctgaaaaagaaatagaaaaagcaatcccatttatagtaactacaaaaaaatttaataatactcaggaataaatttaaccaaagaaggtaaagatctttataatgaaaactataaaacactgatggaaaaaaatggaaggatattaagaaaagaaagatatcccatgttcatagattggaataattaatattgctaaaatgtccatactatcaaatgtgataaacagattcagtgcaatctctaccaaaatacaaatgacatttttcatagaaccagaaaaaaatcttaaaattttcatggaaccacaaaagaccctgaatagtcaaagctgtcctgagcaaaaagaacaaggcttgaggcagcacactacctgccttcaaaatattctacaaagctatagtaaccaaaacagcatggtactggcataagaatagacaacacgtagaccatggaacagaatagagaaccagaaataagtgcacacatttacagccaactcattttcaacaaggacaacaagagttacagataatgaggatgtcctcactattcccagacttaatgaaccatagaagtatctaaagctttgtgaatgcctttacacgtaaatcaatgttttaataaggtccttttgctacaaatagtaagaaactcattttaaatgttaaactagtgactttaactgccagtgagaaatgaggatgacacatagcatggtaaagcagaaacctatagaaacaagtcaggtggtgttgacttcatcctgactaaccatctggatgactttgaggagacattaatgtttatgggtccagttctataaaaatagggaggtgcacaaactcatctttcaaattcagtacagattaaaatgtttaagacaggtggtttataataaagttggctttctgctatggccagaataaaggagaaactttgtcttagaaccagtctggagttcagattgtactgtgttaaggtttggttcacatggtcattctgaatgcagtcataaatatatgtttcactggaattaaaagctacactaactaaaatttcaacccttccttgcaaaatattctcatttctatccatttataaatccctgggtgtagaaactgatggaggagcaagatattccctttgaagaaattgtccacctgatttagggccaagtagattaagtgcatcctaattttactaccttccttgtttacctaactgggtaattattttgtaaaaaacataattttctgtggtgactctatttgcctcattacttgggactttataacttaatgggttgtgttcttttagtcagaatcatactgtgatgggtcatgcctcatcccctaattttccagatatggaaaggaaagggcattttctcaggtataaacatgaagccacctgaggtcactctaagagaacaaaaacagaacagaacaaaaaatcaacagaaataaatccaaaaaggcccccaaaaacagagacctccagtctgggaagactttcagtaaataacaatccagttccagtccctgccaggacaagtgcaataaaactgtagccacgaagtaaaaacacagatggctcactcacacttagtgaacagtaaacagagaaaagagcatcagagccaaatgcagcccagacaccaccagtgaggtcacagagtccgaggaggattgaaaagcccctgaaaagccctttttctaccatgctatctctgttccatacggagaggtgactaacctcagactcaggaaagtagagtctccgagcctgtgccacttcatggagttggccttctcctgaagggctctaggagtgacccagtccttacaccgtgtcctgcccaaagaagaccggaactggaagatcctggttttgtcttattttatttgctttggtttggtcctcataggaatgtttttaggaggagaaatgaatctatgtaaggacacttgggtcctttcacctagggaaccgagagagagctgtagggaaggaaagctacagtaacatgtggaagctggtccactgtgggtgtgggacaaccttctctatagccctgatcatttttaaaaactatttgcaaatgagtcttattcctctctactacatgcagctcatctcttctcattctgccctttgtggaaataccatagtagctgttaactcttccccacttaataatcatgaaatattctttcccccttcctgaagtatagctccaaatcagtcttacggaagaaatcttaattcccagttctagcgtcaaatccctttgagaaggctgtactctggggacatgtacatatatgtatgtatatgttaccatgtgataaataaggcatcttccttcgattaatcagtggcaattagcaccaagctcgaagcctgatctgttacatatccagagtccatggaagagttctcagtttgtggactcctgaggcactgccctagcttctagaccaccaagctccttctgaatactgttcagcagctacaggggacacccatgagagagtcagtgatgtggagtcacaatccctgccaagtatctgttacgcatattaccaggaggggaacctcttaatatttctgcttcattctttatacaactaaaacttaataataaatactacccttagaatattattaggaagttcttgcctgctgaaaggcagaattttagaacaaatatgtttttttttctttctttgtcctctcaaccctgctctctaacctttttccatggaagaatagtagaaataaaagaaagcacagaaagttccagaatagtttccacttgctcagatgtggcagaataaaattaaagtcctccatatctaaaacatgtatcctctgtatcttactcttgaattttgataaaaaggttgattaaaaatatcacaatatctgctcctagaaaatatcaaattcactttcattactaaatggtaatttctttctaagtaaatgattaactacatttatcatgatactcctttttttaagataaggaaactgagaacaacaaaaaccaagtagttttcccaagacctcagagccatttcagcagccaagccagtcttgctggctctcagatgcaagctcaggcttgtgttccaaaatgaacacacaagcctgcacacgcgtgcatgtgcacacacatatagacacctttcctacctcatcaaatcccatcttgtctggatatttagggacaactgagacatactgggagggttccattggaggacggtcaactggaagacacaagaaacatgcagagtgctttgttaatgaaagggtcagaaatcagaattccatccgcatgcctgatctctagggttggaatataacttggaaatacagggcaggggacaatggcagcagttctccaggattgagtagccacacaggaaccctgctggtcagggcactggtttcaggagcatttgattatatggagattgcaacatttgctccacttcccttaagacttatttcaagaatatttgggaggcagtttaggataatggttaagaggaagggctccagagtcggatgatctgggtccaaaccttggtttgcgaaggagtaggagagttaggggacctctttaagctcatttctttggtgtaaaattgggataatagaagtgtatctgtgttataaaatttaaatgagacctgcgtgcaaagcactcaccactttaacacagtaaatgctcaacaactcttagctattacttactatggcccatgatgaaagagctcagaaataggctagaatttttactgaaaaacacttttttctctgcatttaaaattgtcaaagtgggggactatttttatcccacctgggcaggtttaggtgtgggtgcgcaaaaggtccattgctttaacaggatctaaccacagagagctggcccatgtctaatgggaagattccagctgggagtgacactacttcttcaataatgaaagttttatttatttgatactctaaaaaagcttcctttgcaaactatgtattttaaagtttggaagtaatattggttaagaaacctgaaaaggccttgaagaatgtttagtattataaaaattcaaagtcctcgaagaatgtttagtattatacaaattcaaagtcctcatttgattttccttaaagggataatacaaagaaaatttaaaatgatagctggtaactgggttgttgaaagaactatgggtaatggccatgactactgtaacgtatctgttcacctctattccaggcacaggagaggaatacactctcttgcccttgaagttactcagggctatatgactttctggggaaagtttatagtgtggtgctgctgctccactctccaagggctcccccgacactgcccttggtcccaccactgtgctcatagcggcatgtgtggatatggatagcagatgtgaattggaagcagcctggaacattgcatcaacacatgaagggcagctcccaggaaagacacctgctctgcagacttggatagcaagaaataagccattgttgtatgaagccaatcagatttttatattccagcataactttgcccatcctgagatactgtccaaagggtatgatctgtttaacttcactgaaatattatagagaaatcctgacatccaattttacttattggcgaatgatgtgaaattctagaacgtagtgagacagagttcttaggccaaacacaagagctggtctcattacttcaaacttgacacttacagtcatatttctgtgcatatgcagtgcatgtctttgtcttcccaatagcagccgagaatattctggtcctttctgctccactccactccttattagtttcttttaaaatcaatagggagggtccaccaggtacacggttaggtttttaagagaaagaagcttaatgtaccagcttcctcctgttcatgatattgtctgaggagctgtctcactctccctcctggggcctgagacttgggaagatgttatattttgagttacccattctaggctgctggtctcctttggactcacatggcctgtgtggctttaacatttcagccaaagagactgcttttagccactttgtttccatcaaacataggcagtcattgcattcacaggacaagtgttgcaaaaaaaaagccacaagtggttggctcccgaaagtcatcactgagcaaaaatatcagagaagtgtgcttgggttttgccactgaaggcagcagtaagccacagaggaaaacaggaagtgatacagtgagtcagacctaagaaacttagtctgtggggagaaggatgtatctttgctgacaacagacttgaaggttaggtatatcctggcttctgtttgtagtcatttctgactccatctttcataattgatctggtctctcattaaatcccttcctggaaataatccttccctgtactgccacttgggacaatgggcttcattgctttcgggatagtttcaagatctaatgtgaataattacagccattgttacagaggtcttatcactcacagaacccagagttctgtgagtgatatatatatatgtcacatatatacttgacatatataatcacatatatttaatgttcacatgtaccatgggatatgtatgagtgtctctatttttatagacaaggaaacaaacattaaataacttgcccaagatcacagagctgatagagctggtatttgaacctaggtcctactcctttaccggagctcttaattcccattccacatcatccccagagctagtccttggtggccactggtattagccaaccaggcaactgggctgggtccagagtagctcatttaagcccagtcatgtctggaatagtacatgatagattgtacttggatcaaatcctaccgcttcttctctataatttctcctgaacttcttccattgttgcagcctagcttgggtccttacccactatgcctgggctgtttttgatttttttcaaacacttacatgctctcagtctttcctattctaattaatcatgctcactgttgtcaaaataatcttccgccgcacagctctgttctcaactgtaacagtcacactcaacactatatttaagggcttaacaggttgctaggtgttttcatagtcaccatgtaattttatcttcacttttttgtggtggttttttttttttttttttttttacaaataaagaaactgagaccaagccagatgtagacttgtccaaggtcaaatactgagtgattggcagagctggaactcagttttagacataacttcaagtccaattatcttaataatttttacatgatgtactgttgtctcaaaatgtcaatactgagagcaggtacctgagacttcctatcaccttatgctgtaatttgcaagagtaatctcctcatgctttatagaccatttaaatctaacatctttataagatctggcctcctgtcattcatctcccgaaggcagcacatccccaaattctctgtgcagcttctaatgtactaaatgagttatcacatgaaaagagatgggcacagtgcttttaataagtgttagtcattgtcgtcataacccttctcccacctcactcaaattcttcaactctgatttctaaaactccagtctacaattcagaaattccctgaccatccccttcacaagattttcaattctcgtccactgatgcctgataaaaccctaatcctggttaaacccattgcccacttactcagcaccaagaggactactgggagaaacatacacaattgtgttgactgagtcacttcaaagctacaatcacagatgtcaaattggcacttgacaccaccaaatgatgtaagtgtcctttcatagtaaatttattttcccactctttgagagattgtatcttttgtcttctctctcctaaaatctccaaaatctctgtctagctcatgactgactggcctatatacttcagaaagaaaatattcaaaatcaaattagatctaccttttcaatccacctcaagtccacaaaccaaactgcatgtgtatcaatacattctgccatcccatctgccacagtagatgaagtttctatctagtatagcctctgcaatattgttctgggctgcaacccaggacaaaaaccctcttgttttcaccttataattaccttctcttttacatcatcaagatctccttatatactggatccttgtgactggcataaaacatactgttatatttctatttttttaaaaaaacagtacaaacaacctaaccagaaaaacctttcccttgacctcttacccccaacagcctccatcggatttctccatttccccatcccatcaagattcagctttctcatctccccattggcttctcttcagtccacttgaatggatttgtgttctcatcattgcactgaagtggcccatgtcaaggtcatcacagacctctctcttgacagaaccaatgaccaattctttatccttattttccttggcttctcagcagcatcttggctccgtcttgaaacacttctcaatttttcctcctagctctctggctgttttgtcttccccagggatctgtcctcttctcatcctgtgttcttttactacatgagttcagactgttccacagcttcaaatatccttctgatgctgatgattctcaaatatctgtctctagctggagtttcttccctgaactccagacttatatatccaactatcttctgcctttctatttagatgcctattaaatatcttaaacttacgtgaccaaaactagctccccaacccccagtctttttctataaagtctttcccatctcagtaaatggcatatcaggctaaaatcttggactcatcttgattcctttctttccttcatggactgcattcaggtctctgtaagtcctgttgctccaccaccaaaatatatcctcaacctgtctgtttctcatcaactccttgctagagctcacatcccaatcaccatcatgtcccaccaggagagaggtactggtcccctacaatctagtatcctcaccacagcccaaatgatccttctaaatgcacaagtcacttcaggccatgccccctctgccccaccccatcttccacggattcccattactcttggagtaaaatctaaattccttaccatggccagaatgttcggtgtgatctggacatttcttcttccattacttcatctcccttgacccaactcattctttatgccccaatcatgctggccttttgtccctggaacacccccaagcttttcctgtctaacagtctttacatgtgctgttctttccacttgagacattcttcacccaaatattcatatggctgcttcccagatatattgtctattgtctaactctctgtgttagaatataagttccctgatggcagggcttctgcctgttttgttcactgctttatgcccagcatcttgaacaatctgcggggtacagtatgtgttgaataaatccttacagcctgattatctcttctaacaccttcattggctccttaagataggaattcttctttagctgaagaagaattcaaggactacaacaatgaagccactccaccctctcgaactttatttctgcctactgttttaagtcagctctccttcagcatgagaatacttcgtcttttcttggtctgtttcctctgcctgtagtgtcctcaccataccactcttcttgtttaaattttacacttgtacccaagcttagcctaagaacgattaggacttgaggctctcctggatcacacaggccatagcaatctctctctatcccaaattcctatttctttgatattttctcctttctcaaaatgctatactgtgttgttagtgtttttttaacatctgtctgtttctcctattaaatcatacatacctgaaaacagagaattgatcataaaatgttttgaatccctagtaccttcagagaagacgcatacattacaggcattctatgtttgctcatgaacaaaatgcatatactaatgcaagcttgttcaaccatggcccgcaggccacatgtggcccaggattgctctgaatgtgacccaatacaaatttgtaaactttcttaaaacgctatgtgattctttttgtgattttttttttagctcatcagctattgttgtgttagtatattttatgtgtggcccaagacaatctttcttcttccagtgtggcccagggaagtcaaaatattggacaccccgttcctattcttcaatcagtatagtctaacaacactattagcagccatttatttactgcttattgggttctaggcactatgcaaagtgtttttaacacctagttaatcttttattagagaaggatacttgactgataggattttgtcattaccaactttttatcaatcttacacggacttctaggccatatttcttcattatacacctcaaaattttatttttccaacattttcttactcctattgtgttctatatttttagaattcaggacagaaggtaagtataagaatgaaataaaatgcgatatgtaaagtgcttagcactagaggtggcatgtgttgggagatcaatgatgaaagctataatttacaggttcttctcaaatgaactctacctggctagcatggtagtgtgcatatttgtaatttacaatcattaaaatctttattgatgacacgtgcatttctgtgtactgagagcttatactctcagccctgtgggagaaaacaagagaacataaggtctggctggcctctctctgaggccagagagactctccctacttgggagtcgagaccgagagccatgaaacagggataataagggacagcactttatcgagaggtaaatggagtcataataatagcaacacctcattattttatggagttgatatagtcttttatttgctcttctcaacattgcaaaatcactctatagatgaagaaactgaagtcctgaaatctgattctcccttcaaaagcgacagtgtctaagttcaagcccattattctcgctttgggttcagtgcccttgtcaatacagttttcattcattcatttgctcatttgttcatgcattcagcagattttttttggtaacaactacatgccacgcactgtgctaggtgcttggaatacaaagcaataagatgccacccatatcctttagggcctagaacatagggaaagtggcagaaaaagtatgtattaaagaaattcgcaaaggagattcctgagggctggttcaagaaatactgtcacagtgaaccagctccttatttcatcatttcatcatcattcattcagtcatttaacaaatatttgctgggcatctaccacgtgacagacaatgtgctaggtcctgagactaatatgatgaaaaaggaatttatagtgtaggagcaagggagtgggaagcagatactcatagacaactcaatggatctaaaaataaactcatggtctctgttttcttttcttttctttttctctttctttttttttttttttttttttttgagatggagtctcactctgtcactcaggctggagtgcaatggcgcgatcttggctcactgcaacctctgcctcctgggttcaagcaattctcctgcctcagccttccgagtaactgggactacagatgtgcactaccatgcccagcttatttttgtatttttagtagagacaggtttcaccatgttggccaggctgatcttgaactcctgacctcaggtgatccacctgcctcagcctcctaaagtgctgggattacagccatgagccaccatgccagccatggtctctcttttcaaacctctcctttatgctacatgccctattccatttaaagttcctaaaatcacccccagacactcaagacagaacttgggagttttctctatgcctcccttttgctcatctacctacaatcaactcttggctatgtcctttcaagcctatgtcctaagcttctgttccttcctctccattcccactgttactgctctagctcaggtcctcaccaccttttgcccagtagccgtgaaatgtccaaagtggtctcttcacccctggcctgagaccagcagccactgcccatgcatcccatgcatgctccacctacacttttcttacctgtagagtgacctttctaaatccaaattcaacctgacatttctgtgctaaaatctttttgagcgtgcctgtcctttcagctgaagcccaaatgccttcttatacatcagagcctcttggcggggctcctgcccactttctagcctcagtttctgctgttcctccctaaccacctccactgcccacgttcacacccccgtgctctactgatgaataacagaaaatagtccctgctttgggaagccatttcaacatcttcccctaggttaggtggattggttactttctcttttagccaccattgtacatcacacataataaaaagcatagctactgatgactgagcacagcaattcatgcatcatgccagacccagaggcaataacaatagtgtttaaggacatgaactttggagatagcaagatgggttcaaatcccaatctgtcatttgtttagcagaatgatctagggcaagttacttaaggtaacatctcattgtttttcatctttaatatgggcataataaaaacccttcattgaattgttgcaaggattaatgaaacaacaatgaaacagttttgtacactttaatgtacaaaaagtgcttagcattttatgatgtaacagtgatatctgttacatcatgagctattattaagttaaagtcataactactgtggctgtattagcctttttacatataccataatgaatctgcccaaaaaccctggaagttttcattatttccattttacaactaaggatattacttgctcaaagtcatataattagaaagcagccaagttagggtttaagtccacaccacaaaacactattatagcacttatcagatcttttggaaagtatttacttgtgtacccagcgctcttccaggatgggaagctcccacatggcaaagaccttgtcatattcatatttcccataggaaaaatttaggaaagaatgaacaaataaatagctatgtattcagccaggggagactgatggctgtgagattccaatcctggaagaggagggaagtggctggtatggtcactgtggcaatggaacgagagccatcccctctgctcctgggtcactcactcattgcttcaatctgcacatggatgaggttctcgatgtcttcctgcagtgtctgatggggcttcagggggatgggcaggtagccatagtgctctctgttgcagaggtacatctggatgcctgaggatccaagagagggacaaagccaacaatcagaaaacatactgctgagtgacaagcgaggagaaggaacctgaactgtgtctgatgctgagtttgacactgcaattaaataagtggttgtttcaggtatgtctatagacctaaaaaatgctcctttattaaaaaagtaaaacacagcattggggactaataaaaacactcggctattcttcagcccagaggaaattgattttttccctctgaagaaaaagcaaactcatggcctggaatgaacaaaaaaggcatgaaaggatcaaaagggaggcaaggaattcccattctggagagcagaatggaacactgtaatccacctacaggaaataacaagaaaatgaggaatgaaatccacatttgatatgaaagcaaacaggaaaattctgtaacgctgacagattattaaagctaaatctaggcatacatagaacaaaaaaacgaaaaaacgaaggaaatttaaaattctccaagattctccctggttttattgcttcccttagcaggcatggatttggagccaaccaacagacatgaaacttccaaaatcagttcatatagagacaaaagagtctgcatttcagaatgtcctgttaagaacctgtagtgtgacaataccagaagtatgcaatacccttctcatattcaaattgttcttcatagccccacctgataacttgcagagttataaggcatctgtgtttaaccagacagctagaaatataggaatcaggatggtctcatacacatcattggtcagcaattgacactcctgatcaatgataagactgcttagtgaaaaggatgagtccgccatgtatccaagcctctggtccatgtatccaagcctgtgatttgttaattgcgataattgtcagtgttttccagagagataattatctgcatagggactcctctattttgtgcagatgaaatttcctccagtcagctacatcatctgtcaaatcaggtgaagctgtctcatggcattaacagagaggaaggagaaaagaaaataacctttattccctgcttttactgaatctggcttgaatcaaggctggtctaccaagcactgtcccttctcttgccttcaccgagcaaactcattagctctgctgtttgcccatatgaatgcttctggggagcttcaaagtgcaccttcttgtaaagtcatgatgaattcaggaagtggaaggaaaaatatattaaagttgcatctctaccctaattaggcaaaccattttaccatttaactttctgaggcttccataaaaaaatgatatgatacctatccaaattatccatcaagtgtgagggtacaaggaaggcatttttagacatgcaagaccataatatatttacttgccatcatactttctcagaaagctgctggatgatgtgagagaaggacgaggaggaaaggaaggaagaggaggaggaggaagaagaggaggacgattataaccaacaagaaagattataaacaacatgaacaggagagtcagtgtataagagaagagaaataagtcttaggttgatagcttcagcaccacttggattagaatatattagaaagctccagaacagacgtcttcgcaaatatgcaaaaaaggacatctgacaaatctggacattctgagaggagtttgaggtaattagtgattagttttggatcatactagtaataataaaactaagcaaaaaaggcaattattaaaggaattgcctccaaagaatggcaaaggaaaactaatcatagcctatgaatgaccaagcttggagttaggcttgcatgattacaacaagaacactgaccatcaatctgtttgaaattacaatgggagaacagggtgatgagaagaatgtgtttgcatgcagagggcaaaaaggaagaaaaagagctaactcctcacagtctatagtggagagtcaacaaataatgcccacggtgaagccagaaaatcaagaagtagcaatgcatgcatattatttaacatggaagtaaatattagagataaaagtggttgccttctggaggacagaagtgatgcagggtgatgtgcaggggactgttcatttcttaataaaccatggggaactatatgaatactttcaaccatgtgcatgggcagtttgataacagaaaatttaaaagaaaatgtattaataattagataaagtctatgaaagagtctgcactcccagtgaatgctgcttctggggaagacaatttttcttttgaaaaagagaagtgaattacgctacattttgaaggactgtttttcttttaaacatattaaacattttcttgtactcatatagtaccttaacattgcagattgatgtaattatccctatctttggtgatgaaaaatcagattcaggctgtcacttgtccaaggtcacatagtaagtcattagtgccaaatctttgtccctaaagagccaatgccaagtgctttctacccagtcagtaattggaagctcagttccaagaccattagtcactaggggattgccatccctccacaaggggacaaatttgatcactaccagtggtgttcaggatctgtctgcccattgcccatatcactcacctcttttgactcacatcagacatttggaagacgactggctggcactgggatgattcctgtggccatgatacagaacccagatcactggccacaatgggaggtgaactcttgaccctggactcattacaggaacagagacgcgcctatgaccatatgtgctctcttcttgggctagaagggtggccaagccctgctcaccagcacacttggattgctcctcactcatcacccacatggggcaatggctagagtctggggtgaaagatttaggaccaaggtttgtggttggatggtcctgcctgggacatagatgatacacagctagggagcttcagaagagtgagaacaaaagaataccaatcatatttcatgaagaaagaggaaagtgctttgctttgaaactaaggaaggaagagcctggagacatgccctgggctgcacatgactcccaggctcattcatgtttctcttgaaaatacttagagataagtacaatattaccttaaaatccacagttgtcaagaaagacctttcatttccccaaaatgacagtgaatctttcctgccttgactcctgccctgttcatggtctgcaccgccagtctggcccttagctttcactgcttcatgactattagttgtgttttcacatgtaaaaatcttaactcccaactaacaccgtgccaggaacagaaggaaacacttgggagttcatcctctctctttccttttctatctcctcttcccaaatgagtcaccaaacaactttgggtgtctacctgctttcaatgttctaaaaaagccttttcaaagtctgaccaataacacacaaaatcctggtgaacaggccaagcacagggcagagctgaaaaattcctgcttaacctgaatcatttttcccataccaatatccaggtattggtttcatacaatgtatcataataatttagttcattgcatcataataatgctttgtgcagtgactataaaggaggactctgttaggcagtgtcattcgtgtaattgttaatatctcactttcttggaacatcctaacttcaacctctgaaggaaagggattggcactcaaaggactcaaaaagccctgactttgcttcccatcctggggaagtcagagcaaatcacagaccaactgaaagaaggagtttccattaacactgacataggaatctttacaaaaatcttccaatcatatgaggattgcttttgcctagacataagggctacaaaatgcctacacctggccaaagggtctaaattgctccagcagccaagggggaaatcagcctgacccatttctaccaaatattcttattctcagcaaatctacaactgatgagtgggacatctatggctttaaggagagtctgatgtgtgaattgtagcttgaatttgtattaacattctcatctgccagccacttcctcagctgccggaggatctttgcaccatcttttccaccctcagttatatggccacagtgagtttattcaccatcttcttggtttatgaacgtatttttgctagtggttaagtgacacatttctggcacattaataatgggacccaacttctgtcaggaaagtctgaattatcctaacaaagctttgctctgttagatgccatgtgtcttgctgttgaactgctcttgtgaattttgtcctcctgaagcaagtgtagggtgaaatgagagaaataactttccttcctgttgacttgtctttctcaaaaatctccaggccccactagaaatgctttcccagtggttcataaaagacctcagtctcgctttgcctctccttccacagggactgaggctgagactgttcggtgcctctttatctgttctttccttcttctagagtgtgaaaattgcagtgcatgcatgcagagaataaagacgacattctgagcctcccttacagtgaggtattgtcctgtgactaagctctagctaacaggatttgcatggaagtactgcattcaacttctggattgcacacttcaagggacagggagagttctccctgttgtttctgccttgctggctgaaacgcatccatggtggtgagacacctgggactccacaattaagggcagtacctcgtggagtgtgagaagcaatacacaagaagcctgggactctgaacactttgtggaacaaagccactacagcagctcagactttttcaagaagaaataaacttccatttttaaagtctggggtctttgccagtgttgttttaggcctctgtgacagtttcctaattaataaatgaacttctataataaacaattgcaatgcagtagcaccacagagaagcaatcaccttcccataattcccaatatcaccaccagtccctccaactcaaaatagagtgggttcctgggtagaggccagccctggctcttggtcattggtgctcccagggacagcaacatagagggtgctggtatggttattgcagacaatttactgcctctcactaccagacatatgagggtttttttttttaataaaatgcacaaaacaaaggagctggtcattttgctgtgtctccattgtggcactacaaccaaagacaaacagtacctgcttgcctgctggagaaggcaaagacaatgatgtcatcaaaggtccaggtgtagtcctggtgtggggggtagaaagtcagcttgtccgaggcctccttcctgaggtcaattaggaaggtggagtggaccatggggacggggaagcagcctgtcctcttccattctcgaatctgaacgtagtctggggtcctcttatagaagccctgtaaaagagcaaataggtgggttgtgttttctgatttgaagtcttcatccttctcagtcatttgctagactgattcctttcaagtcattaccagctatatacaagctcccaaacaaagccaccttcactcctcttatcatggcctatgaatttccaagtgagcacaagaaatgctgtctacatataaaataatactaaaagggtcttgatataagaagtaacttttatttcagcatatctctagatttaataatttcataaaagtgtattttatgttgacttatgattaaatatgaagcatgagtattaagaagtggcagagcagttaagggcacaggttccagtgtcagactccctgagttcaaatcctacctcagctacttattgtctgtaggtatgggtcaagtgactcaaccttgctgcgcttatttcctcatctctaaaacagggatgacggcactatctactccatggggttagctgtaaaatttaagtaaggtagaacctgaatagtgttgagactactgcccagcaccaagaatgtatcagcaaataccggctcctattaaaatgacattacactgtggctaatatttgtaattaaacatgcattacttagatatacaaatgagggtcttctttcaatgcagttacttagtcaatattctggtgaagctgcagctgctccatagtttttggggattcagcttctgaaacgtccttctgcacaagcacacaggacaaccaatttccttattccaaagcttgaatcatttccagaaaagatgaagatatatctcaacaaaacatgcttacaaaacatacttgtggaagctttgccaggcattttggaaaatgttctaggtgatggcaggctcactggaatgagtgttaagttttgcaaagccagcactccgaagggcaccatactctggaagttcttatgtgttcattaatcagttgcatcacttcatggttacatttcctgttgtaattcagcatccacacataaggtgctacagcctcacctacttctctgacattcccttcaggttctagaagagtgtcctagctgagctaaccctaatgccgaccccatgataagggaggaggatcaaaaatgaggactcagaagatgtgggtctcagagtcatcttaatcaccttctagccgtttgatcttagtccatgcctaccctctttgagcctgagttttttctcctgaaaaatgggataacagctgctctgtcaatctcatagagctgcagaatgaatcacatgtgataaggtctatgaacctattttgggaactgcaattcattatatgaagtattatcattactataatgtttttattagcctttaacttaaggatcatttaacatcctctatggttttcctaatacttcagcttatgagcagtcttccaagagataaaggggactcgggttttttaaagggctgcctaagtacttgcgtctaatataaagttctagattacttaggaacaatattcccagaatgattagcttggaaaatccatgatgatgatgaatcactgaatatccttggggtgggggtgagaaggaaggaagcagggagagtgagggagaataaatgtgcctcctgcaaagaggcagagatgatgaatgtgttcctttttccacataaattgaatcttgttggtaataattcctgttcattggccagacaacatcaaggacattttgttttgaatgagtttaaaggctctgggaaccaggtcctgctttgaatttatgaagtcactggccctttctattcctgctctagtagagactaactgggatggtagaaagccaaaaataaatggaggaaaataatacttgtccctaagttgctcagaatttagttttactgtacaaaacaagtgagcacatttctcctatttgcttttaagcctgaaagtaaataaggagataatacaaatttgtaggctgcggccactaggataacccacccttgttgctgatgtcaaagcacaactcattaaaaacaaccctcaagtgattctgccatgtgaaacactgaaaatgtatgaatttaaaccaatataatgttttctcccaaggaagtgaatggctgttagaaatatgaacatattaccttcccaaaagagacacagaaaatagcacgcattcaaaatctcttacagctagaagaaataattacaacaaaagaggaatgcttcatccagtggtgtactggaccacacattgttaaattttcagaaagtttgcaaaccagttgacatgttgatagcttggaatccataaaaacaaaaatcacgttaatccccaccactctaatgacacctcatgtggcagttttacatgtttttaatagctgtatcatcaagtggctatactgcagtttacttaacctttcccttagcttaacaacatttaagctgtttgcatggtgggagtatttaaaccataaaaattggcaatgctaccaactagggtttttcccacaaagagccagttattaaacatttatcagcacactactgaccttatttctcatccaaaacaaaaccaaatataaaggggagactcaaactttagccctttggccatgagaatacattgaacatactccctctttttttgagacagggtctcagttgcttaggctgcagtgcagtggtgtgatcatagctcactgcagcctcaacttcttgggctcaagcaatactccctgctcagcctcccgaatagatggaactataggtgtgcacgacaccacaactggttaattttttgatttgttgtagagatgtggtttcgccatgttgctcatgttggtctcaaactcctgggttcaagtaattgtcctacctcagcttcccaaagtgttgaaattacaggcatgagacactgctcctggccaacatattttgcttagcacatttttatcctacattgatacatattacattaatcagttgaatttatctaattctttaattaaagaataaaaaatataaccagccatgagcattcactaaaacagaccactattttgaagattttactatgaaaaaaagaaataataaaaaatcaaaccttttttaacttgaattttataaaaataacctaccatggtagttttcattattagaactctttggaaataaatttggcaacatacatcgaaggtcattgaaatatttgtactttttttttttttttcttttttgagagggagtctcgctctgtcacccaggctggagcgcagtggcgcgacctcggctcactgcaagctccgcctcccaagttcacgccattctcctgcctcagccttccgagtagctgggactataggcgcccaacaccacgcctggctaattttttatatttttagtagagatgaggtttcaccatgttagccaggatggtctcaatctcctgaccttgtaatccgcccgccttggcctcccaaagtgctgggatcacaggtgtgagccaccgcgcctggcatatttgtactgtttgactcagtaattccacttctaaaaagctatcctaaggatataatcttaaatgctgaaaaattatattaatcatgacggtcacgatagttaaaaagttgtgaataatttaaatgtttttcaaaccgagataaaggttaagtaaattggaacatagccacttgatgataacacagttactaaaaacgtgcaagtttctatctatgatgttgttacggtgatggggatttaacatctgtcttgttggttttcttttaaactttttttaatttctaagtttttctatagtgttcttatgttagttttgtaaggacaaaaagaattaattaaaaatagtaattcctgaatcaggaattggctaatttgacgtttctaaggctaagctctttagactatttttttcataataaattaacacagaagagcccaactgggtgtagcattggacccagatttactgcccttcctaaaaaatgcttgctctgggaacacaatgacacgcatgtttcaagggagtaaacaagagaaaggtgaatgggactactgttgaccgggtgttgccttgttaaaactagtagccttaattcatttaagcaaaagacttgccttaggggtgattccgcaccagaaattagaatacaggccccgagactccagcatgggggccacaatagttttgttttctgcaatcagtagattgagggtctgtggattagtcaggaaattgtcaacatctatgaactaggaaaagaaaaggataatgttaggtgaaaaggtacttttcagtaatgagtttgagaataacccagcccttctgaaggatcccagaaacttgctcatgacatatggaaccagctatctatgtcctccttattgaaacccattgcagctaggtggctttcattcagtcaaaatatatttagtctaactttcgtatgttgggctctgcataaggcactaagcagtaaattggtgctgccatactgggcatagcctcaaccaggaaccaacctacactttggctagtgttttaggcacaagatattaatggctcccaagccattaaaggttcattcaaaaacacttattggctgcccagtctaggtacagatgggcatgcctacttagcttttctatagtaatgccagagtagctcaaaacagatctatcaatgaattttaatgtgacaagtagaatttttgtttaagtacattatatcaacccatgctaaccagtgaagctatttcctattcttagaagtccatgttaacagtgatttatttagagacagtataacaacagattctaatttataaaagaaataatcatactgaactatacactgaaaaagggataaactgacagattttaccttttgtaggttttatcacaataaaaaattcagaagtcttcatttttatgatagtccatctgtttaccccaaattttgtgatttaacatttgtacacttcaatggcatttaaacagctacacaatgttaaatattgtcagtacaatttgaaaacttctatgaaaggatttgtgtcacaagtgtgcgtgatacatttttgggcagattttcactgtggttgaggggatggggatggacataaattctccaaagagagcatcactgtgccaagcaacagatgctactccccagatcattcaggagcaaaagggaaccatttcagagctgttcagctgaatcacttttttagataattactttttcatatcccccaaattcttccaaaaagttgtaagaacaacttacattgctttacctacagcctttcctgtgagctaaaaatatgcagagttcttatgcctgttgcatggcagagaccaaataattcaggcacttcttcacttacccactgaaaatgcatgtgggcctgaagatgaagtccaggtagcccaattttaaactaccaaaaatttcattgtgcctttcttaaaaagtgggggaggcactgcctaatcaaaaaggttgttttgattgcttccatggttctagtttttggacgactgatttggatacacctgagatgacagttgtcaagaaatcaaacatctgtttttaccagaatgtagtctgaccatttttccctcgcagttcgaagggctgcctgtcgtagtttcatcacatgggcaaaccgggaggttggccagtgctttggtccaatttcatcagggtaagacctaaaataataataatagctcatcattattgagtgcctacatgtaccaggctctgtcctaaatgtttatatgtattcatttaatcttctatcaatcccaggaagtagatactattattattgttatcatcatccccatattacagatgaggaaaccggagcaatgagaagtcaagtaactcactgctcattgtatacaagaatctttacatgaaatatttcagtgggttctaatgagagccctttgaggtgagtactgctattctctgcatttcacaggtgaggatatcagggtagagcagttaagtcattcgtccaatgttacacaatggggcacaatcaagatttgaatccaagcaaaaagctcatgttcctagacaatttttatacatcccgacatcgaatagatttggagagtatgcagtgtaaaacatgagtttcccaggaaaatcaaaggtttaatctacttgttggagtctccacaaatgattccacacagcctaacacattgatctatcttaggtaaagtgaggtcgtgggatctctatcaagattcacaaaacagccaggccaagactccttcatggccacataggcaagtgggttggagcacgctccaaaacccttctgaaggcacccagctggcacggacattgatactgttgcagtaacccaaaactggccaccacttcaagatctcatagctgcactggcagtacatttgttttagtgagtgaaaaactgcaaaaacaatgagactgtaactaaacaaataaggttaataaaactatgtacagcacaggaattctctggaatatcttccccagttattgtttcaatgaaaatcagtggaattctcatttttctaaatatattccccccaaaaatgcctgttctaatattttttcacactgaccttggcatataatatatttagtcaaaacctggctgcagagaacattaccaaggtgcaaagaagggacacaaagtatttctgtgccatttttgttaggccaaactccattataaggcactctaaaggagtgtttacaatcttttacggtgttcagacttcactgttaaattttgcttgatatacagtccatgggcttggatttgagaaacacatatgtatatattatatcatatttatatatatttctttataatataaatatttataataattcttacatatagaaagactagaagaacagaaacttgttctggaatggcatttattattactataatacaaatttggctttcaataaatgacttctctggggaagaaattcaggcaactccttcattctatttctacagttccttaaagtaaaactgtagtagctttgggaacatttataatagtaagttttaaatacatttattcttgttcttatttgttcatccaaccagtattaatttagtgcctgccaagaacatggctctgaggggagagggggaatataaagtgtttatatattctagcccctgccaaagaacttacaacttatttagaaaaaaaatacattaattgcatagggggaaaatgttggttgcgtatatcattgtgccaaaaaggatgacatagaatataagcaatacaattgttgagacaaaggtagatatttataactgagtgattaagaataggtttctatagtaggcatgatttaggataagaattagttataaagaaggaaagggtcttccaggacctgcacaagcaacagtgtggggtttggaaataaaagaaacgttctggataaagcacattttcttttggtgctaaattcatggaattttaaaaatataagtcttaggtgtttgaactttgttcaggtcctaaagagtaagtgaagtatttttaataaagaaatgaaaccatttcatttgtatttgaggtagattgatttgactgtatggtatgtaggatgacttggagatagaagcaattaataaattgctatggtggccgggcacggtggctcacacctgtaatctcagcactttgggaggtcaaggcgggcagatcacagggtcaggagatcgagaccatcctggctaacatagtgaaatcccctctctactcaaaatacaaaaaaatagctgggtgtggtggcacacacctgtagtcccagctactcgggaggctgaggcaggagaattgcttgaacccaggaggcggaggttgcagtgagccaagattgcaccactgcactccagcctgggtgacatagcaagactctgtctcaaaaaaaaaaaaaaagaaagaaattgttatggtaaccaggcacaaaggctcacacctgtaatcccagcactttggaaggccaaggtgggaggatcgcttgaggccaggagttcaagaccagcctggacaacatggtgagatcatgtctctacaaaaaataaaaataaaattagccaggcatagtggtgcatggctgtggtcttagctactcaggaggttgagtgaggagtattgcctgaacccaggagtacgaggttacagtggagctatggtcatgccactgtactccagctggggtgacagagtgagaccctgtcttgaaagaaagaaggaaagagagaaagagagagagagagagagagagaaagaagagaagagaagcgaagaaaagaaaagaaagaaaagaaggaaaagaaagaaagaaggaatttctatggttaagataggaaattacctaaatgagcatcagtaggggatcaattaaataattatggtaaatgcacatacaacagtgattatgcagtaaaaaaaatgaaaattagctccttaactattgctatagaatgattatcaagataaaagttgaaaaaagcaagctctatgtagaaagtatacacattttcaatatgatcctccaaatataaaagtttgtttaaaatatgaataaataatatcaatatttaaaaatataaactgtcatggcaatttatttatgaagtaatgaaaatctgaacttggctggcagctgtgggagtaaacagcaagagagtactgtgaagatctctaaaagggagaaatggcagatattcagaactcacatagctacagaaatgaaagacaatgaaaagtcacatgtacctccaaacctggaagccctaaagagctagttaaagaggaagggtaaataatgagtttacaaatttcgcacttgctactcactctggttcatccataggcctccactccacatagtgatagagtctctgtacatttttcaaccactccctgaatatttctgttgtattatccacattgtgatcagtggctgccctgcatgagagaaagcacaatatagtttaactatgtcatccaatgaaagagagggaaatccaaaagacccctgactaactgaaagaagaatggctactcctggaaaaaaaattgtatatatgaaaataattccctcatagtccaaactagacaataaatttccaaagtgagagacactgcttaaaatcatctttgtgtcattagatcctaaaacagggctcagccaattggagaacgtgtaaatggttgcattaataaataaacacatgaaaacaccaagagagtgtaagcataaaatgaattaactgagagtcaattaatgaatcttcttggaaatttttctatatgttttaactttcagttacccaggatgtaaactccaccttttaacttcattaacaatgaccctcaatttgagcaataattctgcttcatcttcatttcaagtcaattttctgaccgcagcaaaatatctagtcaatgctgctttaatcattgtgaagctacaataataattctcaatataaaactcaaaatttaaggtatgttcaattatctattttggattaactttaccatcacgtttacaaaatagagtattttccaaagcctttaaataatgtacacaaaacttgtgcctgttctaccctgaaagtttaacaaatggatccacttgtaaaagggcctaactcatttatttaaaaagtattttcaaattgtatcacaaagcaaaacccaacacatgtaaaacagttattcagaacacctataaatgaagagataatgaaatgaaaaacagaaaaagagaagaaagcaggagttgtaatcctgacaacaaacgaggtagaattcaggccaaagagtattaagatgacaaagaaggagactttataatactaaaggaggccattcacatcaaaatatacaaagtatgaatatctatacattttcatatattacaggggttggcaaactttctttcaagcgatagatagtaaacattttaggtttacaggccatatactatctgcagctactacttaactctgccatggtagtgataaatcaaccataaacaatatgtaaatgaatgagcattgctgtgttccaacaaaactttatttacaaaaacaggcagtctgtaggctataatttgctgacccctaatatagtagaaagtatagaaactgtaaagaaaaacagaaataacaataataagagatattaacataccactttcagttaaagatggtacaaatggggaaacaagtaagtatatataggatctgtacaacatactaatagagacttctcaagtgcacatggaacatctgctagcactgaccaacaattacatcccaaagaaagcctccataaaattgaaattatataaacaacattctctgatctaaatgacatatacgtagaagttgataataaaataaaatcccccaaatccactaaaaactctcttataaagttgttttttaaaaaataacaattactagtggaaaaataaatacaaaccaatttcagaacttccaaaaattaataatgaaaatactacatatcagaattttgggatacaattaaagcagtgattagagaaaaattcagttttatatgcttaaataaataaaaataaatgagttaaatttctactcaaaaagctaggaaaaaagcaacaaagcaaacatatataaagaaattaataaagataagggtagaaagttgtgagatataaaacagaaaaagagtagaaacaaactaaaatgctacttctttgagaaagatcaataaaagacaagctgtagttaacctacctaagacaaacaaatataaaacaataagaaatggtaaggatgggaaacaagaagattgatttgaaagaaaaattttaaaaatgtgtaagcaactactttgtacaactcgatgataaatttgaaaactaaatataatagaagattttccagaaaaatgcatgttagcaaaattaactcctgaagtgatataaagcttaaatgaataatttccaagaagagagtaaacaggaaaaaaaccccaactaggctcatgtgtttttacaagggaattctaccaaatcctacaatagatacttccaatgctatacagcttgttatccagagtgcaggaaaaaaatgaaaattctaagttcttctaatattgcaagtataatattgatgtctaaaccttataaagatttacacacacacacacacaggcacacaactacagaccaatatcctttaatgcacatgctgcaaaaatcttaaatgaagtattagcaaacagagtccaacatcttattaagaaaatatagcatggtctaagaattttcaatatgaaggaatttcactaacataattcactatgtttatggacctgaagaaaaatcatgattatctctgtaaatgtgtaaaaggtctttaacaaaattccacacctaatcctggtttttaataaccacacagaatacaattcaagcagatactaaaaaaataagccactacaattaaaactgtgtggtaatgacacagggataaatgacatagggagcccagtggcacagaacagtaagtacagaaatttagtatatgataagggtgtcgtaatattcccatggaacaaacctgcacatatactccctgtatctaaaatgaaagttgaaatttaaaaataaataaagtttcatcaaaaatatatatgatataatacagttttgaaaaatgatcagaggtacacatgaaataatttagcttctattgcatcattactttcactgctatttgtaggatgatttaaaataaattgaaagtaaatataaataaaggccaagtgcggtggctcatgcccgcaattgcagcactttgggaggccaaggtgagcagatcatttgaggtcaggagtttgagaccagcctgatctacatggtgaaacccgtccctactaaaaaaaaaaaaaaacattagctgggtatggtggcacgtgcctgttagtcccagctacttgggaggctgaggcaggagaatcgcttgaacctgcaaggtggagattgcagtcagccgagatcgggccactgcactgcagcctgggtgatagagcgagatgctctctcaataaatataataaataaataaaacacaaaaaactccttttcattaaacatgaaacattatagtttttaattggttttaaattgccactaaatatattcaaaaaattttttttatctcctaaaataataatctttaagagagggaatgttcaggaatgttcaagagagaaaaatacattgttaagcaaagcacagtggaactctatttagatagggaatacatttctgtaaaataccaagaaacttaaaactatgtaacttaagccatagggtgtagaaaaatgggacatagaggtatgtaagtaatatttgaaaatattatcttgtaaaatagatacttaaattaaaactagcctacttaaaaacattatccaataactacagatgacaccaatggccaacttgatctactttcaagtgtcttcttgaaattagatgagaaccaactcttctcttctcggcaaggtctaggagggagaacgacccacaggcccacctggacattccatggcctggagagggagagaggtgatgtgtgaatctgacagttttgagggataccaggtgagcatgttaggaccaagatggggtaggaggagcccttagcaactcacagaggtgggaaagtggtccagaaagcaacgtggaagaaggccacaggctccactgagtttgtgattgtgccaaaaagtgcaacgtcagcaaaagtcacatcctttgtgactcatggccacaagctaccaacgtccagggtacgccatgaagagcgcaatgagagtctaaccactggtctcgtgataggaagcatgcagagagcaattcctgaaactcagaatttaccataaagcaccttattcttcacttaaaacattatgaagaggagtaagttaaaactaagcaaaacaaaaattccttatcacagtgttagccaaaagctatgagatttctacattattcttaaattatttataaacggcataagagaatttgccaggtgcagtggcacacacccttagtcctagctacctgacagactgaggcaggaggatcacttgagcccaggagttccaggctgcagtgagtacaactatgcctgtgaatagtcactgcactccagcctgggcaacatagtgagaccccatctcttaaaaaaaatagtctaggtaatttatacagcatctacttctttccttggttgttgtttcttcattacacaggacttcttaaattctctttgccttctctacatcaatgcatttcctaatccttttgacaaagttggtcttatcgtacgaaatgtgttttcctggtgtacagattaaacaactccaaaacctgcctaagcatccactcctgatgaacatccttagaaattagctgcctggagtatgcagaggtacagatgtctaattaaaaacagatgcacagatttcaaatattctctttattgagttaaaaaactgtctgtagtgttacttccctgaattaagattctgtttgttctcaggcttctgaggaaatgaacacgtcctccagttgtggttggagagaggtgcatgaatcctggtctttgaagtgcagggccaatctctcctacactcattcccagaggaggaagaggaggaagagcagtgagggccacaccagcccaccgaggaagcctggtggtccccgcttaagactaagtttccctgctcctcctccccaatgtcaaaaaaggcaaaaacacagaaatccaggcagacacttctaactactgccttgtaatcgctctgacaaaagtatatttccatttgaatgcataataatgaaagcaacacaggccctgggctattcagagggttggacagagagagataccaaaggcccatatgcaagctttctggaggaaacccgaggctggtgctaacggttctattttcagagccctgtagcacaaggcagcaacagcgcagtgcttgtcctgctgcagcactccacaagcatctagacacaaaaacctctgcggctgaggtggatttttccatgaagctaggaagctgagaacccagaatgtgtgaggcccctcaggaggagctgaggcacagtggcccctctctcagtctgaaggctccttggaaaatgagtactgcctcgaatctgttaccctcctcccaaccagaccagaaaaggcacccagaaaaatcgcagacatcactaatggattccttgaagaaaacaaatgatgtgcaaggacagctggacatctggagaggtgatctgcaagtaattgacagtcagtaatcaaactggaaaaccacagattgtgaaaacacaaatatgggctggctgggtgaccatgtttccgggaggctcatacggctcagtctttgcctcaattctccaactagagtggattcacacctaaatcaacacctccactcactctctcttccccagatctctgactcaggataagacaccaaggaaaggctggacacagtggctcacgcctgtaatcccagcactttgggagggtgaggcggatcacctgaggtcaggagttcaaggccagcccagccaacatggtgaaaccccgtctctactaaaaatacaaaaattaaccaggcgtggtggtgtgtgcctgtagtcccagctacttgggaagctgaggcaggaaaattgcttgtacccgggaggcggagactgcagtgagctgagatcgtgccactgcactccagcctgggtgagagagtgagattctgtctcaaaagaaaaacaacaacgacaaaaagacagcaaggagagctcagctcttgagctgtttttaattttctttgaaggtcatgttgggacaataactttcctttacctctaaggagccctggtacccgccagccaccaaggtctctcccttccacttttaggggagctgtggccctgagacagcttcagtgctcatggttggccacctctctgtccatgagtcctggcctgctttctttggagctagtacctgaaaagggagtgctggtagaaacaggtgccacatccacactggccacctcttaccctaatgctgcccatctgctttccctctgattctgcttttggttcctatttccccttcttcctcttctccagctgtgcaagttagcaaaagcccatgagtctcagattcaaaattgaattaggactaagggaaacacgtattggagatgtgatcacagcacatgtagggatccccttggctgatgatgctcccaggtcaacaggtgcactgtcaccgctacatggaagggagcacaaagagcagaccaagaagtcaacatgtctgcaggatgagacgctttactgcttggctgtggaaaaaaaaattgagatttatctggcaatgtctaaaaacattgacatttctccttgttccagaagttagttttcatttctaagtcttgcctcttaagactcagagccaactagaaataattagaactgactcatttattttgacaagtcctactgaggttgttagggctaaactcatattggtaagcatggggccactggaatcatattaaagatgaagactggatctctcagcaggtgggacacggaaactgaggacacagtactcctttattttattttatttttgagatggagtttcactcttgttgcccaggctggagtgcaatggcacaatctcagctcactgcaacctccacctcccgggttcaagtgattgccctgccttagccttctaagtagctgggattacaggcatgcgccaccatgcccagctaattttgtatttttagtagagatggggtttcaccatgtttgtcaggctggtttcgaactcctgatcctcaggtgatccacccgcctcaacctcccaaagtgctgggattacaggcatgagccaccgcacccggccaggacacggtacttctgatcacttccatctgtactgagactcagggaatgtcctcagcttccctgccacacccgagaaagtctaagacctctgtcactatagaagaggtctgcgattggtggagtagcaggatggcaacactggacaacgactgatctattgatcttgctgcctgagaacctgcaaaatacattccccagaggctcaagggaatggcagtggaatgaacaacaaacttagtcaccacctggacaatcctcaccatgactagtgagttggcaaaggtaaattttccaattcgagacttcaaacactgaactaccctctcagatgcttcttgttttcattgagcaaagaagactcactggtgtagaaaataaacagctccacctaaaaataaaattccactaatgaaagcaactactgtaattcattttcaagaaaggtcatatcatcgagtcccgccacctctgtgtccagtctcaaggaaagcctccccagcagcagacgtgccaaaggcagagacatgctcagccactcagcaaaatatgccaattgattcttctttcttggttactgggtagaattctgtctaaagatctggaatcctttttctgggtggaaactagatatggatatggttaaagacgtgaatatggattgggggtctggggattcctcccacaaaaagccttttcctagatcctattcataccaagtcacttagttgcaattcttcccaatgaactaagaaatcagaaaaactcacttctcatgaaaaattcctcaccaacaaaattaatgtttatacttcctcaacatccctcctcagtatgccccatttcatcccagaaacaatcatagacacgacacacctgaagcctgggtatatgtgatgtaaaaataaatatttgattctagaaattcaagcaaccaatcaatttcatccctaaatggcatctctaaatttttcctgatggtaaaatttgctgattgaccagttaacagtcaattcaaaagcccattatcatctttcaataaaattaataaacttaattaaacatattataattgagctattttttatactcatgattcggagatatatttttcttctctttgtgttaagaacttctcaacattatgccacacactaacccatttttagccttatgattaactaagttactcattatctttatttcccctgttatagaaaagaaggctgaggatgagaggttatgatttgctcaagtcatgcaaatggtgggtgctagagcttggcctttttatttaggccttctaatccatccctcaacacccaccctcccactccaggctccccaccacacctgtccaacaaagagtagatgaccaggaaacacctgtcaaattggaagttctctaccttgtcaaggatatgaatcaatatgaccaatatgatcatctcaggatgacaggatggaaatgctctagcaaaaaaacaaaagaaaaatgggaagattcattcattccctacaagctttgcttaggtttactttcagcataattttccttggagtcacaacccttggaattccatgaaaatatcagtgggagtgtctgagacaagacaaatatgtttctcatttgtctatctaccctcttcctgttttcgttctcctttggcccttgtttattcttcttcccacctttttcacccactcatcatggccccttttcttgtccttattggattttccaattctgttaagttctttattttgtggatgtaccctgaagacatgtagttactagttaaatgtagcactggtactaaagagaagacacagcaggatccaaaaacattttctccaggagtcctgaacctctacatctccaaacacatcaggttagattggacaccctctatctgtaattatgcatcactagcttgccatgcttccagcactgtgcttgctcttgtgttataattaactggttctatttctttcttcattacttgactttcttccctgaggacagggactgtcccagtacttaacagttcactataaaataagcacttatcatgagtttgatgagtgaatgaatgaacaatttcagggaacttctccccatccaacccaaatgcctataaatgctgagcacagataacaaagaaatgaaatgggccatgtatgagccaacagtgtgaaaggaggactgttgagaataggcacatgtgggccccaactgattgctgctgcactggaatgtgtgcccagaaatgctaggctttcaaattgtttcaagagaagctggctatctactttttagagataaaagtctatttataacctgtacaaacttttaggctgaaatgccatgaaaatattccaccctggcaggaggtctctggaaatcaacataaaaaacacattatttcatctcttaatagcccaggtccatctatccacacatgctcagggcacatatttcagtaattaaatatttcaaatatggctgggaggacagcaatactatcactttgctgctttcacaaaacagaaaacatcttccatgagaaagaaaagacaaacatgcacagattgagcaagatgtaactaattctctcaacccagtctaatatcaagagaattggaaagaagaaaaaaatgatggcagcaccacagaatgagtgtaagtgtacacttcctgcaaacaccgtacatacctcctctcattgcgcagcaactaagacatgattactgctgcacaaactttttactaacaactttattgagatatatttcacatatcgaatactcactcttctaaaatataaaattcagtggtttttagttgtgcaaccatcaccattatccaattccagaacatttccatcacctcaaaaagaaaccctacatgcattagcagtcacctctcacccctccagcccctggtaaccactattctgctttctgtccctatggatttgcctattctcgtcctttcttatcaatggaatcatatgattgtggccttttgtgtctgccttctttcactttgcatactgttttcaaggttcacgcatgttgtagcacgtaccagtacttcacttctttttatggctaaataatgttccatagtatggatatgccacattttgtttattcatttatcagttaatagacatttgggtgctttcactttctagttactatgaacgatgctgctatgaacattcatgtacaggtttttgtgtgaacatatggtttcatttaccctgagtacggctgctcaaattttaaatactatggaaaaagaataaaatttattttattttattctttaccctttgtggagaatctactatgttccaggcagtaagctgaccattttacgtatataactttaacatttaaagtaattttcctttaagtattattatccccattttacagaagaggaatgtgaggcttagagactctcttccaaagatggttttctttccatttatacttgatctttgatatgtatttttcttaatttctgaaattctcagttttctgttccaatgtagcagagaggaatcctttactctgcttcatgagtatcttggttgtacatgagatgagcagatgcaagggcccaggaatgcgtgggcagttgcaaggaagtgagaagtgtcaggtctcagcagaggagctgggtggagcagctgaaacaggacatggatgattaaactctgagtggggatgtccagcactgcctcatggtgcctggcagggcaatgctacagcaaaacatggagcctctgaaacatgaggtcatgggggaactggagccagcgcgaccacagggaaagtcacagcccaaggactgggcttgctacgtgcagcaattattgacaggaggatctccctgctctattctctggaggagaactggctgaactgcagtgacaatgtgggcaaagtggtctcttggattgaggactgggagaaagctgaaggaagtgtccatgttctgtgtagaaagatttactttgattcattcctttctggaaacaactgcagttaagaatgacaataaatattttagttatctattaatcctgagttccttgacctactattttgctaacgacatccttaatcaaataaaaagtatgaagtcaggaggcatggctctttcaccaattaactctgtaatcttaatgaatttacttgaactctctgtgctttgtttttccatctgtaaaatgggacaataacatctgctgcatctacctagctcactgggttattttgaggagccaacagcatgtgaaggagctttcaagaacactttccttgaaagctggccttcccctggctgtccccaacacacacacagatcctcaattaagaaataagacagcttgttgaataggctcttaagacacatgcaaaaaagttcaacacattcatttaagacaaacaaactagaattaccacagcctaccattttttaagaataaaagatacacatgcccatagcaaggactgctaattatctcaacatcagttcttctctttttccctagtaatagaatttttagctgagtctatgactgtccggcttaaagagtaaactttaggctcaatgacagcagagacatttgtctcttctgtttactcctccattcttaacgcttagaacagtgcctcacacatagtatgtgctcaataaatatttgttgaatggttcctttcacatcaaactcctagcctaataagaactataaaaacacctgtacagttccctcagttcaacagacactggctatgcatgtcctctgtgccggtgatcgtggcacttgctggaaagcaacaccttgtcattcacatcaagatgcacccagtttctcacagatggacaggaaatacagatgtgtaaataaataactgtaatttggtatgacattgttgacgatggatatatgacaaggtctccaagtgccagggaggagggagtggctagaaaggtgtgggaagggccacgagaggcttctcaaaggatcagaggcttgaattgggatttgaagattgagcagacattaagggaaggtagaaagaagaatgttccagaaaaaggaacaacatatgtggaggcagaaagggatgaaagagtctgatgtgtttgtggaactccacgtaaatttgttgggctaggacttacaagccaagagggcgagatggctgtaaggtgttagggctgatgcaattgtcagggatagggtaggcacaggacacagtgaagaggggtgaccccctttcctgggtccctagcatcttgccctcctttaaaaaataaactggtttataattctctgaaattatgtgtttttccagattgtgacaggtattgctgttagcatgagcatgcatttattctttgattcctcagaggaaatgttcaaaatatacatcatgtgctggcctattttattcagttccaattccatccgcaggtgcagctgccacatagtctgggttttctgcgaaaggtgtgatttctaacattcccacccattttcttcataacttcatttgtacctcccagatcatgtgtccaaagtaaacacttaacatgtgcttgttgaatgactaagtgaacaaataaatgcttgtataaatcaatgacacgaacaaaaataaagtggttatatttattaagggtctattacttaatgaaaagcagcagcaaatctgtaatagaacaatattagatgcatataaatcattttgatttttttaaaaagccatcacacttttctctgctacagtatttgtttccccattgagaaagctggactagaaatgtgaacaaagagaaaaagtataaatttacaaactgaattcaaagctgttttcccacagagtatcccagaatgacaacttggccctgactaaaaaaaaatgtcagcccagtcagtcactgttatccaatacctgttgtcttggttccaggaacaacactcctggccatttcaggagggagagacaaatgtttgctttgaatttacctgctttgagaaattttcagtctggtcttcccatatcacttcatttgtggttccttcacatggcggtggtgggggaatgttgcaggagactacagtttggcaggtgttagatacatgttcataaactatactcacacccacagtaaattgaagagtcccaagtcatatttttgaggagtcttgagttattttacttagtcgtagtgtcagggcaaacaggaggctattctgatggtatttttttttttccatttctattctggaaaactactgtcagagggaaggaacaccgtgtgctcctaacattcccagggtctgtgtggctttgtcacttgctcctgggagaggagcatgcataaatacacagcatatagatgtgttgctgttgcctttactactcactgctcttctgcagagaggggagcagtgagagcaaacctcagctaagtgctcactcctggccaggcattgacctagaactctagcaacatctcatttaatcctcacagcaaccctatgatgtagtattcttactatctccattatacagaggaggaaaatcaggtccagagaggtgacacatcatgtccaaagtctcagaggtagtaagaattagagccagacataagtcagacagctggactcatgatgtcccatctaccactactctaagaggcttattttgaagctgtcctttggagtgaagtttaaaacagaaggaaatacttttaaagatagtagagggtaaattctaactttgtcttcaaagtgctaggtatatcagtaggcttcacgttatcagtaaaactgctgcgaccacagatcatttaagtcagcttagagtccccatgggtcatgagccatcttcatgcctcagaaatatagtcaatgaagcactcataattttcaatgatgtcttaaagaatgaatggcacctaatgatgattgattgactgtcctctttaatattgctcaaaactttcagtcaagttgtttatctggtctctgacagataggtttaagaatctttgctcttgctgtgaatagagttatcagttgaaaggatgcctgatgcactagctttttaaaagcttgctccagatttcatctggtgactttggaaggtaggacacggatactgggctctagacttccaaggtgctcaagccttccccaacctccccaaatgggtaaaatcccccagttatatggtttttgggatcatgtatctcttctttctagtacttatcagagttgtaattctacatttatttctatggtactcaataatgtatttctcctctaatggtttataagctccatgagggcagggatatgtctgtctttgctcatcactgtatcctcaagcccaggacagtgcctggcatcagcactgggtaaagggttgctaaatgaataactagatgcaaaaatgccatcctcactttttacaagaaaactctaaatatttaaaacatgtatttttcaccagtaaaaatgaaatacacaatcagataaagaagacaaaatgacttttggggtacttcctctctctttcataatccatatctggaaagtttgactttcatgtgggctctggaaacaggaaggaatcagatgctgtttggtattaagctgctgaaggctccaggggagcccagtaacttatctaagaggaagtggggaatgcaatcagttgctttgaaggcagcacccaggaaatatctggccaggacagaggttcaagcaaatataattgtggtagatggtaaatatggcaacaggtgagtaattctttctggctttcattggggtgtgtcttttaagccaaattagaaatccagcaagaggatttggtatgcaccattataaacagagtccagctccagccaatgcagggagaaggctgcaacctccctttcagacccaaaaaaggacccaatgactccctgaggaacaagtagaccaaagggcagctctgaacacccttccttccccagccccaggtcaggccatgtctaaggcatactttagtctctagctgccaccatgttcttttggaggtgccatgtgaaggaagccaacaatgtccaacattcaaagttcatgtccccagaatttcctaatttttcaattgcctctgtaaattatttcagaacatgtcgctgttaaaattcttattttcattcccacatcctgatgtttagagagggaattaggcattaccagagctagatttgaactcactgacccaagtttcttcagcagaggatccaaaaggaaccaaaactttcatcaggactgttatgtgtatgaagacagaagagaagccttttggtacaaggtagcactcaagacaaggattcagtaaaataagtcacactcattttctcttgtaattcttttttttttttttttttttttttttttttgagacagagtcttgctctgtcacccaggctggagtgcagtggtgtgatctcggctcactgcaaactccagctcccgggttcacaccattctcctgcctcagcctcccaagtagctgggactacaggcacccgccaccacactctactaattttttgtatttttggtagagacagggtttcaccgtgtgagccagaatggtcttgatctcctgacctcgtgatccacccacctcggcctcccaaagtgctgggattacaggcatgagccaccgcacctggcctctcctttaattcttacaacatcctaggaagtaggtattctccgtatcttatggatgagaaaatagttacaaagctagtaagtaatggatccacgattcaagcctaattaaccctgcaaattattattattatttgagacagagtcttgctctgtcacccaggctggagtgcagtggtgtgatctcagctcactgcaacctccgccttccaggttcaagcgattctcctgcctcagcctcccgaatagctcggattactggggcgtgccaccatgcccggccaatttttgtatttttagtagagacggggtttcaccacgttggccaggctggtctcaaactcctgacctcaggtaatccgcccgccttggcctcccaaagtgctggattacaggtgtgagccactgcgcctggccttaacctgcaaattaaaggtgaattttcaaaagcaaggaatgaagagatttctttttggtaaggtcttatggggagtaataacaaaatacctggcataaaatcaaggatcctatatctagtcagattttttaaaaatagaaaataaagccaaatgtatttgactatactgcctatagataaattagattttatccagaaggcggtatggtgaagtgacttttgaaacccttcagctatttaatcctggctaaattacttaacatctctataagccttagtttccacatttgcattgttgtaaagactaagaaatcacctatgaaaagaataaacattagaaaaaaaacaaagagaagaaaaacaataacatgaatacatatcaatagtcatttctgaatacataaaatttccaaacttgtagcaagaaaattgcaaatgtaagtacttcatcagtgaaagaaataagtgctataatccaataaaaggcatttggccctgattgagagaaaaaaatctcccaaacaaccaaacatttttaaaaaatctaaccactggcaaaagtgatttttgaactccaaacctataatgaacagttcaaaacacatatagtcatgtctgaacatagatgaacaaaaatcttaaaaccttagcaaagtggaatacaacaaacgtgtcaaactcagtaaaataaacatcctcttgagtgagcagtggctggagggagaggaacaggagaaatccctaggcagcttccagagagttcttcaagcaggacattctgccagtggaggcgcagcctccggaagccagagccacgtcaggctagcaagcgctcaagggcttcttgtatactaccttgtatgtttgcttccagcgggtgtgtattttttttttctttttttggtttgactatttgtttttctaaggaaacctttggtttttcttcacatttttttccctttaatatcccaatttacttaaaatattccaattaccttaatacatgtaagtttattgtctttctttatccctttaattgcacttttatggggtattctaatttgtcatcttatcctattctccttttgaatcttacattttactttaaaaattacgtataccccattttattattatatttttactcctttttactccttatttattgtccttatattcaatctcaactgtaatacgtgtttttaacttttcaatcttattgagctctgttcttttaaactcttttacctgaattatctaagtaaacgaatcttgtgtttcttgtattttaaatcttatagtattcttttctagtcttgtcccaactggtttgacctccaatgccttgtacgctgccaggcccatgaaagacaggccataaatgttaggaaataaacagctctgcactggaccacagctggcccgcatgctggggaggaggcgcacaggcttctcccaccccttccctgcacctctgataaaccctcagggaaatcaccctgtgatcccttcaggctaacagaagaaaatctatatgaaaaagagaaggcagaaagctgaagtgataatgtttagaatccttagaagctggaattcccatctaaagacaaggcgatttaaaggtgtagacagtgattgggcttcagtgctgaacaaagacatctaaaactcaggactgataagacaaaatggacagaaaactccatgaagatgcaataaggagacctagctcaaaacattttttggactctggagctctgaaaaggggtattttctgccaagttatctatcctcagacaaaagtaaatgttttgacattcctgcaggctctgttaagttccccacctcgtgaacaaaggcctgcctagaggtgaggacctgtcagctgacactgcttatctgccttaaaacctcagtgcagtggccttctctaaacacagggcaagggtgctaactggagaagcctgcagttctctctcaagtgagaaatacctactgacagaaactgaaggtctggacatacagcaggtgtccaagactctaagaaagtaaatactacatgggttgaggaaatgacctattataaatggggtgaatatgcacccagagggcactgccactcaggcaatcaaaatattaactacttaggcttttttacatttttgagcttatcgaaagaatttcgatggtatagtgcctgagtcaggaagggggtcaatacacatgaggtgaatgagtgaatggacaaatgaataaatgaataaacaaattcatggcgtggatcaggggcaggcagtgtaaaaagctctatagaacaagaggcttaaggtctggccacaagcccaccatcaacctagcatggaatttcaagtaaatcaatttacttctcaagttcattttctgtagaaaaaaaccacattttgcttaacggagttgttgtgaagataaacataaaataaaaaagattccccccacagtattctgtatagtaagacattataaattgttatatgtcttactataaattttaccatgtaagattatatagacgtttaagagaatgataaatgaacccttgtacataccacctagcttaagaagtagatttctttgaagtccgctttgtgccttccctagttactcctcttccttctcggccaataatctctagtctgaatttttggttattaattcccttagtattttttatagcagaggtgtccaatctcttggcttccctgggccacactggaagaagaagaattgtcttgggctacacataaaatacattaacactaacgatagctgatgagctataaaaaaattgcaaaaacaacctcataatgtttcaagaaagtttacaaatttgtgttgggctgcattcaaaaccgtcctgggctgcatgtggcccatgggccgtgggttggacaagcttgctttatagtttcactacatatgtatataaccccaaacaaactatactttaggctgtttttgaactttatataaatagattcatgttacatgtgttttctgtaggcttaacactgacttaaaacttacacatgttgatacttttatctgtagttgataaattcactgccaatgctgtaatacctcactgtattattatactataatttagtgatctatttgactgtcagtggacatttagcatatttccagatttttgcaattacaaacaatgctgctatgacctttgttgcacgtatcccctgctgtatatgaacaatagtgcatttaggagtggcattcctggatctgtcataggtctgaatatgttcaactttactagggaatgccaaattgtcttcaaagtagttgcaccaattgatagtcccaggagcagtatatgcaagtgtctattgcatatatattcccagcaatgcttagaatgttgtcagattttaaaatttttgccaacctggctgctgagaaacgatacattattgtggtatttatctgcatctccttattacttatcaggtggtggaatgtttcatatatttatggtcattcatgtgcttcctcttttgtgaaacctgtttgtatttttgcccatttttctgttaggttctttgatttttctcttttattcatgagttcttcgttgattctctacattatttctctgtcggttggttgattctcaatactattcctctgttggttgcaaaaatgatttcccactttatgggttgtttgtccactatttttaggatgtcttttgatagaaagtcccctcatcttattgttttgctttttgaatgacttgagtattcttggtcctttgttctttcaaataaatcttataatcagcatctcagagtgcatgaacaatcctcttgggatttttattagaattgcattaaattaatcgtctggagagaatcattatctttatcaatttttcctttccatgtacatctatgtctccacatttattttggccttccttaatgtttttaataaagtttcagaattttttcataaagatattatttttgttagatttattcttaggtaccttacatttttggtttctactataaataatatttttaaataaatgagtatctgttagatactcagttggtatctaacagaaatgcagttgactttcatatgtgaattctgctatatttttctaccaatttgtataatttatctgcaaattctattgcattttctctgtagataatcatatctacatacatacataatgattgctttacttcttcctttctaatttttaaccttttacttcctttatttatagcatttcaccatcaaatatgatatttgttacagtctgctttggtgtttggcttttcttattgttttgttttgtgggtagcatttattgggttgagaaaattttcttggtgagagttttgtttcgaatgattgctgaaataaaacactttttgcatctattgagatgaacatatggctttttcccgttaatttgtcgatatgataaaatgcatctgtagattctctaatgttgagctaactttccattcctggtgtaaactcaactcaatgcagtatctttttgctatgttgtcggatttggtttattagtactttgcttaggatttttacatttatgtatatgggtaaaattaggtagtattttcttttattatacggtcctcatatgattttagtattacgttatgttaacctcacgaaataaattggaaaaagtattccctgcttttctaatcactcaatgagtatatataatgttggaatgatcttttcatgaaataatatataaagcctataaaatcttctgggcctaatggtttctttgggggaagattttaaactactgactcaatttcttcaatgtttataaaaacgtgcaggatttctttcttcatgagtcagactgttatatgtatttctctcagaattttaaatattttacctaatttctcaaatttattagtataaatgtatttatagcattcttatattctcaatattagttacatcattatttatgtattctccttttcatcctttatactgtttgtatgaccagtcttaccaggattttattttattgttcttttcatagaaccatatattggattattagtcctctttgatatcttcagtttctatttcattaatttctgtctttatatgcattattttcttccttgtctccttgggtttattctgtttttttacccgcaaatgtcttaagttcacctcttagcttatttagtaaaataaaagtcaaggccttctaaatttccattattatttcttccttgatccttgacttatttataattgtgacttttattttccaaatcatggcaatttttgagttattttgcttttggtttccgtctggttgtgatatattctgagaatgtgatatgatgccaattcctttcaacttttcagtctcgttttttggcctctatgtgtctattttttgtaaaaggtccatgtgtgtcagagaagaaaatatgttctgcagtggtggtactttttttcaatttttcttttcttaacttattgattgattgattgagatgttttcctctcattttatgtttctccctcagtagttaacggctatcataaaaataagatgtgtatatctaacttgacaaagtttaaatttaataaaaatgttaccctctccaaatcaatacaaggaacttagaatgatttaactatagtcacccccatcccaaatgaaatattgttacgtcatattttagttttatcttgattttgtaatcccttaaattgcacagtattgttctcattttataaagtcaattaatttaagatccacccacgtgtttaacattttctttgttcatcatagatttctgcatcttaagtctttattatttaccttttccctgaagtacatggatttaggtgattctttacctactagtaaattatctcaatttttgtttatctgaaaatgtctccaattgactctccttattgaaaggaagtgttgctaggtgtacaattctaagaggacagtgtatttcagccccccattttttttttttttttttttttgagactgagtctcgctctgtcgcccaggctggagtgcagtggagcgatctcggctcactgcaagctctgcctcccgggttcacgccattctcctgcctcagcctcccgagtatctgggactacaggcgcccgccaccacgcctggctaattttttgtatttctttttagtagagacggggtttcactgtgttagccaggatgttctcggtctcctgacctcgtgatccgtctgcctcggcctcccgaagtgctgggattacaggcgtgagccaccacgccaggcctatttcagtcctttaaagatgttattctggctttgatatttgctcttgaaaagtctcctgtactatgttgttcttttttggtaatctatcctttctctctgctgttttaaaggtcttctacttttttaaaaaaaataaaataaatatttttcagcttaactatgatgcatcaagttgtggctttctttttatttattctgcttgagattcattggaatctggatctgaagattggtatcttttatagattttggaaaattcttacccatattatgtccaagtactgtctatccctcaatcttttaaaaatatacttctggaattccaacaagcatatattaaagcttctcatgttttcttccatatgtctaaacctctctttcatagtttccatctttttgactttatatactgcatgcagtataattttttaactctattttccagtttgttactttgttcttatgatgtacttaaagcatcattttctttcatttctagagatgactaatatatcccaatttcacattttcatatatgcagataatcaaattttccccagcacattcgtgtcacaccaagttaatttacatatttattgaactattattctgggtctcttgattattaggaaagtcagttgaaatcacatagaaatataacatcccatgaaatgccctgcttcctgcttcttactccctgaatctcatagtcattataatctgcaggtaaagttgcaaggccaaatccttaggtgtagttgggaatatcccacaggtctaaaagtctgggcctaatgcttctctggcagaaattttcattgctttataaggttcttccaagtacagcctttgaatgacaaagtttaaaccctctagctatgccaccccttgctcctattttatcttcctcacaccattttgaagattatgatttttccattttgctgctactgaaagcaaacactagactagtggaagtttgggttgggagccagcccagtgctcactgtacatccatcctgggctcctatctagcctgttccacaggctgtgcttctatcaccagcaggatttgagggcctgggcccaacaataaacgaagtccacttggcctggagaggactactgctgtcaggtgacagctgcccctggctgggagaagaaacctgggctagactccatgccaggaaataaactcatggccatctgcattccctttcatgactcagccgttctttatgaaaggatttactgtgtgaggagtaggaggctagaagatctgaaagaagaaacagcaaaggggattactaagccattgaaacaaagatgaaaaaatagctttccctaggcaggctgctgctttgtagcgacaggaagagaattttccacttaaagaataattattatagagaaagttaatctttgtatacacaattcagataccacaaaaataaaataggaccaaataaccttattgggacctcagagataagcagtaatattttggctgataaatgctgagtttataacttagtcctattctagtttggtacagtgaaaaaaggacttaggtctggattcttattccatgctttctgtctttctatcttgatgccattgttattttggatttttcatcactctcagccaaaataatcttgatgcaaaagactgggcttaatatctaccagaatttaaaattcacatttttttaacccagcaataccacttataagattatatcctataaatatactggaatagcattaaaatatataataaaaatatcaaaagactgtgatatcaaaagaatggaaacaaactaaataaagatataataaaaatatcaaaatactgtgctatcaaaagaatggaaacaaactaaatattcaacagtaggtgactggttgtgaaaatgatgtatacattattatgtagccataaagagtctcagagatctatatggaataatctccacatttcagggggaaagatcatatattgaactttccaaatacaactgcaacaatatctctcatctcatgatgtgactttgacattcctcctatcaaaagatagggattaggtcccctcctcttaaatctgggaagcagaagtgacactgtctgatttccaaggctaagtcagaaaaggcaaggcagctttctctgtgttggccaaaaagactcatgactggagtccaaagtcactgtgtaagaggctgccatgctgtgaggaagccaaacacatggagagaccatgtgctctactaccgagtagatgatctactaccgatagatgctctgctcaatagtccttgtcttcaaatccgtccagtccagggaccagtcatgggagtgatgagccttcagatggctgcagcctcccagccttccagtcttttgagccaaggttgcagatatcatggaacctataaggttccagggaaaagtcacccctgctgtgccctttatgaatttccaaatcacagaattgatgattgtggtaaaacagttgtgcttttttgatactaagtttgaggtggcttcttgcacagatagtatgtttttaaagagttattcttcactgtttgctttttcataccatttcaatttttctattaccatgtacatacattattacattttccaagtctatataaaataaggacatttgctaggaaactatgatgccagagacaagcaggtctgccggcttccactagtaacacgactctgaaagcccaaatccccactgagcacatgtgaaaaagtccaaagaagacgaagaggatattccaggctttttagtttttaaaatcagatatcatactcccacaactatagtatgtcaacatgatacaaaccttatcagtatttttttcacaacaaattattaattgaaaaagaaaaccaccaccatgcaggatctaaaacggcattatttttttaatcatagattaaggtgcaggttgaatataaccttcacttcacatcttccaaatagtaagctagctacggtcttaaaatccatgtctagtttatccaaagaaggctttgggaggctaaatgagaacctaagatgtaaaaggttgtcactcttccctaaccatggcaaggtgcaagaaagcagcacaactttggaattcatagaggtgtcctgaagtctggtaataataggaaaaaaacccataactacccactttgcaaaactttgaagttaatagaaaaagtaggaggtaaacagtaacacaaaggatttattccaaataatatcagaaatatgcaaagaataacaaagcagagtgatctacatctttaactgtgttctacaacatttttaggtatttttaagtttctctatttcatttaattttaaacaacccttttaggaggagatgtaaccagaggcaactacttctctataaaaatcactcagcaactatatagtatacatgatacagaattttctatttccataatctctaaactggcactgtagatgatttacaaacatcctgagggacaatggcccttggtagacaccatagagaacattaatgttctggtaattttgtagaaaaattattctagtctgctgtactgcaaaacagtctcactacagagccacagggagccactgcacaggacaagaggagggggagatgggagtcacagagagcacagggagtcacagagagtcacagagcagggggacgtgggagtcacagagagatccttccctcgagggatcggtggtttgtcatggagttgattctgaaggccatcaaaaccttcctcatatcatgaagtttgtgaaaaccattgggaataattaatgttttatactcaaagaaagctgtcatttcttttaacaaggaatagaaactggggccaggaggcccctgaaaacagaggcatgatggaatgctggctgagggctcccgcaagtgatccacagccctctttgcctcagcctgcctggaaccaggacaaggacccagagcacgctactgagccggggctcagtcaacatctgtggaaagaatgactggcaaggaaggcccaaacttctccaggctccctgggcctatggatgcagacctgttaaaaagtgtcagctcctcagaaagcttggctttctccttcaccttctcacacaggacctctagtcctggcagaggctccctgaccccgtcacttcatgtgaactggttgtcttaatctctcctagttgctaagttgctctcttgccatagtacttctttgctagtggcagaaggatggggagtggggatatttctggttagtggagcaaaggcttcagtgtgtcacagaatgtggtctctaaggcccagacaactgtgtgggatctagcctaggtatcaatttgaaaagagctacctggttatactcagaattcccacctatgcccttcctgcctggaactctttgacaggaagacttttctcctgcaagctttctcagcactctgcacagcccatccacactctgcctctccgtcctcactccaccaagtcaccagtcatatctctgcagagctggcccctgagtgctgatagaactcgacttattccccaggagacacctcagccctggtgcgaatcatgagacctctcctccactgggcctgtctcatgagttcacagatgaggccagtggtgcctgaaccccaacacaagacagaaagtgcaagttattggatggatgagaatgtcagagaaagtcaacaggacccggtggcaaattttaatctgtttgctatcatagaaacttgggaagggttttaggtatctaaggaagaaaaaagctcttcccctgctgttggaggagagttattggaaagaaaccatcttcataccagtttctttccccatcctgctatatttctctctcccttctagtatgtggttaaacaaaattgggagcatactatatgtacagttttctatgctctagggagcacttgttcatataatttcaagaaagcttgaaaacattctttcattccactcccatatgttgaacatttaacttgttcccaatttttcatttttataaataatgcatggtgaatattcggttcataaatctttaactgcaactctggttattttcttagactagagctaaaaaaattagagtatgggccgggcacggtggctcaggcctgtaatcccagctctttgggaggccgaggtgggcggatcacctgaggtcgggagttgaagacaagcctgatcaacacggagaagcctcgtctctactaaaaatacaaaattagctgggcgtggtggtgcatgcctgtaatcccagctacttgggagtctgaggcaggagaatcgcttgaacctgggaggcagaggttatggtgagccgagatcatgccattgcactccagcctgggcaacaagagcgaaactccatctcaaaaaacaataaaaataaaataataataataataataataaaaagattatgagggcaaaggatactaacataactgaggctatttatttatattaaactacccttcagaaaagtaataacttatagtactaggaatacccaggcctgattccacatcttcaccaaccctgcataatatcattgttttaacattgctaattacttttaaacaacccatatacaagttgtacctcactgattctaataacgtattttccctcctctatcttaacatctctgaattcactggcactttgcaatacctggcatctgccaatcactttagaccagtcagtagatgccacttagttatctgtgatgagtgaacttggttgttcattctagttttaccattgaacaactactatccctcaagatttcagtcaaaaagctcttagggaccatttgaggaagcagtgttagccatggttgctaacacatcctggtaagatcaaagcagaggcagcattaaaatgtgcagtatgggtgtcagtggcttagaagaaaatcctagaaacaaaagcagagcacaatgcaatgctgcaaccccaagctcatgaaggcacagggaataacaccatgtgcaaagcacagacctctatgactcttgggaaaaaggtgattctggagagttggactctgcctgtgaagttttcggcaaatctcaatccctttatttcttttattattgtatgtgttcacaagagataaacatctatgtctcaacaactctaaaagagatattttgataagcataagataaaaattctaagtgataagaaataattatgccatagtttaacttgcggctttcctttctttttctacaatacataaaatcatggtatatcagacttgattaaatatcatattttaaaatatgagagtattttacaataatggaaactgaagtaattttcaaacgatacataatacttgcaacaaatcatgtagattttaccttaatctgtgggtaggtcttgccctcctaatatgttccttcctccttagagaagagttagaatagggcacatttcctggggactgcagctgctccaagaaccaagaccacagttccatttggtgtggagctctgtgaaattggttcacagtggccatggcccccagggtcctcaagcttatcccaggttcctcaaacattttgaaaagagctctaccctactgtttttctttaatctttcctctaccaacattacctcatctttctcaataaaaatctctcagaactattaaagtagaatacataaacagatccattttattaaacaaatattcatcaccccccattaccagggcccacgcttggcactggacatgaactaggatcacagaatgcttcctgctaactaagaactaaaagtctaatgggaaaaattacttattaatctcaaaaggaaaatactactatacactagagaagttggaaatacattaaccaagtgatcaaaattaacatcactagaaaggggcaaacagacgtcaaccttcagatgtgataccaaagacacgtgacttatacagtattccaaatggataaacaaaagctaatcatgaggaaacattggagaagcagtggaatattttataaatgacaggcctgtatttttttaagatcgatagtatcaaagagaaaggctgaaattaaatattaattcagattaaaggagactaaagagacagaatgacttaatgccataaatgattttagactggatcttgttttaaaaagaaaattctataaatgacattacaacaattcataaaatgatgacatgtagattgtagatgaaagtattgtatcagatctgggcattgtggctcatccctgtaatcctaacattttgggaggttgaggcgggaggatcatttgaggccagaagtttgagaccagcctgagcacatattgagaaccccacctccacaagttttctttaaattagccaggcttggtggtgcatgcttgtagtcacagttacttgggaggctaaggcaggaggatcccttgagccccagagttcaaggctgcagtgagctatgatcatgtcactgtactctagcctgggcaacagaattagatcctgtctctaaaaaatacattgcatcagtttaaacttcccgaatatgataactgaactacagatatgtaaaagaaaatattcttatacctaggaaaaatacactgaagtatttttagtagaggcatgaggtttgcaaactatctcaaataattaaaaaataatatgtataaaaacactcatatagagagaatgatagagcaaatataacaaaatgttggtatatgagagacctttgtgttattcttgcaacttttctgtaatgtttgaaattatttcaaaataaaaagtaaaacaatagataattcacatgaaagtcttctgtgtatacttatttgtaaggttgtagtacaattaaagagaactctgttcttaaagtaaaaaataagatctaatagacaagaagtatagacaaataagcctgcaaacttcagtgctatgagttctgacacattaatctccacatcctgagaaatgaacctgaacaaagtcaagatcagagaggcagttgtcagcattaaacatgatttgttaaatgtgaattaagaacaacaaaattttccttctgtttcaacatcctgaaattgcattttattaagagattgacattttcgtaatcaacataatttccttcaatcctttttggaaaagggtgaggtataagtacaattaatagatgcatgattcttaccttgtccctttctcagtatgtattatatttggtcaattatgccagaaagctcctaaatctagattgtaaatggcagctcttcagattatgtctacttattttatcctctgttttttcttgtcttattctccatatgaatcccccttacttcctctaaacctcaaaataacagtttttatgattctttcagattttaaacagagaattatgagtagatcatcttggggattatattcatattgttgacagaagacaataccacttttttccaaatcactgaatgcccagaacctggtagtaatggtccaagaagttaatggagacagagagagttaagacaaaatatttttgtttaaatttaaaatttgcaattattatggtattttaaaaatctgacttctcttcctgcctcttggtcataatttctatttattctacttttgcttgtgttctgtaggcatcacagatctcatgccaaggctctgcccagtgtagagagctaagtaacacgaaagcactgaacatcccaaagaaaagtccagtttccatacactcatcagttatgactatgtccatgctgtagattcctggaggtaccaatggagttgccagttgctgtcacttcatcaagggggaggatcctgcaaaatcttccactggatacagagaggtttccagcatggctctggggtctagattttttcacctaaaaatctacagggaccagccagtcatgcaggtgaataatgtggttgagagactacataccccgactcaaggtatggccattattctgccatttagaaattcaggcccagtaataccaaagtttccaattcttaaagagaaggcagaaatccagatttttataggaaatccttaaatattggcaatttaaaaagagcaggttcaatctggcccacaggcacctagtttaggatctctgctacaggttttaccaactgtgtctacaggtatttaccaactgtgtctcctcactaaagagtctggcagcctgggagagcttcgctatggaatcatcaaatgtctccaaatcttgaaaggcacagaggggcaaggagctaactgaactccaaagacatcatggtgatttagaggcaaataatatgttttctagaaatgatgagatttttttccccacctttcctcctaccagtcttcccttctgtcctctcaaagaatgaggtacacaggcctgagtgaaggacaatctcctagaaccatgaccaaagaacagtggctactgtgaggacagaaaggaaatatgacagagtaactacagatccaaactgagggccaccaaataccctgcttttgatcaacatctgggggaaagaacttcaaggtttctttgaactcagtcagcctttgctccaaaagtactggccacctttcacaacggcatcaatggaatctcctgtccagattttgggctgctgaaataaaggatcatcggctcctgggagatggatgacagccatagagtaggaagccaatagtgccctccagccagaggaagcaaatacaacaggccagtggggaggaaggcctgtttttaattctcagtggcatcatgctgtggctcagtgagggactctgaatggggaggaggccattacttgacatataattaccagtggcagcaatctaccaaagaggctaatggagatccaagggctatttcagctttttcaagaaacaattcaaagccttgtcagaataaaatccacatttcctctttctccttagtacatttccctacctagagtcaagcacgttaagacactgttcacagctgtaaagtgaatgctagctcgcaggtgccagccccgtggtttgctttgggagccgatttaatgaaagctggaattgggaccagtaaagctttcatttcagggccattctccaacatagttgtctgacaacttaactgggaaagataaattatccagagagagattactatgcacaacctcctttttctttccaactcactccagagtaattccaacctccagttaccttccaatctgtctgctgaaaaccttttccttgtttactgccatctgctacataggaaacccagacaacctccatcctcactactctgatttaaggagccagacagtaggtgcaaacccggcttccttgttccaatcggctgttatgcttcttcactatttaaacgtgtggtcagggagcattctcttagtaattcaaggggtcaccatctcaaactcttcctttgctctcaatgtcattgcgtagttatagtcagtaggcagctctctcggctgcctacttttagatggtgtaaaccctatatgtaaaacctacatgtgaggtgtaagtgggtgtcaatctgggcagttggttaatatgttcccagactgtgacataaaccaataataaatgtaactgaccagcagggtttggctggaaatgaaaatcttacacattctctgcactcgcactggcttttaccatagaatattttattataattcataattgtgtaatctccaagaaaactataagaaaataagggaaggaaaagggcagaaaaggaatgatttttctttgtcctttctcatgcctgttgaggatgacatttctccttttccccaaaaaagaataaagaaaaataggatatcaaataaaagagaatagagttttcccacaatctctcatgcatctagaccatcatggtccacaaccctgcatttctgctgcctccttctttaggatgatgagtaaaaatgatttttcaaatccactaatcttataagcctttttgtgcaaatgtctctctaagtatttaaaaacactgtaaaatattgtattagtaatacaaacacagaaaagaaactatttattcagagattttgatagtcaccaaatctaaagccaaccatgtgtgtgttattcccacagcatctaggattattagaggaaaaatatgttttcttttaaacaaaatgaaaacatgatgctggatcacatttccaaattctttttcttaaaagagagagaaaaaagattgaatctattttcataataagtatggatgactcttggaaacaatgaacctttgtttttactgaacttagcagtataatcaagaaactgtacattttcagtgtgtacatggaaattctaataaacataaaattcatcctcactgtgcatttcaaaggcagtctattcctatcatcaaaaaagcaaaataagaaaatggttcccacagaagagaatcccaatttttctggttcttgagaaaagcatgtgatctctgttttgatcctaactttgtaaccagataggccattgaggaacttggaggaggaaacaatcagttgtctttgaggatctcagttttatcataaaatgcaaataaataaagtggctattgatgtgaaaatctattacaataacttgtttaccttttcccaaatatttaccgagcagcttcctataaggcacctcagtgctagaacctggagattcaaaaagaagagggcgggccctcaagaagctgagcctagggggcagatccaaaaaagtaaacataattaagaatagttataagagtgttaagggaggccaggtgcggtggctcacgcctgtaatctcagcactttgggaggccaaggcgggtggatcatttgaggtcaggagttcaagaccagcttggccaccatggtgaaacctcatctgtactaaaaatacaaaaattagctgggtgtggtggtgcacgactgtaatcccagctactcaggaggctgacgcaggagaattacttgaacctggtagacagagattgcagcgagccaagactgtgccactgcactccagcctgggcgacagagtcagactccatctcaaaacaaacaaacaaacaaaacagcattgtgggagattcggtaaagcacacaataggtctcagcccagatttcaatacctgcaagaatctactcaaagaaggtgtggtctgttacaaaccttaaaaaataggcaagtggtgtggagaggtagtctgaatctaaaaaagagcatttataaaggtccagaggccagagagagttgtggccctgtggaaggcagttcaacatgattgcagcatgagggaagaatggggaaggacggggcgggagaaactggcagaacccttgtatcttgaagggccttgcatgccattccaaggtatacggattttaccctcaaaggtctttgaaggtttgggagtaatatggccaagttttacctaaagaaaggtcatgtagcttccagtgtgtataatggatgaattggtgggagggggggtaaaacagaggggcagagcaatccattaggaaatgggagatggcggtgacttgaactaaggaagtggcagaacagataggaaaaagtgaaaaaaatctagaggattaagtaggaacaactgacaaaaactgattaataacttgatatggatgatgggggagaggtccatgtttctgttttgggcaaatgcttgcatggcggtgggaatataggagacagagctggttgagaaaaggaatgagaaagtggagagatcagtctgagatataagttagaggaatctctggaccattcacatgaaaatgtcaggagatctctaggtcttgagctggagagacaccatcagggagagaatagagagttgggagtcataggcatacatttggtaactgaagctacaggaacggaccagactacttgaggtgaggttttccaacgaaaagaaagccaaatctagatcccaggggaacaccacttttaagaaacatgtattgagaaatgagtaagccaaagggaagacagcaaggtaagaagaaaattaggaaggtggaaccatggatctgagcgaaggcactgttataaaaaaggaaactggtccacatgattgaatgcagcagaaaggggactgaagagaaagtgaagtcaaagtgacactggatttaatgagggggattactcattaaatggtgatcttggcaaggaaactttcagtggagtggtgagtgtggaaacttgattatggaaaccagatgagaaatgaatgcaagtgagaatgctaaactggcaaatgtcgaccattctctcaagaagtttgactctaagtccttgaaggctggcactgtgcctcattctctgttgtatcctgaggtataatatcaacaagtaataaataaatatctgttgaattaattctaaacaagggaagaagatgaggcaaaggctactgggaggatgggtcaaggaaaaggatgagattgagagtaaaaatgagaagtttactttagacaggatgaaatctctcttccagaagaacaggagtagaagaggtcacaaaattgaaataattttcatccactagctttagttttattgatgaattcagaagcaaggtgatctactgaaaatgtccatggaaatgatgaagtaagtagatctagaagagtaaatagcaagctttgcaagggaaacaaaaagatcagtgggcagctgagggcccacttgagggtggagggattcaccctgtgtgacaaaattaacacagacatggggctgggggatgaacagtcctcagaactagagactgcaggaggatggatctgggattgggctttttctagtgggtaaaaaaaaaaagatgccagaggaagggaatctcagatatttgcaattggtccacgctagaaggaactgaagaccaaaggaaactttggtagcaagtaaagtatcaagagggtcttaaagaagatcagatcagattgtagggaacatggcagaatgagagctgaaggtttgttatagagggatattctatgtgaatgtaaggtaaatacacatctatcctgttgcttttaggtctggctaccatgaccaggtgctctaaccaacgttgccaacctcatctcattgcccccaggctctcagaacagtgccttgttcctcaacccactgtgcttcttttgtgatgctgggcttcccaaggggagaaatgcagtattttactcactctgagagtccaattcccgccattagagacattcttgatatctgtagtgaatgaataaatgaaagaatgtctccgcatgtttgcacatcttctaatttggtgaaatgtagactgttgtgctcactctccctgtgtaggtacctatggagtattctaagttctgagatcccacgcaacagatccctggccctctgccatgatgttcttctgttgaaagttagggaagatgctctagaaggaactgtggggctgatgtgaaggagaggtgatgctttagtgccagatgacaagccagggagttcacagaacaccttgtggtgtagagaatttggtaaattgagtaaaaagctatctacgtgaaactataaggagtccctaagtcccagctgtagatgccatagatgtggcaaactattaaatattagatattctaattcactgtaatttattgacagtcactattagctttagtgaatatgctgaagaagttaaaatgtcaaaggtgatgttataaaaatgaattcttactccaggcatcaaactgtcatgggtggctttatttatagacacatagtggtttctgaggccatacacagttaataaaatgtgacagaatgagtttttcatgcactataacccttagttattaaatttatctcagagtcaaaatgatttagaatttttcactttgattataaattatcagtcactaaaatttttatcattcactgaattacaccaaagattcagtaaaaattatatagcaaatctggagtgggacttctcatgctaagaattgtctaagtcaatgcggcaaaagcagccatatggaatgtttgcaaagcattttattgtgggaaataaatgtgggtgttaaaatactatgtataactacaaatttaggcatgctaattttatcagcagcgagatttcagtgttaaggctaaacttcattaattcagaaagcactaacatagaactttaaaagaacagctggtgtgtgaggtaataaaaagtaaaaacaagttttcaaaaggaatatttctaccactcaagtggcattgggtggggcagcaggcaggtgctgtgttttaaagctaaagacctaggcaggattgaatctagcttttgtggggctggaagcttatataacctgggggagcccattttaagaagaaggatacaaaattcaaaatgtaaaattaaatttcaaaagtgaattttttatataaaaatatataaagtaactatttgttcaaaatgagaaaagaaattataatatttttaaaagctgagtaatgccacaagcattcaaaactcagaaaaatattttattagttaactgcctgacatattgctgttaatttacttccttatattgttgtttatatactctcaacctcttcatatagcaaatatctatatctttttgtatagaaagaaaagcaatataatttagtcttccctcaaccaaagttgattgaaacttggttttactaacagtttagaaaagtttcaagccatttcactgtgttgatgacagtgttatgtgccatttcaaatggaaccgccaaactttgtcaggctacatgcatttgatctgttagaacacagtctaacctaaggtgctgtaatgtataaaatgttatgtacttggacatactctctgttcatagtactgccacaagtttgtgctcttcaaacacagcaatcctgatatcttctaattcatgtgatttttatagcaaaaaagaaatgcatctgatgtacttataattatattaaattgtattcacttcattatcaagtatgtttctggcagttttgttttgacaaggcatagagagaattaagtcattcacttgaaatttttcatgtctgatgattggaagtattttcccgagacaagtttcaattgttgtttctcctccggccctcaattacttttgataccagccagacggcagagcctttggtcctttcccacgtgtcaagtgaaccacaagagtaataacctacatatggaagtaactataagccgcattattccaccgactgcaaactaaatgcatccccaagttaacttcccctcaaccagatcacagatacgtccagggccactccagtgccacccaaaacaagaagtatgatagaggggaagttggctaagtggtcttagccaattgcttataaaatatttcttttcacagattttaccaaaacaaatgtgaatacattgtgatgggcccctggagcaggcagactaaagtgcaagcttcattagcatcacagttaaccacttctgggcctgggcaggtcactgttttgtcctaagcatggcactccggaaaaatcttaatttgtctgaacttcagtttccccttagtgagatgaggctactactactactatgtgtttcacagggctgttgtgagctcggaatgagttaattcatgggaaccattatcataatgcttggtaaacagtaaatgtttaataaatattagctttcattattaagcaaaagatgttataaattgcaggatactacataacaaattggttagaagaataattcatataccaacaaacaataaagacattaagcagacacaattgtcatgttagttaaagctaatttcctattttattattaccctaaataactatatatatttgaaaacaacaaaactactttttaaaaattatatctgaccaaaagctcgaggctgcagtgggctacgatcatgccactgcacttcagcctgggcagcacagtgaggccctgtttcaaaaagaaaaaaaaaattatatctgagagatttaacttgtacagatggaataccacctcttcccatctcactatatttgaaatggggttggggtggggtaggtgatttgttgccctatagtattttaggaggaagaagaatgtttcttttctagtattaattgttctaactggtgtgttatatttcctttcctaggaagcacataaagaattccattcccagaaatcaaggtttcaaaacatcttcagaagcaaagtaaacaaaatggaaaacaaatcttaacaataattttattcataggaaattttttcattgctaataaaatctaggaacactataaacttttttcagactatacaaattctttttttaccttgaaaatctaaatatttattaagtaataggtaatactgcacaaaatatctaagtgagaaagcatgaggtattttagagtcaaatttgacacagaagcctctacataaatgaatatacaatctttcaaagtcataaattagtatgctgcaagattctccagacagcagggatcagaataaactgagaaggaagaaatatttcctgccagtagcaagcagtaaaaatgccaaatgcagggaaggaggggaagcgttttaaaaatcaaatggggttcatcatgggaccatacatctgcctaaagcaaaccagattataattcgtgttttattagagattagacttgcaaacatcttgagtttcaacacttgaatttgaacggctgaggacctttctcatggtccctaaaaatgtgcctctcctttcaaaaagaaacaaatcattgctttctattccgatttttggcttctcaatagcaactcacttcttggttgtactctatgggaggcacaataaataccattgacttaaggaatcgaagtccactgaggtgaaaagcagtacttgtgagggctcaggtaggagacagaaaaaatcctggcagttatctcatttttcatgaagaaaccaggctgagctgtgccaagcagacagctatgagctcactggtttgaaataattacgcattgagacttttcctcaggacagagctaatgggtttatgcacgaaacatagctcaaatattgatttacggggtttctcattttaaatcagtaatgagtaccctttacctatacttgggcctgacaaagttctctgttatgttaactgatgaactagattaaatagaaaataaatattcaactaaagcagattgttcttaatacacatttttatgtttggtggcctcattcctattttaggagatgcagaaatcaaagcctcaaagaatcaaaaatgatagaagagcttttcagaggaataacactccattgttgagactcagaacttaagtacaaactgaagcaaacccaaaacaaattgctctgtttagcccagtgccaatctgagaagcgctctttttattcaagatgagatgtgctgtgacgtcaaccaaggaaacagaaacatcaaaagtggacagtattcaaatgatttctgtgggaagatgcagagcaggatccaaaacactgatctatatatttctgcatatgtttgctccatgcctaaagaaacaaggagaagcataagggaacagcaaaaaattcacctaaaacgcagtgatgcatgctgtaaatttagcaggtccttccaaaactcctaacctgtgctgtaagtaagaaaagagataaatgcagatctattggtgtccagcactcgcctggtttttagacttattggatggcagtgtagaaagtcttcatttattgtctaagtggtatgttttgtctaattttgttattttcaaataaagcattttttcatatatactgcccctgcccccgaatcctattagtaatgacactgccattgatgacagaagagccaagaaaaagttgaaaatattccactgtgaaataaggatgcagaggatgttaaggtagcagatttgctaatataataaacaagagttaacagagcaaataatatttcattccactaactggtagatgttgaataatatagttaaatggattggtaagaattaaaatgaaaaaatactatatactgttgttgatgatattgaaaactgaccatatttctctcaagaagctcaaagaatcgcatgctattctgaaggcaaatctgacctaagtccaaaaagactcagccatacaaaccttctttgttgttttcccctttctccattcctcccctcctcaacatcttgacaagatggctctttctcatcattcaggccttggggctcaaatagcaccttctcaaaaagcctttctctgaacacattatatacagcgtactctcctatcagagctctaccccattattctggtttactttctccttaacacatcttttgaaatcatcttttttgttcatttatttgtgtatcatctgtctttcccagtgcaccataaactctgtgagagcagggtctacatctgtaccaccagcatctcaaacagtaacatttattatgttcttagattgtatgggtcaagcccttatgacattcttgcttggagtctctcatgaggttgtacttagatgcagtgctggctgttggttgcaagccttagtttctctctatgtgggcctctgcttgggactgtttggatgttctcatggcatgggggctggcattccccagagcaagcaatccatagcagaaactgaagtgccgtttataatctggcctgagaagtcacaggatctcacttctgcctatcctgtcaagtcacatgattcagcatggcacgagactataggagtgaataccaggaggcaaggatcactgggtccatcgggagaggttggtgctgttacagttcactgtttttaaaaagcaagcctttgaggttccaaaaccttgtatttttatacactacttcaacatttaaaggacttgaaaaaactcattaaagctttctacttttctaagacatttgaagaaagtatgaatttctttttagtgacttatatggtttgaatgtgtcccccaaagttcatgtgttggaaacttgatccccaatgtggtaacgttgggaggtgggacattcaagaggtaagtgggacttgagctctgccctcatgagtggactactattgttattgaatgagggggtttgttatcatgagagcgagttccttataaaaggacaagtttggcctctcttgttctctctcaccctttcttgccctaccaccatagaatgatgtagcaaaaaggccgtcgccagatgccagcccctcaattttggactcccagcctccagaaccatgagccagtgaattctgttcattataaattattacccagtctgtggtattctattatagcagcacaaaacagactaagacagtgacagaataaatgaaaagaataataaaatgactactgcccccttcactatgtatttaataacaagttactggttttgttttactatctatttagttgagaatgtgcagcactcaagctctttgaatgtcaaagtgggattaatgccaagtgcagacaaagctgggaggagtttgaacaagtatttggaagcaagtccccagacaggatttgcagcccatgtctcttttgagacaatgacatatgcaattcttctaccaaaaatgatctcacttgttaacagttgattgttcaggggtctggaaaggatactgtattattctggcagccagagtaaacttggggcaggctgtagccatgtgtaacccttatcgtcttagggctcaaaaactaaggaaggcaaatatatttgtaaagttgctgaagacaagagttatctgtctggattttttaagtcataatcattctgtacaaggtgaaaggaagaacaccttctcccaattatttcagataagacagttgaatttctactacaatgactaaaactaattacgtgaataaataaatagatcaatccatcaataaattaactaaggagcctgaagaaagtattaatttctttttagtgactcctctggcttgaatgtgtcctccaaagttcatgtgttggaaacttgatccccaatgtgagaagccttaagatttacctagaaaaatgcctgtttggaaacacagaaagaaaataattagaagggagaaaatggagccaaacaaacgatgttagtacaagtaggagtgaaatttaaataaaaatgagaactctaaattcactccaaaaaatcaattcaggagaaattatttcagaaggtaaaacacagagtatggttcttctgctcctttgacatcaaaataataagggaaactgttgctttctggctcaaagctatagaacacaaaggcaatttgttatctaatacttgacaactgatatatagcttaggggaagcaacactaaatctcagatactctattacaaagaagagagagaaaagcttcaaaatctgttttgcctcagggcagaaatcgtttcaccctcagtccattaaatcacattgactatgatatcaaagtgaaaactcattagggcattttatgctttcatgcttgagccctagtgttaccaatgcacccaagagaaaccttccttaagaaactcaaaacagctggcaccacatttcagggaaacaaggcagctggcctacagctggagagtatcagctgaatagccaagactggagagggatgagggagtcagccaaagagcagtattttctcgagataattctgatctagcagaaggatgtgcttttttatttattagttatagcttggaaagggaagcgtttgattttagaaactaaacccctagtgtaagtcaaagagttactaaggggaagactccttgaaaaagaaagtttttgccttcttgattttgacttttctgtagcatataaactcaaactcaggagacaagtgattttcagtctcccatatctctacttcctttgacttttgttttgctcctaaagtgtcagcaaggagggaggtagccccaaccagcttcatgttacaaggacctttcatggcactcatgcttttggcctctgaaggcattgccaatgtttagtatttctatataatgacactactgtgaagtaaagcctttccataggaggagctatcacttcagtgtgataatccactagcttggtgagacttgaattccaactggcaggttcttctaacctccaaagtgcaaatgcaggctgctttccttacacagcagactgagcaaaaaacaccagtaacttttgcaaataacaaacacacatatcgtttcccatcacaatggcaaatgtcaaactgctgtttttgctttttccaaaagtgcgtgaggtggggggggggggcggtgccggaagcattctagggaagacttgcacttacttattttgcatatatgataaaattaaatctaaccaaatacctgcaacacgtacacttatgctgcaaatattccactcctagtggagtcaacagcaatagatttcctagttttcagacctggaactatctcctctgacatagttctgacataattctctgggctttttttcttctcatcacagcctttttttgcttctgttgttcatgaaaaaagatagcattttcactcaggttagagggcaaataagtttttacaatttttatatagatatgaatcatcagtctaatcaccaaggatttgagacatggataagtcaaaactacagaagaagtcaaatctaagtaaaaataaaggaaaaaagctcaaaatgccatcttaaataatgtggcaatagcgtgagttgtttcatttttcatggcattagtggtggaacttcaaatacatagcatgtggtggctagaaaagtcttgaaagattagcctatgcaaccctcattgtacaggtaggagggcaaggcaaggcaaagaattcaagaaaatttgaaaatacagtggtacatgacatagacaatgcaaaagagcagttaagaaatcagatattactggtactggaatgctctgtatggaatgttgctgaatacctttcagcttttttctttttctttttcttttttttttttgacagagtgttactctgtcgcccaggctggagtgcagtggcatgatctcggctcactgcaaccttcatctcctgggttcaagtgattctcctgcctcagcctcccgagtagctgagattacaggtgcccatcaccacacccggctaatttttgtattttagtagagatggggtttcaccatgttggtcagattggtctcaaactcttgaccttggtgttctgcctgccttggcctcccaaagttctgggtttacaggcgtgagccaccacacccagcctcagcttttttttttttttttttctgagcagagataaaaattaggctccgttctctaaacatacaagtatcaggcaacacagagacagagatacagctcaagggtttgttggatgattggaccaagctgacctgttatcaaaactggcttctacatatccaacatactgacaatccatgcatagacaactgatagttctactactgctgttattttgataagatgcatgggaaaatgaggtcttgggcctcacaagaagattatcagtagcaaagtctggccaatgggcttggaggttccatgctttccagagggacacttaataatctgcctctcatagggcaaggagagttcagcaaatattagggagttactgccctttccactttagacaaacaccagcagttcccctttagttcaatggtattcgcacaggcgttatgaaagctgttaagattcagaaccattgtcagaggacttggcagaatgtaacctaatcttttctgactgagagacagaaaactggcccaaaagtggggctataaccttcagtcacctgctggcattgctgccatctgatgcctaagaaatgaggatccagtgtgtctttgatgcccgtcaaagctttgaagctgggtcaagaccaggggacaaaggcagcactgtttatgcaaatctggaaacaaaagaagctaatctccaaagccatcagaagtaacatcagaaattcaatacccagagaggattagaggccctagaccagtatgaaataggaaacctaaaagcaaagctgggcaacacaccaaaacacatactgtaggaaggaatcctgagctggccagagcctggctagatgtgctcagaagtcttgatatatgcagctcccttagtcaagaggcaaccatctgtgtgccaaaggaaggacctcctgggcagctgctgcttctctacctggtgcacacagctccttcataagaaggtctaatatatgccattgcaaggctagctctcatgttgccactttccttgggagttcagtcatcatcaagcacgtgccttcccaaggagacaacactcttagcaaacacctttcgcacagtataaaacaggataaaataccacgagcttcctagaaaaggattttttaaagccatcccccagagatctaaagttgggctgagggtccaggaagcatcgattatgcagttatgtgaacattcttcagatatggttatccccatgaagaggaaagtgttaggtcaggaaaggactcagagaacatctcatctagagatttttaagcaagactgcatattaccaccctttgggaagttttcaaaatacgtcaattgccctggatcatcaaatgattccaataagtggctgcatttgaaaagcacaattttagcacatttcccttatgttacaggagaaactaagtgacttgctcaaagcagcctagcatgagcaatgcttccaagacctttcacaggacaacacagatagcgtatttgcacactagggaaaaatgaaagacgctgcttttggctagaggaaactgtcctggagaccccactgccaccagcctcacttcatctccaggtgattgttattttcttggtgggatgtgctaagctgtggtatgcagttcacatttttgagaaggataaaagatacaaaaataaagtggatgcataaacttaagaactttattgtagaatttttgccctgtcaccaaaagagcacaagaaaatagggtatggaaccatataagacttaacaactgagttgcaatcttccccacaggaggctgctgtacatgcagttataataatgctgctatatcaacttcttaaaaaatatttgttgtgcagcagcaacaaactcagaacaatcctctgtatagcagaacagaactgtgtgaatttctaaaaagccatattttgagttcatagctagtgaagacaccagggttagggactttgtaatatcatgtaattaaggctgaactgccagctactaaaaacaggctaatttagtagactgtttacatttgtcacaaatgaggggaggaatttttaatggtatgccaacgggaaaaatctaagaaaattaaatacaagaaacaaagaaaccaagattagggtatataaggactgaagtggctcaaatgaattctacttagtttaaagaaatgcactggtttgatttccctgtactctaagatgttcattagtaggtattttttcttctgcaatactaaaggcttaatgaactcattgtgtaagatacactgaagaaagaatgtgagggagtgtcgttttatactgagccccagtgcaaggagcttcatacagtgggtaaaacatttggggcattgtcttttaaaaaatctttttaaaaaaatagtcactattagatggagatggaacatatgtgcttgacttaataataataacaaaaaaacacaaatgatgcatgcctggctgggtttctcctatgtaatcctgtacattactacttctcttaataagaaaaccccttggtctttttgatggcttaagcatctggaatctgaagtttagaatattccagagtatgccaactttccaaactctgaaaatcccatgatctgtactttaagtgcatacatagccttctaggagctcatcttctgcagttcccaaaccaagaagaagtgcatccaaatcacttatgtacatgcttaacacaccaattcctaggaccccgctgtggaccatctgatgaatgtgactgaaatgggccccagaaatccatgtatctaacaaatgctccaggtattgtgatgcaactggcctctgaacctgtatttgggaaacactagttgaatccagcagccttacactaaagggttggcagaacaatggtaaggaccatgtccactcatggacaatgaactagaccaatggggacaagtcacttttaggccacctcaattactaatttcaacatgattacctggatttatccacatagacaatcagtgatggtggaataaataaaaggatgtaacattttaaaaatccattgttttagaaatccatagtttgtcttgctaaataaaaagcttacaatggaaaccaacgtacccaataaattttattaaaatctaacaagattgaggaaaggcagagaagaggcttgtacttttctaaaatattttcgtatgctggctgtttcaagccttacatgccaattccacaaaatccatttgcaacacaagagatggtctgactgtctgaatactctcccgcccaacctgtttctagcacaaggaaagcagtggcgtggaagctgcatataagcttactgttcaatggtgcagtgatgacatgaaaaatcctgattccacttggcagcaactttccactatcttggcgggtgtaaaccataatcattgtggtgtgtggtgctgagacaggattatggggctggctggcaaccaagaaactaaaaaacagtctattagtccagcaagggactccgtgtcgggaatgctatggccccaaatgtctacaaccacacttttcacaactatcccaagaatttaagttctactgttagtctctagaaaattctacctttcccaagactctaaaatgcagcagtttctcacttaatatggctttcagggagaacaccaatcaatgtacctccacagactctcctgtcttagagttatgtctctctcttgtgagaatgagatacttgccttcaccactgccctccccatctccaaaacatatacaatcactctcagaaagaaaagggactggaaagaaacagtcctacttccctcttggcagcaattgtatgcactttgggcttggcagtccaaatggggaaagctctatgtaaggaacctcctctctgcagcctgatgtatccctcaataggtcttgaagtgattcaacctggaaggtaatgaactattccaataaagccaatgtgtgaatgaaatcaggtactcatgaaaatgcttcagctcagcagcttgtcccagactcatcttctaccatactcttgggggtatacagcccaagatcactattctaagatcattatttatgttattatttgtgtttctgaaagacatatcttctaagatgtcttcaaacattaatcagaaaacactggagggaaggagattattttgcattatgtttgcagaggaacaaaatcttatcagttaaaccaacaagtcaggggacaggccttagcttgctgaatttgacaaacaactaaaataataattgttgcttcaattaagtgaaacacgttacaaagtcagccctagcaagatgtcatggagctattattcaaagtctaactctgaaaggatttctgtatggtgctcctagagaggaaaagaaacgccctgcagccaaatctgaggtttaattcatgcaagagacttggctaatgccacctaccacaaatgctgcattttcacggatctgaactacagaaagttccagcaaattaattacagccactctatttatattctacctgacttttcaattattacctataatgagatttttatttttatgaacattaatgcacagctttcctaccagaggagtagagagctaagggaaaagtaatacaatcctgatccttttaccactaggtcactcgctggcagcttgccaagcctgctggttccccaaagtagttactgcttgggtcctagggttccttcagcagcctgaggtgggagcaaagctcaccacccaaatgtcaacatgggtcaggcaagtcaagtcaaagaaagacagcggggactaactgcaagtgcacacagtgtgggtctgatggggactgggctgcctggacaaaatccaggggacagcagctactcagctccaacaatagttgctgtgtatgaatccaggcctggcaaggtcaggtgctggttacatggcatgttttgtctgtgaaaagttaccaagttatacatttatgatatatgaacttttggataaatattacacctcatcaaaaagttttttttattagggccagaccttctagaggccagagagacaaggacaagagagcaggacgggtgttatcagagaggccttcagagtacctgcctggaacaggtgttatatgaagctggcttttattgtgccacccagggcatggctgtagataggctggcagtgtttaaagaacatgggatagagagatggattttaaaatatcacacttatccagaactggatatgtaaaacactcatatttgggttaaaatgaaaaggatatatgtatatgtatagaaagtttctagaaaaatatgaaagaaagtgttaatattggtcactggcaggtggtatagagtagatgggagatttactttttgtgatattcccaatcatactttttttattactttcccatttaaaaaagtcagaagagcaaattcttaaaataactgaagtactattaaaaatccataaagaccctaagggattcaaatttttaaaaactaacaatttttgatatgctaacaacatatcaattaaatgcaattaaatgaacaagtcactcttttgaaataaaaatgtcaaaacatagaatacatacgttttgtaattcctgatgaataatagctataatttaaacacatatggtaaaagttcttcatgatatggtaactggggaataggtgtagtggccataccataggctaatgattttctttcagactttactgtatgttgttatgctatgtcaagaaatatgcagaaacaagccttattattgtcctactatagtcctatataagccttataatggtcctactatactgtgccatagacttggagacggtgccacacagcaatatgacccaagtgcacgtttaagtgttggaaaaagaaccaagagacaaccagcagccttctcagttacaaggcattcattgttcattcctatgaccaccagaaacagacaagcaaaaggaacctaagaagcacatgcttatgtatttggagtcacaaagaaactccctggcctaatcacttggataaaggagctaaaaacagatctgagaaaaccaaactctgcttaaaatactccccatgctcctttaaaccaagaaggatattcattataaaataatcagcattaaaacagctacacaggattaaaaatctagaaatcagttatctcattccataatcaccatgggaatctcttaactgccctgtgctttagatgcctcatcatggaactcaatataataaaaccagggcaacttaggcattcttactaattctgtagttaagctgtcataactggaacaacaggattggtgtcatttattagtcacttcagtttttacccagaggaaatattctgagctccaatcatattttgaaattggaggttgcagggaggattgataatttcttcaatcatttggaatgaagctgaatttaggggacaaccaaatctaagactactgattaaaaagcctgaaaaatggaatctctattttaccaatatgaactgaaaatgtagccaatacgtgtatgattagtgccaccttaatcatttgccactaataatacttgagaaatttctttctactgttatgtagctatgatcacagcaagtgacctgcatatttatgtacaacccacattttagtcataatctgtccctatgaaatataccaaaacagattagagttcactaaaaagtgcctgaactaagtgatgaaattatcaagacagcggaagagaaccactaagacccttgcatcattcaagtggaaatgacaattcttatttgaaagaaacactagcgttcttatcttcccaagttgggtcaaccgacagaagcaaaaactagaactaattggtcttttcacaatcttaagcagaccatctgtactcggtctgcaacattagctgcctgggtcacatcctggctccaccatgcattagcctagtgacctcaggcaagttatttatattctctgtgcctcggtttccttctgtgtaaagtgatagagtagaatgtaatggcatctcccacctagggttgttgtctggagtaaatcagttttgataccaaagtgtctagaacagtgcctccatgaatgtatccttccttccttccttccttccttccttccttccttccttccttccttagttctttatttttcccttcccttaccttttcctttttcttttcttttgagacagggtctcgctgtgttgcccaggaagaagcacagtggctcaatctcggcttgctgcaacctccacctcctaggttcaagcaatccacccacagtctcccaagtagctgggactataggtgcatgccatcgtgcctggatgatttttacatttcttgtagagatggagtttcaccatgttgcccaggctggtcttgaactccttggcttaagaaatctgcccacctcggccccccaaagtgctaggattacaggcatgagccactgcatccagataaatgttagtttcctatactaatattttttgttgttgttggaaagaagaaactaaacaaatttccatttgaagattttttaaaatcttgattttgaaaggtaaaggtaaaggagataggagaaaaaggaaaagattcaaaagaaatagcaactatcattgttagtagcatttatgtaaaagacactgtgcataccttatatcatttacttgtaacaataactctttgagacaggtgttactattagttatttgaagataaggcagctatgtcttagaggtttactgatgtgcccacaatcacacagaagatttatgctctagtctatctgaccctaagcttgtatatttcttcctccaactctggttgatgccctccacgctaaactaccagattgggaaaatgaggaaaggaggaaaaaggtgaggaaaacagactaacagacagaaggggcctaaggcatcatctgctttttcagccataaaccgaaacttctatctgtagggataacatacaacatttaatatcaagagtgtaatgataaaatatgacatcattcttaccactggtgctgaaaaatgtcactgatactagtttggaacagtttataaacacaaagtatattagtatttctagttaaacaattatgaaaatgctactgattggacattaaaatgtggagataaattcaagataatccccaaacaatgcagaaataaagtagtatgcaaaatgttaggaccatcccccagctcatcactgtttatgtttatgtcaacagaagctcctctctttatttaaaaatccataaagcggttcccaatttagtatgttacttttcaaaactctgccaaacaaaatgcccaaatctttctgtaattacatagcagttactgccttgtgcctgcacagactctgtgaatcccaactgtcttcccacaagcaacagcaggctctccaaaagaaaaacttaatgtttcatttggggcaaatgtttttccctgcgccatgcttcggttttcactgtcatggtacttggccccactctccctaatcataggtttaaggaggatgaggtcagccttccctctgttgctaaggctacttgctcatggttccactgaattaaggagaacccactgaagtacactaccacttgtcacaatgcctcacagttcccttcatctcagcatattcccaattccctaaaacttagtgcaggttttaggacacatgaaatagatatcttccttaggtccttatcacaggattgtgatatttgaaggaaaacaattagcttggtggattttgagatcagacaggtaaatgtaaaaagctttcctttttgcttatacaaagtatctctaaaatataaattttcctttgttcagactaatctgaataaacttgatgctgactgagataactgcagacattcttcaacaacagtatcttccaggtcaatttgatgatactcatttcatctgtatgtgcagtgcagatctggtccagaacttaaagtgagaaaaattatcacataacaggggagtctgaatgtgatcaataagccaggtctctcactgacccatctgggacagaaatcagatgctcctctagcctgtgagtggatgaatgagaagagtgagtctgcacagagtgagttattgtggtcagattcagaggaagctgaattctgtgtggctctgtattcactgcggttctattttacaaagttctgggtagctcacagccatttttgacatcagcatgtgctggctttgcagaatggatactaatcagtttggcatcttggaatgttgcatagagcttgggaatgagaaactagaggcaagcaatcggtagaagcacctcaaatctgtaacatcctaaactgaggtaccacctcccatcagagtgttatatctcataagcttcccagccaaatattcccctagggccagaccagaagtcagcacttccaaagagattctatggtacaatacaatctgtttggagacttgcagtcattagacctgccacccacttgaactccctgagagaaaactctggttgatgccctattatctttttttttttttttgcttgttttttgccttgctgatccctttttctagagccatccttctttcccaggttttagttgatttttactcttccttcaaaactgagttcaaactaagtgtccactcatcaagaagacatccatatccatacaactgccccaatctgatttataaatcatttggttcttccccaaaccctttaaaagccattcagatcaccttacactgcccagtaaaatgaatcatatttatctgtaaaaaaacacacatatctaaatacactttttttcagccctgatctggctggttcttattttaaaaaatgcattagaagaatatgcttgtacagcctctctgtacctcagttctctcacctgtaaagtggtataataacagtgcatatctgatagggtcattttgaagcttaaaccagaaaatgaatgtgaagttcttagaagaaccacgagctcttattattatgtgtggaatttataaataaatgtaattttgagtaagtcaatcactttaaacacatttcttcttctgggaaatagagataattttatttcttcacagaatggcagtaagaatcaaatgagttaacagtgcatggaagttatttccaaaggttctttacagctcctttgtgagctgaaaagaactatttagaaactgggatttgtattattgttacctaaagaattacacaatgttttaaagacagaaccaaaatttttcaaagaagagtcttcaatgactgacgcaagcatggccttgcacttcttgcttaacctgccaatgctggacataaaagacaacagatttcaaaggtctatgcagaactggaattctctcatctaagtaagacaccagtgtccataccatctggaacttacagggaacttaggatgtacattgatgctggttgatcctaattatattgcaaaatctatggaattcaagagccataaagaatttttgaaatcatttattccaactccctcgttttattgatgaggcaactgatgcctatggatcccaagcaaccagccccaaatcacatatcaaactagtaataaacaactcaagtctcctaatttgtagattataggcttatgtaaattttgtttatatcatgtttcctgcctttttagggtggccttgggttcaaattccagtttcaccatttattaattctgtcactttaagtgacttactgaactgatgcaagtctgtctctttctttgcaaaataaacatcatagcatcctcttaaaagtttactgtatgataaaaagaggtaatgtctctaaatcaggtagcaaagcatgtgcctgacacctgcttcaccactcaccaacttcttatggtaaatactgtaacgttttaaaaaactaaatcatgcataaagatcaaaaccatattttaaaatatctcttaaaaaaaacacaacaactaaggtaactgatatgtgtgaatttcttttggtaccgaagtggttaaaaaaaaatccttccttctggtttaaagcctggctgtcccagtgctctctttccacataatatgcccttctccgccaggcggtcacgtatggcagggtatatagtaaagcagtgtacagcacagagctgtactatatcacatgtttgctttcgcacctttgcacctctcccaccaggtactctgaggctgccaattctagctgctgcttttactcctcttcctctctttgcccaaccgctgctttaaggatgtgtctcgcctgagaacagctccctttatcaacacaagacagaaattgctccagagtgacctgggctctgtcttcctcagggggccagagtcttcttgtccgagtacctacctgacagcacatctcccctggccagcatccacctccttgtcctccacaacccactcagcggctaacctggccaccaactaacttctcgccctcggatcctcgcgtttataaaaggtgcgagacgaccaagttctacaaggtggggcgggcaggcacccgcacttatcccctggccctccccgcagcagacacagggaccaggtccaagcttctttcctccggggacaaaacttggctgtttatctttcccagggcatcttcgtctctccccgggacgtggaaccccgatgcaccggcagggacagcccggagcgctcgcaggagaccaggcccacggtggtgccatggttgggcacactccgcgggctccgcccaatctccacccctaggtccaggtccccctaggagagctaggagcacatttccagcctggagcaggagcccggcaccggaaagtcagagcagcgcactgcggcgccccagccactgcggagcccctggccaaccgcagttacgttccatctgtcgtatctacatgggaatacggcgacaggcaccctatcccctcacgtcagggctagcagtatgaggtggggaaagaggaaacctcgagagttaaaagcgagggaactgaaagtccccttgaggggtgtcccccatgccccttgtgggacaaagccccaattcgcaggctaccctccagagctccagcggtccggttctccccatcagcaccctctgcgcacactgacccgcgcgtccctccgcagcctgaccgcccgatccgccagccaccggcgcgggcagcgagggggtgtgtgcgccagattttccgcgtgcccccccgcccctccagcggctccctcgccctgcagctgctgctccgggcgctgtccgcgctgggcaggccgcccccgcgtcccgccgcggcggcccggggcccgtgcgcgctcaccagatggccatcctgctcttggggtagtccagccgctccaggcagccgaggaagtgcggcagcgtgtgcgccgcgttgcgggcgaggaccgccacgagcaccgtggggctctgcaggggcgactccgggaaaaccaccggctcctctccgtcgtcctccgagtcccgctcggcgacgaagcgcgctcggcagccttcgcggagcagggctgaggagaggagcagtagcgaccaggcgagggtggcagcagggcgcgcagccatgttccgggccgaggcgggcggcggggaagtcctggcgcgagcgcccggctgggctgcctgagggcggcggcggctgccggggagcaaggggctgcgaggggcggccgggggatgcggcttgccgcggccggccggctcacacactggcctcggcggctgcggttcccaggaccctcccgccgccgctgcaccgcccaggccccagtgcgggtgcgcagcgtacctgcagccgctggcgctcccctgcgcctcgggctcgcagacagtagtggccgaggggctgtgtgccctgagtcctgaggaaagttcctctagtccaggttccgctcgtacagctgaggtctgtggccttccctagagccgcgagttgtggccctgtctgccaatgagcctgtgagtgtgtgtgtgtgtgtgtgtgtgtgtgtgtgtgtgtgtacataacggtacaaccccaagaaaatttattctgcttttgcaaaccgcagactgaagcccttcacagtgatgcaatgtatccagttttcataatgcacctattgactgagtagagttctaaaatgaaaagtctccccaactattcacgattatgacaaacacttgtttaaccaccgcaaaggcagcatgtcgcattttcttatatactcaacttctgaaattcattcttgactgagtagacacctaataacacaaagtttgaagacttggagaattttggagccagatcagaccccgcaaaataaaagaaagcccttgggagacactgtcctgaagcctcactctactgtgaacccagtaagcctcctcacaggagggctgtgaaagaataaattcacttagctggttttctttttccgtaataagccaatatgatagagtaacaaagagggaaaattcgcgcatgttggagagcagagaagagataaggaagaaaagaaggggtgaaggaagaacacaattagcacataaaatgaaactgctggcatacactgctaaaggagatttactttttttttttttttttttttgagacagggcctcactctgttgccggggctggagtgcagaggcacgatcacaattcactgcagcctcgacctcctgggctcaagcaatcctcccacctcagcctcccgagtagctgggaccacaggtgtccatcaccacgcctagctaatttttttttttttttttttttttgtagagacgggttttcaccattttgcccaggctggtctggaactcctgggctcaagtgatctgcccaactcggcctcccaaagtgttacgattacaggcatcagccaccatgctcggctggatatttagttttgaagatatattgtgtagcctttgatagataagtatggagggtgttttggtgccagtgcacattcatgatctccaatcccaactcaccctcaggtctgtcccatagtctttttattagttgttatcaatccttctcagcaactattagaagtcttccctactgtcttttgaagtatatcacctccttcatccagctcccccaacaccactgtctccaactagcatccctaccaagacctttcttacttgcaggtgcctcctcacgacagggtctttgatcacagactagaaagggagaggtctccctttctagcccatgatttttctctatcattccactctctactgaatcttcaactgatctctatcaactcctttctctcaagctaaatacttggtcagtcttctcttatccgttaaaaaaaaaagaaagaaaagctttaaaaaaaagtcctgtgtcttcttctagtcatccctttgcttgaccaagctccttggaagagagatctatacttgtattctccacttcttcatctcccatctttcccaccacagtgcagtaaggcgtcagccctccccactgttctgcaaaaccaacagatggcctcagcattggcagattcagtaaactcttccgttctcaccttcctggacttcgattacataatctcccatcctagatctcctctgatactacttgtctctgagccaagccccttcactgtgtgcctccctatagtgtgctagtcttcccactccatatggtctcctgtggttatatcctcaaaatctatgtcttctgctctaatctcttctctaatcttcatatttttttatcgaatggcctacagacatttccttcccctccatccattttcaggaattgttcccactttcaaggggctcacagtcttgtagggaagactgagagttaaacatctgttagaagtactgtaacagatgtaccagctacagtgaagggatagaggaagatgtggtcatttccacaagggaggtagtgatgggactgttagaaaggtccagacaatctccatgttgttctgtctttcttgtttccctttcttgaactatgtcccactcatctttcaatactaaaatccgcactccttagccaaacttggtttgatagttatcatttgttcactttactgcaaacagagggagtttaaagctaggcaaccacatttctgtcttattttccttctgttactgatatggtctgcctatgtcctcacccaaatctcacatcgaattatagctcccataatccccacgtgtcgtgggacgtaattgaatcatgggggcaggtttttcccatgctagtctcgtgatagtgaataagcctcacaagatctgatggttttataaagggcagttcccctgcacatgctcccttgcctgccgccatgtaaggtgtgtctttgctcctcctttgccttctgccatgattgtgaggcctccccagctatgtggaactgtgagtccactaaacttctttttctttataaattacccaatctcagctatgtctttattcacagcgtgaggacagactaatacagttacctaaagtcaacagcttatctgagtctattttttcaaagaaaggtgaagcatctaaacctgtatggtctctaatgacattataatgaaatcggctccatggagttctcttaaaataactacaacctgctctgctctgtagatgaaatcaagggtttcccagccacataacctacaaaacacctatttaaaacttttaattgagtgctcatttagtgactgagaatattaaggtaataacagggtatgcaacagtagaagatcattgtaaatatggttgggaggcagtggaggggaagcctgggaaaaattaagtccccatcttactaacagatttgtttcataagttcttcagaaatcagtaatgtgaatttggatgtttcccccccgcataggattgatgttataagacagttaatttgaaaaaaaaaactaatttaaaaataaaagccaattatattttaaaatattcattgcttataatgctctttccatggaaaatcggctgaatggaaagtcagggttgtacacacatatctctttgtctccactgccagtagactgttccaattgattctacataaagttagaagtaagcactttctctcatatcccctccccatactgttccagcacaggggacttccatctgggacaacaaaacctcttggactgtcacccttagtgcaatgtggtggggacagggcctatgaggtggccagaggacttcttgcaggaaagcttctcaagatgtctgtggctccagcagcccagaagaggaggaaataaatgcctctggggcagctgtgataggcttgaaagagcaactgacacttggagctgaattttcatttcactggtgtcacttattctctttgtgaccttggaaacttgacctctttgaacatcaattccttcctaggtaaaaaagttttaaatgcttgcctcattttttcattcaacaaacatttatgaaattgctaaatgccaatcatttgagtgttgaatatttgaatgcttctcccttggaaaaacagggagaaagtggccagcccctcgtaagtcctgctgggccatagttggcagaaagagtctcttggctgaattatccaggcttctttcttctgtactgaaatatctttctttcactacctggtttgttttactcgcttttctgatccatcctaaaatcctacaatgtaaaatgtacttgaattgacaattctgccaatttcaacatgaaaatccttgagagaggagcattagatgatatctttttaattcaatcagatttttaaatcttatcacctaaactgaaatggcctataagaagttttgataaagggaactgaatgggatcctaatttgaagcatgggtctctttggtgacaaagcaagttttatggatttctgatacgtaggcccgaggactctgggtcctaggaagggaattaatattaagggagaaaaagagcagtgactgaggtgggaaaggctaaaattaaactacgtcagtgtcaaagttttgtctatgctctggctgcatccaagagctatagaatagtcactacggaggaatgttttccaattcaaaacaagtttatacaaatgtaaactacacttctacgtctcatttaagaatagatgcatcccttaaattatattaactcattccttcaaacacttgctcaatgcctactctgtgccaagatatagttgctggaaatgcatgaataaataagatgtgtcatataaatgcacaaatgctataagtcattttatgtcttatgatggaaaaaggagcataagtaaggaagtggggaagtggagatagctaggaaatgtttaattaaagagatgtctttgaattgagcattgaaaaataagtagcatgcatggacaggaagaattaatatttttaaaatggccatactacccaaagcaatttacagattcaatgctattcctaaactaccattgagatttttcacagaactagaaaaaaactattttaaaattcatatggaacaaaaaagaggctaaatagtcaaggcaatcctaagcaaaaagaaaaaagctgaaggcatcacgctacccaacttcaaactatactacagggctagagtaaccaaaacagcatgatcctagtacaaaaacagacacatagaccaatggaacagaacagagaacccagaaataagactgcacacctacagctacctgatctttgacaaacctgacaataacaagcaatggggaaaggattctctattcaataaatggtgctggtataatcggctagccatacacagaagcttgaaactggaccctttccttacaccagatacaaaaattgactcaagatggcttataaatgtaaatgtaaaacccaaaactctaaaaaccctagaatacaaccttggcaatatcattcaggacatgagcactggcaacgatttcatgaagaagatgtgaaaaacaattgcaacaaaaacaaaaattgacaaatgggatctaattaactgagctcctgcatagcaaaagaaactatcaatagagtaatcagacaacttacagaatgggagaaaaattttgcaaactatgcatctgacaagggtctaatatccagtatctaaaaggaacttaagcaaatttacaagagggaaaaaccaaacaactccattaaaaagtgggcaaaggacacgaacagatacttttcaaaagaaggtatagatgtggacaacaatcatatgaaggaaagctcaacatcattgattattggagaagttcaagtaaaaaccacagcgaagaagaggaggaaataaatgcctctggggcagctgtgataggctgagaattataggataaccacaatgagataccatctcacaccatcggaatggctactaaaaagtcaagaaataacatgctggcaaggttgtggagaaaaaaaaaacgcttatacactgttggtgggagtgtaaattagttgaaccattgtagaagacagtgtggcaattcctcaaagtcctaaagaccatcgatcaggtaatcccattactggttatatacccaaaggaatataaatcattctatcataaagacacatgcacgtgtatgttcattgcagcactactcacaataatgaagacatggaatcaacctaaatgcccatcaatgatagactgggtaaacaaaatgtggtgcatacacatcatagaatactatgcagccataaaaaagaatgagataatgtcttttacagggacatggatggagctggatgccattatccttaagcaaaccaatgcaggaacagaaaaccaaataccacatgttctcacttataagtgggaactaaatgatgagaacacatggacacatagaggggaacaacacaaactggggcgtattggagcatggaaggtgggaggagagagaggatcaggaaaaataagtaatgggtactaggttaaatacctgggtaatgaaatactctgtatcaaaaacccccatgaaacaagtttacctatgtaacaaatctgcacatgtactgctgaacttaaaagctgaaaaaaatataatttgattcgaaatataagaaaagaaaaatgagtagcatggactaagaaaaggaagacagaaggggaaagagatgggaattccaggtagatggaactgcaggagcaaggaatgaaacagtatgacacacttgagagatacaatgaacagggcatggctgggagataggatgggaagtagtaacagagaaagctagaaaattatacggttttatacaattttatatataatcatttctttaaaatgggcaaaggactttgaataaacatttctccaaagaagatatacaaatggccataagcacatgaaaagtttctcaacatcactaatccttaggaaatgcaattcaaaactataagatttatcacttcacactcattaggatggctactagaaaaacacagaaaataacaaatgttggcaagggtgtagaaaaattggaacattgtgcactgttggtgggaatgtaaaatggtacagctgctgtggaaaacagtatgacagttcaagaaattaaaaatataattaccatataatctaacacttctacttctagctatatacccaaacaaattgaaagcaaagtctcaaagagatatttgtgcacccatgttcacagtggcattattcacaatagctaaaatatggaagcaaaccaggtgcctattgattagtgaatggaaaagcaaaatgtggtatatacatacagtggaatagtattcagtctcaagaagggaggaaattctgacatatgctacaacatgttaactttgagggcattatgctaagtgaaataagccaatttttaaaggcaaatattgtatgattcaacttatataaggtagttagtcaaaattacagagacaaaatagaatggtggttgccaaggggatgggggtaggggaaatggggagttattgtttaatgggtatatgtttcagttttaaagataaaagagtcatggagatggatatgagtaatagttgcacaacattatgaatgtatttaataccacttaaaatagtaaattttttgttatatgtattttaccacaataagaaaataagaaaaagtcaatccatgtgatttattaacaaacttgaaaaatcatatgatcatctcaagaaatgcagagaaagcatttatgaatccaacatgaattcctcataaaaattctcagtatataggaatagaagggaacttcctcaacgtaataaacagcatctacaaaaagcccccagctaacatcatccttaatggtgaaagactgagtgttcctcctgtgatcagaaacaagataagaatgtcagatctcattacgtctgtttaatgttgtactggatgttttagatggggaggagaagaaggaaggaaagaaggaagaaaggacagagagagggagaaggagagaggaatagaagaaagcagggagggacatttaagcaaggtaaataagccgtaagatatattttaacatgaatgtggagtgttgtattagcccttctaggccaaaggctctaaaattcaatgatttattaaagtctattttactatagaactttaaaaaatgttgaaaatgggggaaaaaaagaaaaaaatcactcatgatccactactccaccacaaccattaacattttggggtaattttaatatggcatttttaatttgcacattttcaatgtgggtttgtactcagtcctcttcagtgagactcaatatccatgttgatagcagatgttgactaaatatctagagatagacatgggatattttttggaccatggattgcttttgatgtcttttcatatttacaaagccaggcattatttaaggttgcatatatgcatctgtttacttatagaaattgcctaacttactatcactttgtactctagatattagaaaaattttaataaaaatatttaataaacatgaaatataaactaacagatataatccataaactaatacattaatttaaatactactaataaaatggatatccatatacccagcacccaccttgagaaacagaacatgaccattaactctgaagccctgagtcccttcttgtcacaatgctttgttccattccccagagataagtactagactgaattttgtgttaatcagtctcttcattttgtttagaactttacctcctgtgatggttaattttacgggtcaacttcactacactagggtgcccagtttcttggtcaaaccagtctagatattgctgtgagatatttttcaaatgtgattaatatttaaatcagtagactttgagtaaagcagattacgcttcataatgtgggttgccatcccatctgttgaaggccttaaaagaatgggattctccatgaaaaaaggaattctgactctggattgcccttggactcaagactgcaaaataagctctttcctgggtctccaacttgccagcctgccttccacagatttcaggttttcaagcccccacaatcacatgagccaattccttaaaatcaatctcattctctctttttggttctgttctctggagaactctggtacatctcctaaatgtgtgttagttttgcctgcatttgaatttttcttcaaataccatacaattcacctatttaaagtacacaatgcaaaggtttttagtgtattcatagttatgcaacacgatcacaatcaattttagtacatttttatcaccacaaaaagaaacctatactcattagtgatcaatccttatgtctcccagctcgtgctactctctcactaatctactttctgtctctatagatttacctactttagacattacacataaatggaattctacaatatgtgaccccttgtgattggcttctttcacttactatgttttcaaggtccattgatgttgtagcatgagtactttattcctttttaatgctgaataatattccactgtatgaacatactactttatattttcatcagctgagggacatttgggttgtttccacttctgggctattataaatacagctgctatattagaattttaaacaaatcaaatatcttatatacgcttctataactaacattttgactatacattaggtttttagtttttatgagattcattcaagttgttgattgaaactctatgtgtgttttaaataattactttttgaaaactgtactcaacccactaaccactaacataactaaaataactagtgtatttcacaaccactaacaggtcctggcacttcatttaaaaatattgctctagaatatatacctgggattagaattgttggatcataggatttgtgcatcttccctttggtctacttttctgccaactcttggcttttgttgctaatctgataggtgtattatggtatcttcttgcctcaatttacattttctcactcaatcaatgttgctgaacatcaagttatgtttgctggccttttatgtctttttttctgtttactttcttttttttaacctaaggagtgttttgttttgtttcctaattgatttttaggagttctgtatatattctgggtatcttttctttcaattgtgtgttacagatgtcattttccttccactctcttagtgttggaaattcttaactgagatacagttaaatttaccaaattttttccatattgtcaggcctctgagcccaagctaagccatcatattccccgtgacctgcacatatacatccagatggcctgaaataactaaagaatcacaaaagaagtgaagatggcctcttcctgccttaactgatgacattaccttgtgaaattccttctcctggctcatcctggctcaaaagctcccccactgagcaccttgtgacccccccctccccgacccctgcccgccagagaacaaccccctttgactgtaattttcctttacctacccaaatcctataaaacggctccacccctatttcccttcgctgactctattttcagactcagcccacctgcacccaggtggaataaacagccttgttgctcacacaaagcctgtttggtggtgtcttcacagggacatgagtgaagcatatggtttgtgctttttgtgtcttaagaaatcactcttaaacttggggtcataaaatattcttttatattttctcctagagatttaaaagtgtttgcctataccgtgtagccaatcaccccttctctccttcccttcttgcatctgcccacatgtgtatgggtctgttgcctggctccctattttgcttcattggttttacctatccatgtgccaatatcacatacttgtaattagagatctttgtaagaatttaaattttgtttaaaaccttatctttataagatatttatatttcagaactttaacttcgtaagttctctcccttttgttcacaaaaagggtcttggttatttttggccctttatgcccacatttcagaatcagtttatcaggtattaagaaaatactttttgggattttaattggaattgatagaatctgtaaataactttggaggaaattgccatctttacaatattgaatcattctctttcttgaatctttctctgttcttgaaacacagagaataggaaattgtgtgttttgtgtacaaaaaaaggaacaagatatatgtgaacctccttacaaccaatgaatgaaaagctgatccagaatgctaggctacatttttcagcttggaatcactgtctcatacaatactgtgtaaaagcttttcttcttcttttttaaattttctttccacactagagattcacatcacaatttagtgttcgcatttcctcgagactcttactgaattaatatgtctctggctagacattacagatttttgtaggaataaaatgatctggctcaggatatcattgggaaatgagttcagcaagtgccagattacaatgaatttgattaaatccaatatactcaggggggatttcattcgttgtttcttatctagcttttttttctcactactttggttctctaatagagtgaactattgaagcatttacaaaatgagaaatcctccaggataccagacactgaaactctcctctgttctctagtggatttcactctagattgtcacaataggtattttgattctgtactttaaatactgggttgtctaagtgttcccaaatcctttgtgttcattcttagccattcacaatcaccaagacctatttaaaaatttacattaacagggaagctaacagacactcccttttcattcttcaactcttttgaaaagcacgtaatactcattcttgaatgtatcatgctttttctaagcaacagtatttaatctatttgccaaaggatggcatttatctgttgcttttttggtttatggttctttccatacccccaattattttttcttgaacataagctgaaattcttcccctgcagatgtttgaggctggttcatatagtccctaatcccattggatatccttactgatttataaaagtttccctctactcagattagcatcaaaatactcttaatgcttttaaaaatgccatcatatgaactgatttggatctttaggagtcagagagatttattcacttccaatcacttgaattcgtgtcagtgtttcatgcttcaatgacccaattaatttcagtgccattttcttctttcgggcttagcagctgctttgtggtggcaaaggttcattcaaatgtaatgtatttgagggcaacatatgaatcttcatgtgtggctttacatttcattcaataatagatgcccttcttttccctgtgtatgatgtgttatttcttttgatgcattcaagcttttctctttatttttttgactttcaatagttttattacaatgtagacttctttgtgtttattttagttgctatgtatttagcattttgtactagtaaatgtgtttttcatcaaatttggggaaattctggccaccactctttcttcaaaaattttttctgtccctttttttttctacttctgttgtttacatgcatgttggattgtctgacatgtagcaaatctctgttggtctactcactttttaaagataatttttctctttgttgtttacttttaataatttctattgctctatcttcaagttccctactttttcttttgtaattttttttggctgttaaattcacccagtgaattttttatttctaaaattataattttcaattttcagaatttccatttggttttaaaaatctttttttttctttttctttgctgagattttctatttgtctcctgagattttcattcattgaaaacatgttttacttcattgaggatagttataatagtcactttaaaatccttatctgtcagtttcaatatctgattcatctcagggttgatctctagagtatgcgatccatttccttgaatttcatatgtcagatagttttggatagtactctggactttgtgagtgttaagtggagagtctggattctattattcttctctgatgagtgttatttcctttgtattagtaggtaattttcccggctagattttaactgaaaactctctcccttttggagacagctctggtctcagttcagatcttttgtttttaactgagctgctgtgattctgttttgggtggttcaggatctctcagagatgtgggttgacagtttggggatccactctctgactccttccttgggatttcttaatctcttcagaattcaaaattttctgtcttcacttttctgcttccccagacaagaataactgataagttttatacatgcatccctggtactgctgagcctgacttctggactgcactttgccccaagctaaatgccaaagagaggagaattttcttgtggagttcttgatcttcaagcaagcttgcccttcctaccagtctgctgttcacattccagtatattcagctttttgtattgtgtccaagtgtagttcctgatcttcaagcaagcttgcccttcctaccagtccactattcacattccagtatattcagctttttgcattgtgtccaaattgttttctgctgggggatggtccactagggtcttagtctatcatggttgaaaacagaagttatgtcctgcctgggactttggattttgagtcacccttgtcctggtcaatgcgatagcctcctaaccagtctctgtttgtgtccttgctccctccagtctatcctcaacatatcagtcagagtgatcctatgaaaacgtccaggagcctccaatagcttcccatttcactcacagtaaattaaaaaatacttaaaatgtgctactctgcctgtttgaaactcctcatccttggcttccagatcacatgcttatgctagtttgtatcctacctttctgaacactcgttcagcaactcgtgtttcctctaatcctgaaacgtgggtccaccctgaaagtatggttctactttaaagttctatgtcagggcactgagtaaggcctttcccgtccccagcaatcagaaaccaggaccccactgctgaaggcaaagaggacgtatgtatcccccaactttctcagagagttatcggcagcactgacttaaagaggattaagagcttcagggcgcaggctactctttaatatttttcacgttagaatttgctcagatttgaataaacgcagagcgaaactagagagcgttcgcgcaggttctagctaccttggtcagaaggaggggctgatgcaactttcctcccagtttctgagccctctcgcactgcagctgcgagcctcggggaagcggaacccacaggcgcgcgcgccgctgcttctggccgggcgcgggtcgtggtgcaccacgggagcgccgcaccggccggcatggaggagcgcggcgattccgagccgacccccggctgcagcggcctgggtccgggcggtgttcgcggctttggcgacggcggtggagctccttcgtgggcccctgaggacgcctggatgggcactcaccctaaggtcaggaggcgcgagaggagcagggcgccgtccaggcccctaacccaggcagaacactcccaggcagctctctttctttcttcctcagtgggagactgaggacgcgcgccaccctcaccgagggggaccggtgtgcacaactgccagcctcaggcagcatcggttttgtttgtttaaacaagttgcactatctcaatcccccagccaaagccattttggaactgagagccagacagtaactccgcccctctcaagccggagatccctaataagcgctccactagttttgctgtctaggtaaatcccctttgggggataaatttatttaatcctcacggtaaccatgcaagacaatttgtgggcgatggataagatctaggggtccatagtgataaagatttaagcacagtcacgtttacacttagccttgggcccagaatgcatctttattttgaaaaggtgcagattcctaatatttcagatttcttcgaaagtttgaataggttcttgctcaaagcagagctactcacattttgcgtgtatttttctagattagcagcaggcgagatcaagatagtcctctgcttacttctgcttgagacattactgccttgtacaagtacggttccaagcagtgaatagacagtgaatggagatgtgggttttgtaagaatctcaaaaactagtctctacggtactttaacagaattgcactcttctgctagagagcaataattcataatcatctaaaaacagccaagaaaaaatttgaaggtataagtttgaagagttaacctttttcagcttctcttgcttaattttatcttcctactctgtccccttcatcctcccaaaaggtgagaaaaagaaacaatagcatggaaatattatttagtgcccttttagggaaacaatagcatggagaggcagcatattggttaggcgcatgaactcaaaatcagactcagtttaaatcctgattctgtcacttatcaaccttgtgatttgggacaagttgcttgatcttattatgccttagtttcctcacctgaaaaatggggatattaatagtccatacttacttatacggttgttacaggattaaattaatgaatatttgtaagccattcaacatacagaaagcactatataagtacttaataagcgaaacaccagtaacaactttttaagactttatctagatttggtggtgttattcagtttatatacttgtagattgttttctttttcaagttaatggctgtatacaccttgaccatcaaatctccccttttgatttctcttcttgaaggatcaaattaatttttaaaagaaaaagaacaagtaataaaataatagggggtatttgtttttccaatttcacctttctgttaatttaaaaattatgtagtttcatccagtaaaatggtaccagatttattatccccaaacacacttttattttattattctcctgcttagaaatcctcagtgtttccatactgataaaatcacatgtttagcttgaccaccaaagccttgtaacctggctcaaaattatgttttgggtgttattttcaaaacatgtttgaagtcgacaactaattaacccctgtcctcctgaacctgtacagttacagtgaagctgatgggagaatgtgactttagacctgtccccatgcaggtctgctaataattcaactcagcattagccctgcatatccacctagtcgctggcatagctgggcagcctcagaattctcctgcaggtgtaggcccctgaaaagtattccccttatgctgaccagtagtctgaaagaagcagctttctctagttccttgtcaattccttttaaaaaatctactcttaaagtgagaaagagtgggtagagaggctaggactgatactctagcagattctctccatatacaaataagaggctagggaaatacacagtacccactaacatgtcccatcacaagttttattaaaaaggtttctctattgctggcagataggtttctttacaggcccttgaatgtatgtggcttaatcccacctttgtgtaattacctgcagtattactctacttctccacttacttaaatcataatgttcttcagtgctcaacttgtatcccatcccacctctgctataaatctttcaccagtccctctgagtagagctcttctgacctgctgtgtcatgttttttattccatttacatggtttttaatcacttacagtcatatattgttatttgcctaacaattttaagtgtgcatgtatttaacaattgcaagttctttagagacagagataagatcttatattgccttttaacttccactatacctagaagaattttatagattatatatgcttgatgaccacttgatgattggaagaaaatattaaataattttttcttctcaatttgacaattatattttaattttcagtatctagaaatgatggaattagatataggagatgccacccaagtttatgtagcgttcttggtttacctggacctcatggaaagtaagttgtttgtttatattgttttgttattgggactgtggtagagatttggggggttggattgggatatagcattcttaacataataagcaatcttttatgcatttgctgttaattttgcaatttatttatttacattgggaattactgagtaacagaagctactagaaaagcaaagacaggaggtagtgttacgagtgatatttgctcagctgagtattaggtagaagtttggagtttttattttttgtatttaataaacattattgtccattcaatgatgctctttcaggcaaaagctggcatgaagtaaactgtgtaggattaccagaactccagctcatctgccttgttggtactgagatagaaggggaggggttacagactgtggtgcctacccccatcactgcttccctcagccataacaggtgagcaggtgattttggtctaagttcctttcccgagtaaagcagtaggaaacattaaacatagtgatgtaatacttttaatgaaatttgggatacagggttcatagctttactcttggctatttgaggaataagttaaatatgagtgttgtattcggccattcttgcattgctataaagaaatacctgagactgagtaatttcttaaaaaaaaaagaagaggtttaagtggctcatagttctgaaggctttacagtaagcatggtgctggcatctactcggcttctagggaggcctcaggaagcttataatcatggaggaagttcgtgaagcaagagcaggcacatcatatggcaaaagcaggagtgagagagagtgttgagggggaggttccacacacttttaaatgaccagatctcacgagaactcattgtcctgaagacagcactcagccatgaaggatttacccctataacccaaacatctcccaccaggccccacctccaacattggggattacagttcaacatgggatttgggcaggaacaaatatacaaagtatatcaagcattcaacaagtatttatttagcacttactctatggtcagtactttttcagagacagtatgtatggtagaaatatttatattcttggtaaggaagcaagaccattacatatgaaataacagctgttataagatgtaccatgtaatacaaattatactttatatagcagttggtgaaaagcatgattaacatgcaagctgaaatcaaattttcatgtagctttttttaaaagctttaaaaaagagactttttttaggacctttttttaaaaagcttaggtacacagcattggattaaacatgtctttgtttcatgacatactctcattattagttcatgcttggtttttatttatttacttagttatttttaataatgtaataagtatctctgtacccatcacccaaagcaaaactagattcttgataataactaacatctaatcttataagtcccttccttaacgtgctttcactgacctgaggtaactcattctgaattccatgtacattgggaatttttaaattttagatgtttttaactttaattaaaaaatcttatcttttaaggctgaccttatacacttaatattatattactaaaattcatccattcttgtgcattttttgagctgccacataacattccattgtgtgattataccaccatttttacatccactccctcgatgatggagtgttgctaatgtttaactttaggagataatttcaaactattttcaaagtggttgcctcaatttacttttcacctgcagtgtaaataagatcctttggagctgtattgtctctcacatttagtattgtcagacttttaaatttttgccaatggaatggattattcttattttggtcttaatttacatttcccttattactcataatactgaatatttctttatatatgtattatttataagaaatatctgttcatatcttttgcctgttgggttgtttttagttttctcattgacttgtatgaattctttatatattcttgacctaatagtttttttattgtgttttccagtttttaagtctgtctttcactgtcttaagatgtctttcaatgagtaacagttcttaatttgaatataatcatatttatccatcttttataatcaacgtctttgtgtctagtttaagaaatattttctatctaacggtctaaaaaatacttatattttcactaagagttctattgttcttgtttttaatggtgtgagaggcggttagggataccattgtcatgtggataaccactttttctacctccatttactgaatagtccctcctttcctcactatctgacatatcacttctgctactttccaaagttccaaacatgcattaatttgtttctgggttctctattatattccattagccagtttatctgtccttttgccaataccatatctcttaatcgcttgcttggtaagaagtcttggtatctggttagcaagcctcccttatgcatttcttctttagaagctgtagcaggcagcttctaagatggcttctcctaattctggtattcactcccttatgtaactctcttcccttgagtgtgacctggactcagtgacttctttctaatgaataaaatttggcaaaaatgataggaatgtaacttctaagattaggttacaaaagactgtggcttctatcttgggcactctctcttgcttactataaaggaagccagctgccacgtgagctgtcctacagaaagtctgaaaatagaaaagagatgacaattattgatggagcaagattcttgagagatgaggaaggatggattcaagaggatagtggaggagagtaatattgagcatgtaaaggggtgctgtaaacctctgagagtggggtatgggaagaatgaacaaatgaaaacacagctctatttgggtggcatataagtagggaaaagagcagagcctcttaaattccagcatgaataccgttgatgaatacttaacattttttctagctgactatgactgaatacatagcagtctagtagaaagagccccagactataaagtcttaagacctgggttctagtcttgggactgacacttaacattttgtttgatgtttagcaacacacctaatttctctgggtttcagtttcctcgtcttattttgttgttgagggatttagattaccagtacatgcaagatcccttctaaattaaagctgctgtaactggttattttcattgtgcatatttcataaagccatattaaactaaatttgcagatttctatgaagtattttttgtatttattattcataatgagaattgttttttaatatgtcagtctattcatatgcttctttgagaagctccttactgttttctctgtgtttgagaattacaaatagttgttagcattgacatcagatttaatcgctagtactttccggtttttactagcatgatttccaagccatcctatatccaagagtcttaattcattcctcagaactcattacttctgtcttttaattactgtaacaaatattgtcctagctagtattaatgttatattatttgtttggacaaggagctactatttgaaattaacctgcatttattcctaaaaaataaaattaatgaaagcaatagcctattttaatcaaaatcatttcataagtctagaagtacaaatttgtttccattgttaatttctagtattttccaggtggtaattaatgcttttctagcttgaatggctaaagcttgttttcttcttcaagtagaattagttggaatgataacttggtaagccattttgatgctgttgcatttaataactgagagagcttaaatctttatgtcttgtttttatataaatattcttaactatattatacagtagaatactaatatagaatgtagcacaaatgaggcctgatacatactagatttatatgccttttagtgcataacattttctcaactcaaactatgcaaataactttttaacaaatggaaatgtgtgggtgtatatgtgtgtatgtgtgatttcattattcagtctttaacagggcagtcttttaggtagtaggcatacttttatctatttttacttttagtgtattttataatataaaatgttatatatctaacagtaatgctgcaattccagcctttcatagttaatgtgggaatttttctgtgttagtaacacagagaagaaaatgattgatgttgagtctctgataaccttgtatagcaaagaaattcattgggacatgtcctaaaagtatttggtgggaagatgtgagggcaactcaccatgaaagaaaaaatactttttatttaagagggaaaacagcttttacttattcagtgataaaacatctacataaattaacgattctgttttcacttttaaatattattatttgtcagataatattgcttgggctttttggtcttaacaattatttattgagtgactcttatgtgtcaggcaatgatctaggtgctggggataccatgataacaaatactttcatgacatcctcatgaaagtagtattctagcactgaatattcgcttagaaaatacttttttttttttttttggtaattgttggatggaattttaaaaaacagaattgccctttgttcagatatttaattgaatgtgtgatttgggactgccttcacttattttgtagctagataattgaataacaagtattatggagtactgataagtagtttaacagggatatgtacaaaattatgtcaaaacccagaggaaggacaggaaaagtctctttagccagtaagagaccatggtttagtagggtaactgcaagtaattaagcatgattgcctacctagcatggtgtctagtcagagtaggtgtctagtaatattccttaaggcagcaaatgaatgaatgaatgaatgaataaaatttcagagaaaagagggaaaggatggaaaattagatgggaaagtttatttagattatgaaggccatcattgtttttacttttttgctattactaatggtattctaatgaatagccttgtgagtacctccttgtactcatgtatgagagttttcctaagaatagctgggacatgtatacctttataccttctttttttttgagatggattctggctctgtcactcaggctggagtgcagtggcacaatctcggcacactgcagtctccgcctcccgggttcaagtgattctcctgcttcagcgttctaagtagctgggattacaggcatgcactaccatgcccaactaattttttgtgttttagtagagacaggtttttgccttattggctaggctggtctcgaactcctgacctcaagttatctgcccgccttggcctcccaaaattctggcattacaggtgtgagccactaggcctggcctatcccttcatctctactggttattgctaaattgttttcaaaaggattattaccagtttacacttgcacttgcaatgtgtaagttttcacagactgggagaagatttataacatgtgcataactgacaggttaatttagaattagcttctgtgatttcagaaaaaaaatcccaatgggaaacatgggcaaagaatatgaacaggcaactcacagaagaggaactcaaatgctcaaatatgtttgtaaatgaaggaattacaaatataaaatgtgtttgtgttgtcttaactttgaagaagacttgcagacagtttgtttttattttttgacagaaataaggtactgtttaatggggaacttttgaacagaactacagctagcacttagagagtctctgaacagtttaggaaaaggagctccctctcgacatgcaaaggaaaatgtctcttcactaaggttcaaggcttggcgaacaatgaaggccagattttagatccacttgtgccaggcaccgttgtgcaaagcacaatctgcatatctgtacatgatgccctgcccctgaagcatgtctgtggagtcttaggtttccacaaagaacactatgaaaattactgctaaatgggtggtgtcattgaagggctttaagcaaggaagtgagactattgtttattctatgtggttttaagaatactttgcatttgcagagaatgttacagaatttcaaagtatttcaaaatatttttacaagtagactttcattaaatcagcaccaaaatccctagtggtatacggggtgtttgttttatcctaactttacatacaaaaagctgaggttaaaagtatattttcatttgtacccccactttttccaaaagataataaaagattaagtgagctgtaccacggtctcagttagcctcacagctattagagtttctcttgctttattggtttttaaaaagattttattgtaaatgaaactagatacggaaaaccacacaataccaatgtataaattaatgagttataaggcaaacgtctagaactcttgtaattataactaagtcaagaaatagaacttttctaggcaccccacaaacttttcaatgtgccccatcccaatcataatctttcttcccccccaaaatagccattattctttcttttatagtaataatgggctttggcccatatattgttcccaggacctcttagtgctaatttgtcttttgactctcactcaagaaagaatgttggaatatcactggtgagactgataatattatcaggaatattagttttatatttaaaaataccctgccaactttactactctattgttagaaacaaattacttgccacatactatacaaccaacctcagcataccagttgtaaatcaccattttagactgtgcgtcttagctgcttgaatatagtgctttaaaaaatgctttgtagtcctcaaaaaaccttaaataacatttttattagtaggagagttgggtagcatacacagctgtagagccagaggagttggcagtttgctggagctacaatttcttattatttacaaagagcatatagcacataaggcctgataactgtctcttttattgaaggagacaaattttataatctgttgtttgtaaaactgaaccaaactctgtcatttacatagttaactacaacttagttataaagtatttccctagtgatgacaaatagtcccactgtttcagtcaccacttgactgttatgtggcagagtggcatgtatatttatatggtttattatttattttatggtgtatatgtattttctgcctccttaaaaagtaattgttctaaggagtgtttaatgttatatctgtgtgctattctaagaatgcctgaacagtttttagtgtctgcttcccacttactttcccaggctttagacctggtggttttgtttacatactttctggcaagagtgtcgacagattccattacagggtgaatgtgtatttgaatgactgtgagtgaatgcattactttgagcacaagtacgttttgtgtttagcattttctgtaaagcagttatatatgatatgtgatcacagttaaaacactttgtcatatttttcaagtttcagaaggtcttgtgtgtaatagtccttatgaaaatattgatttaatgttatttcctgatctgtaatgggggaataaaattgataaagtgcccatttctgattatctagtgggaaaattttgctgatggagtatgaagtaattaattgctagtgtttcttgtttctctcatctaaaaatacttcctaaagctaatgtaaaataatttttagtttgcattataatgccatattaagttgtatatttgcatggtatccatatggacagtactctagattgtttctttgctaaattgaatctaaggaatacatgaagcaactttggtaaatgactgtagaggtacagtttgctcagacaaagcaatggtataaaatcatattcatagatacacagagatgaaagagatctgatggatttaaagatgagacaacaagaggaatactaactaaaactagtgacctatctttttcagtgctaagattgcaaatgaagtcaaatttatgttcagatagcctgattagcttcactttggaccaccttgggtccattggtatttattgagtaccctaaatggtaaaagtatactatactgaaattaggataatagtattacaattttctgtaatagtagtagtactacaggtagttgcaaatgggaaaatatcttaagtgacttatacagggactcaaattataagggaacaaaatggttttctagtctttaactactggtagggttttttttgtttgtttttttttccccctcatagacccaatgtcacctcccaattctaatgtaaattttgtttcttcagtaagatacaagaggtgggaaaaccttagttgacatattttaaactcatctgtggttatatgtaaattaaaaaaaagctgagcgaagtgaaatgtcttatacaattataaaatccaggcacagttaagatacagctttctgaaactattaatctccttttctttccccaaaggattgtagttccttccttagtaatacgtgaatcattcatcctttcaaacctgactaaattgtaaatggttctttcttctcagtgtcagagaagaatagtggatgggagaatggagcctctcccatcaccattttgttcccctaggacctcaaatagtggcatttcttttgttgttattgtttcgtggcagttggtaacctttctaaattgaatacactcagccatcttatctgagacaaaaatatttcaaaagttcttcttggcatctgcatattacttgggaagtttagaaaaaagatgtaaacattccatataccaaattgctcctttgcaagcttagctaccatgaagctaaaagtctaagagcttttaaaagttggtttgaataaaattattttggcaagagtattgtacaattaaaggaatttatgccttaagagaagtgaaaataattctgtgcacattagaaatgaatgtcagagccaaagttaggattcctagcctgtggtgatttgcttaatctgatgcttagcttattaatgcatatcatatcctatttccctcaatgttgttttcaaaagaatgtactctcttttcctcatacattgaatccgatgaattttagttattttttctttgtcagaattaatttttcccaatatagcttttaaagactgccaatagtaatttttcttttttaaaggacatgattaaagaacattttattagctgtttgtattatcacagcagtaacccagataatataaatggacgaattatttatttttaaatccattgcctttgtgttttcatggggagaagaaaaaacctaatattttaaaaccccgagatgtgtagggaaaattaaaaatttatttattgttcttacccatcactaaaaatgttataaatgtatttgattttactttttatttaaatataattaatacaaacataattatatactacctagaggcaaaatttggttttaggatagaataaaaaggtaaattacaaattattccagtattttctaagttgcttatttatttattggctgcctgggctcatcgggtgcaaaatattatggactttgcctacaagatgctaacagtctggagctgagatggacagtcatttacatctagtgtgataaacgtaatgacagatatgtacagggtactgaggaagaccacagagggaggagacctaactttgactggtgggataaagagacaagagagtctgggaaaacttactggaggacaagatgtttgaaatatgcaagaacaaggaacaaggatgggaatggatgccctggttaaagtaataacatgagcaaggtattgagggctgagagggcctgaaatttgccaatagttcattatgactgggtatgtagtaatggcagagagagtacctgcctgcagttggtgagaaagccctagattggtgtggcatgggtggagaaggagtgagtatgtgtgatacaagagatatgggaatgatgggaaaaggaggggaggaaaggagagacagacatagaaaaaatatgaaaaaacaaacaaacaaacaaacagctctcctcctgggaagtaacagttcaggagaagcaacctcttaaggattaaggaagtcaaaggtaagagaaagttaaatcaagagttttgccactacaaaatctgtaggaaatcctgaaacaaaggtgggaaaattatttgagtcagaatattaggaattgtaatgcttgtttctgttttctgtaatggataccaattacaatgtgcaaatctgtaaggatatagatgtttagctattaatgcaagaacctaatttggggatttgaggaggttaagtaactagggtttagtcatctgagcttttctcttcattatactcactccctaagcggccttatctggttctaaggttttaaatatcatcgatatactgatgactcccaaatttttatctccatcccaacctcttccatgaacctcagactcatatatgtaagtgcctacttgacatctccgctgtgatctaaaaaaggcatctcaaattagcatgtccaaaaagaaatcttgatttgctcctatactttctccttctgtcgttttctttttgtcaataaatggcaactctattcattctgaagctcagaccaaaaaccttagagtcattttaaaatgtatacacacacacacacacacacactttattttttagaccaattttagatttacagaaaaaattgagcagatagtacagagatttcccatctaagtcccagtccagcatagtgtttcccctattattaacatctttgtgttagtatggtacatttgttacaattaaccaatattcatacattattagtattattaactgaaatttgtcatttacactagggtttattctttttgcacaattctgtggattttgacaaatgcataatgtcatgtattcatcatcacatacagaatagtttcagtgccataaacataccctatgcttcatttattcatccctttcttcacccccaaacacatccctggctgctactgaactttttactttctgtgttgttttgccttttccagaatggcatatagctggaattatacagtatgtagcctttcagattggctttcactcagcaatatgtatccctgctagcatggcattttgggttttagctaccctagtgggcacacaatggcatctcattgttcttttaacttcttgcaatttcctgatgacatatgatgttgagcatcttttcatatgcttatttgccacctgtatatctcctttggtgaggtgtctgttcagattttttgcccatttttaaattgggttttctttttgataagtttcaagacttctgtgtatattttgaatgcaagtcctttatcagatatgtgttttacaaatattttctcccagtccatggcttatattttcattatcttaacattgtattttgcagaacagaagttttaaattttaatagaatctgatataatttttttcctggatcatgcttttggtattttatctaaaaactcatcaccaaatccaaggcatcctattttgtcttctagaagttttatagttttgcattttacattaaggtctgtgatccatttttagttaatttttatgaaggatataaggtcagtgtttagattgattttttccaggtgaatatccagttactctaacaccatttgttgaaaagatgtttatttcttcatcaaattgcctttttttttttggtcaaagatcaattgactatttatgtgagtcaattctgagctctctattctattccattgacctattcatctattccttaaccaataccacatgatcttgattactatagctttacaataggtcttttttttttctttatgtgatttttttgagacagggtctcactctgttgcccaagttggagtggagtggcacgatctcggctcactgcaacccggtccgcctcctgggttcaagcaattctcatgcctcagcctcttgagtagctgggactacaggcgcataccaccacacctggctaatttttgcatttttaatagagacagggtttcaccatgttggctaggctggtctcaaactcctaacctcaagtgatccgcctgccttagcctcttaaagtgctggggttacaggtgtgagccactgtgcccggcttgtaataggccttaaagtcagataaaatcagtcctctcactttgttctttaacactttgttggatattctgactcttttgcctttccatatcaattttacaatcagcttgtcaatatctacaaaacaacgtgctgggattttgaatgggattgcacttgtagatcacattgagaagaattggtatccaggaacatggactatctctccatttgtttagatctcctatgatttctttcatcagagttttacagttttcctcacatagatcctataaatattttgttagatttatacctaaatatttatcttttatgatgctgatgtaaatggtgttttgtttttaatttcaaattccaattgtttattgctgatatataggaatacagtggacttttgtatattatccttgtatcctgtaaccttgctataatctcttagtttttattcttccattttctcatacccccaaattaatttatcagtaaaccctgtcaattccttaaaattacatccagaatctgtccatttcttaccacttacactacaactgttaccactctggcttaagctgctattatctcacctcctggacctactaagtggtcctcctttaaaacacttgatatattaatgctactcaacatatttcatatttggttttctttgattatctactgtctgttttcctccactagaaagtaagttccctgaaagtgagaacttggttttgtttattggtatatccctggggtctaacctggtacctggtacatggtgctaagtaagtatttgttgaaagattgggtaagctatcttaggctactgtgttcctgcagcagagacttcctaattaataccttaaagaacataagaatatactataagcaaccttttaagaatttccaaaaaattagaatgtctgcaaaatctgccaggcacagtggctcacgcctgtaatcccagcactttgggaggctgaggtgggcggatcacctgaggtcaggagtttgataccagcctggccaacatggcaaaaccccgtctctactaaaaatacaaaaaattagctggatgtggtggtgtgtgcctgtagtcccagctacttgggaggcctagtgaggcaagagaattgcttgaacccaggaggtggaggttgcagtgagccaaggtcacaccactgtgctccagtctgggtgacagagcgagactctctctctcaaaaaaaaaaaaaaaaaatatatatatatatatatatatatatatatgtacatatgtatgtatctgcaaaatccatccacttgcaggatttatcaccattttccacgctttgcattgtaacctgccaatgttatgaatagcctctttactttttagttgaattttttttcatttatattctctctgccctttcacccctctttttccctagtgccttgggaaaaggacttatattaattctggagtagagggttactagaactagttctttctttggaacatctctgaagatattcttagttatgagatttgatcctcaaatgctacatactttcttgaaggaccgtccattattatttccctgtaattgaaaaatatttccactttctgaaagcataatccttattacaaattcatttaatgaccactattttatttgagtcctaaagtctcataattgcaaaatgacttctgtcatttggcttctctgcatattaggatgtgtgtcctcaccttccctctgctagaaatctgctgctggtgaaacccccaattctggcagcttcttttaactgatacagcatttttttttctcttacccttaaacaaaagcttgcagttcattacagaatgacttcccactggggtggatagcttcattgttcagtaaacccccttggaattttagctgccttgattttttactaggaaggcattggcatgaatttcaaggaggtggtctgttatccctgaaacttttctttgggactgagcctgtggatgaataaggcttctttggtgcctctgacaccaacttaattttgcattatgtttcagagttgcattatggcatgtcattccattatatcataatgaggcaaatcaaggaattattcccttttactaataaggctatagcatatattatttggccacattgaagaggataggagatactttctatgggttgaaattaatactacttttaacccatgatacattctatttcaatagcatttgaagttaaaagtaatgcggtcttcaacttcttgtcctctgtgtaaatctccagagattacttagtatctgtttcagaatcattacagaaaaatcaatgctaagatttatggaaagcatttaaatagcttggactaaaggtattagccaaatagtgttaactgtgtatttgcttcaggcttgttttcaagttagctatatgaagctctggaatcactttttttcagtacacagagctcctctatgaacagttatgagaaataaaaacctgttgtgagcatcaaattttgttgctgttattaaatagctattattattgatacatatttttctttaggtgggatttttccctttagatataactgagtttaaaacttgaaactgttagtattaatacataggttatatttttcataggttgatttctatccaatatgaactataaagaattttatcgtttattgttgtagatttgtgtgatgaaacatacaatatttccagtatcttcacaatatttttccaaagaactgagctattaaaatttatacatataaggaaacattctgtcatttctaaagtgagatttcaaaccataagcttgttagaaattaagtgagattatagtattctggtgatacttaaatgttcttgggatctttacaatcatatgtggttttttaagaacttaagaatcttttgttactgctattattaatagattgggaaaatataatctgttgactaaaaggcaaaataaacatttttaagattttatgcagtatcctataatggaaacaaacaagaaaggtcttgttcttgtttgttgaggaaaagatgatggctttgctttaaacatacttgaaaaatcgactagaagagatcctgaacaagaaactgtaagacttctggaatgtaccttgagtaacagaggcagataaactattttattctgttactagtgagaagattcactggtaattcacaatcaccgccccctccaaccaaataccataaacaaggcctcagaaatgggaacttccatttcatttttgacagtgatttctctcaactctgaaaacaaaaccccttttacaactctgagttagttttcaaatgttagggtttcctgcatgggtatttggggtaagtatgaaaatgttttgctgcttaaatcaaagaactctggaaacagatataaattgagaatggaaaaagagtagtgaataagatggaaatttctattctaaatttcactatatgggctacaattcccatatagttttccttagtgaacaccaccccccaacacacacatacaaacacaccttctgatttaaataacattatatcttcagaaatggaaaatgtgttaaagttgtgttaacaggcttccttcttgtctgtgtcccattctcatcacagtctaccagttagggatgtttagagaaatttatcttgtggcattgaagtggctttatgtgcattatatattgggttttatgtatattgcatactgtgaagtaatcatgatacatgctgacaacaaaagatgtagataagttaaaattttagttgatccattgtctgtttcttctttgccatctttgtagaaaaaaattaattcaagatggacagcctataaaaatgtatctttttctattattattaatttagatattggcgtgccacttttgaagaaggaaaatacttagctacattaaaagatttgcattgaagaagcaattgtgatatgctgccttttatcacagtgtgacttcccatcagtgctgagtaatgaagtttctgattaatatctatcgttgctttatcagaatatctttctctaaagtaaatcattcttgtgaataagaatctagctagttgtaatgcagttcagcataggtggaaataattttttaaggactaagtcaatttctgggattcagactgtttcagaaaagaaacattttctgtatttccactaatggcacagtgtaccttagtatgtttgggttagtattcagttttagcaataatcatggaggcaggggtatctataaatattatatcccaatttgcaaggtagcaaagttgtatatatactacataatatgaccacttgacagtttatgaagtcttttcatatatgccatttaattgattcatataataatcttatgtgtaaacataaaggtgtactactatcttcatttcaagtatccttgaaaagactttctccattgaattgcctttgtacctttgtcaaaaatcaactgaccagccttatagcacgttaagaagtaacttatatgatgttattaacacaaaggatgggggaaggaatgaagctatattggagtaaacaatgacaccagacagttatgtgaagaaatgaagaataccaggaatattaaatatgtgaatgtaaaagaccctaatatattttcctttctcctcttaactttataaaaagaaaattatttaaagtaataattacaacactatattactgggtttaaatatataaacatatatgacaataatagcataaaggtggaggaaaggaataaagctctattggagcaatttctatattttttagaatcaagttagtattaagctgagagaaattgtgataaactaagacgcaatagtaatctctagagtcatcactacgaaactcaagaaactatagtaaaaaaaaatacattaattaaaatggtgtactagaaaatacctatttaatagaaaagaaggtgataaaggagggtgagaggaagtaaaaagacatgtgatatatagaaaacaaatagctaaatggcaggcatgaatccaaccataccaatgttaattttaaatttgaataaacactcaaaagggcagagattgtcagattggatataaaaacaagatccaactatatgctatctacaaaagatacacttcagattcagagacaacaattttggaaaactgtcaactatttctataccattctctttcctttccttctgtgattccaattatgtgtaatgttgaacttatttgatactataccagaagactctgatgttattttttaaaattattttttctctttttacttcagtttggtttcttgtgacctgttttcaagttttctagtgctttcttctgtcacatctcatctaattgagtgaccgcaactcctaagtatattgtgactttattttcaggataagggagatcttgaaggcatctcgaaagttgcaaggtgatccagatttgccgatgtcttttactttggccatagtggagtctgattctacaatagtctattataaacttactgatggatttatgctgccagaccctcaggtcagttttgaggtaactgacagcaagaagtacaaaaagaggaaaattatgacgtgattttaagtgtgactcaagtcagtcacagaactgccacttcctttgccatagggaaaattcaagaaaaaaagtcttgattttcagacgtcagaaaattggttatattttgttcaaagtagcatgttcctagttatttttgcaaaaaaaaaattgatttccttactctttggagaatttcatggttttccaaagtattttatgaagtcatcatgcatttaattatttagtgagtagctgaggtggaatgtaaaggctaataatagttgtaagtaaaaaaacgcttatttaagaaatgttaaattggttgacattttgacaggaacattttaataagataaatgtgctatatgtgatttctttacatactttgttggtataatttggataattacattaaatatctttctaattttgcttttggattacattgtttatcggagaaaagtccatcctgatcttttttttttccagaatatttctcttagaagatgacatccatgtttcctgatgcttgttttattcatacaagattggatttgagacccatcagactgcttcatcttttatctcagaaatagggttgacgtacatagtgagggttgacttccccattccataaggttttcattctgaagagtaaaacttccccaggtagaagactttctccttcttaaaaaatatagggtgatttctttaaaactttgttatctagagacagtttaattacagttatatacaggtttatgcctaggatgtattcagatgggtgggacctgtgtgctgcttttgtcatcccacactcaaagttgtctctttgtttcttgctgccactgccagctcattgttgagactgccatttctttctcttactcagctctccccagtgccttttggccactgcagctaccgtagaatggcattttatatgtaccttgtcacccacttctgtttactttttcctctccagtaaaaagtaaaagatttctttcaattggtcttcccattgcagttactgttatttctcttttttggttaactttaaatcaaaactcaaaatatgttcatccagagtgtgtcttaagtaacttacgtgtcttaagtaacagggaccagagacatgttacctacaagagttctgggctatccttttcattcttatcacatatcatagcttgaatattacaacagtgtgggagagaatcaaccgtaaaaatgtcttcattaattagacccagttattccacttttgttaatgtctctcaaattgtacaaagtataaaaaattatatgcacaaagatgttccaagtgacattacttttagtagcccaaattataaaccactttaaagtttggggtaaagattggcaaactttttctataaagggccagaaagtaactattttaggtttttaaacctactgtctctgtcataacttgtcaacactgctgtatgaagcacaaaagcagccatagacaatacataaacaatacgggcgtggctttgttccagtaaaactttgtttacaaatgtggtgccatagtttgtcatccctgggtctaggaaatagtcaataaacagatatatacaaatgatacataatgtacttattaaaaattagtaatgaatattattaaaaacatgaaaatattaccttaagtaaaaattgcaagacggaaaagtgtataagtgggtgtaatcatggctgaaataacagaccaagcatatgataaaaagataacaaagtaaatcaaattactaactggttatagtgggataggaggcagaaaatggatgactttgtcttttctcaatgtttttatttgtattttataataaaaatgttttaaaattaaaaggtgtcttgaaatctgtattagttatctatcattgcaaaataatattaccacaaatgtagcaacttaaaacagcacacatttattatcttatagtttttgtgggcaagggacccgggcacagattagttgggtcctccatgaggctacagtcaaggtgttgggcagggctccagtctcatctgagacttgactggggaagggtcagctttttcacccacatggttattagtagccttcaatttcttgagagtgctcaatgcttatatgccattggcaggaggccaccctcagctctttgccacgtgggccttctcaatataactggttgcttcctcaaagccagcaaaggagagtctcagcaagatggaccttataatccttatataatgtaatcacatacatcccatcacctttgccgtattctgttgattggaagcaggtcataggtcctgcctacacactagggtttcatggctgattaggaaacaacaataacaagaatggaaaaatgatgaaaattaggaacatcacaaaatagtataaagcatcattcttcatctgtagtcattcctgactccttcctttgatggtatttgaatttcacttttattcttggtgggaggtctccataactccttcaggctccctctgcttccccagaggacatgaagatggacctattcagaacaatatgtgtttgggtgactctagtggaaaatttgcaggtctaagaatcctcaaacagtttatgataaattcttagggtctcttgatttcttaagtctctcgtttgattcattttgaggtctttcattataattctagaaaaatagcattttcagaaagaagtgtaaggataatgtcagatttgtgtgtcggatctgttgaccagtgggctcctatataactacaaaaccagaagtgtcttttggggttggctgtgaaaggcgctttcccaactctttaaactaggattgaatcctgctgtatgtcttgggatgtttactctatttcagaatgttccctgtgtacttcaccaaagttgttctgtccaaagccagccagacacatcctaacatgaataatggcccagaactttttggaaagggaggccacccagctgtgtatgtctcattttaatgaaaaactagataaagtgatttaagtaattttgtaagtgagtttacatttgtctccctgttagactgggctccttaagaacagaacaagaaatgtattttttaatacatctctgtatcttgcctctttgcacagtaactcacatatagtaaaccctcagtaaatacttggcaaatgaatgaatgctgattatagccgtgtctgattatataatggcttattttttccctcaaggcaaactaaaacaattcatttggacaccagagggcactgctagataaccacagcattttcagactctactaagagtagattagctggagaagtggtactcttgaaaatttattttcaatctgtaggaaatagcataaataaaaatataaataagttttacgtactcacatcccctttttctttctggcatgcctctaaaattatactgacattaaatatgtgacttgattcatgctttgcttaaaatgtagatctatatttagaaataaaagcctgtttagggtaggggtagatggggtgggttttatatatatatatatatatttttttttttcttagccatatgaaagtatgcattttagtttttcattctaaaagcctaatttatcctgaaatgaatttcaggatcacatcacatagcaataaaccccagctctggaacactcactattctggctaagtgctggtggtaaaagatatacattgctgctttaatataagcaggtattccttgttgtattgcaattctctttattctgttttggggatattgtgttttttacaaattgaaggtttgtggcaaccctgcctcaagcaagattgtcgatgccatttttccaacatgatcatttcatgtctttctgtcatattttggtaattcttgcgatattttaaactttttttattattatatctgatatggtgatctgtttttcagggatatttgatgttactattgtaattgttttggtgtgccacaaattgtgcccatataagacagcaaactcagttgataaatgttatgtgtgttctgactgccctaccaaccaggatttctgccatttctctcccttacttctggcctccctattccctgagaaacagcaatattgaaattaggccaattaataaccctacaatggcctctatgtgttcaagtaaaaggtagtgtagtacatctgtcactttaaatcaaaagctagaaacgattacacttagtgagaaaaacatgtcaaaagatgagatgggccaaaaactaggcctcttgtgccaaacagtcaagttgtgaatgcaaatgaaaagttatggaaagaaatgaaaagtgctactccagtgaacacatgaataagaaagtgaaacagccttattgttgatatggagaaagtttgagtggtctgcagagaagatcaaaccagctacaacattcccttaagccaaaacctaatccagagcaaggccctaactctcttttcaattctatgaaggctgagagaggtgacaaaactgcagaagaaaagtttgaagctagcagagcttggttcatgaggtttaaggaaagaagctgtcttcataacttaaaagtgcaaagtgatgcagcaaatcctgatgtagaagctgcagtaaattatcaaaaaatctagctaagatagttgatgaaggtggctatattaaataacaggctttaaatgtagacagacggccttatattggaagaaaatgccatctaggactttcatggctagaaagaagccaatgtctggcttcaaagcttcaaaggatgggctaattctcttgtctggggctaatgcagctgatgactaaattaaagccaatgttcatttaccattctgaaaatcctggagtccttaagaattacgcccaatctactctacttatactctataagtggaacaatgatgcctggatgaaagcacatctgtttacagcatggtttactgaatattttaagcctacgattgagacctactgctcagaaaaaaagatttctttcaaaatattactgttcattgacaatgcacctggtcacccaagagccctcatggacatatacaaggagattaatgttgctttcatgcttgtgaacacattatccattcagtaaggtcaaggagtgattttgactttgaagtcttattgcttaagaaatacattttgtaaggctgtagctgccatagatagttactcctgttatggatctgggcaaagtagactgacaaccttccagaaaaggacttgccattctagatgccattaagaatatttgtgattcatgggaagaggtaaaaatgtttgaaggatgttgattccaacccttgtggatgactttgagcattcaagactttagtggaggaagttaactgcagatgtggtagaaatagcaagagaattagaattggaagtgaagcttgaagatgtaaatggattgttataatttcatgagacaacctgaacatatgaggagttgtttcttatggatgagcaaagagtggtttcttgagatggaatctacttcttgtgcagatgctatgaacactgttgaaatgacaaaatatttagaaaattacataaacttaataaagcagcagcagagtttgagaagattgattccaattttgaatattttactgtgggtaaaatgctatcaagtagcatcagagtctacagagaaatcttttgtgaaaggaggagtcaatgattttggcaaatttcattgtatgttattttaagactttgccacagccaccgcaaccttcagcaaccaccactctgatcagttagcacccattaacatcaaggcaagactctccaccagcaaaaagattattacttgctgaagcctcagatgatcattagcctctttcacaataaagtattttaaaattaaggtgtgtgcattgttttttagacatgatgccatatactacatgttcgtgtaaatgcaagttttataggcactaggaaaccaaaaaaattgtatgacttgttttattgcaatatttactttattgcagtggtctggaactgacccttcaatatctccaaggtatgccggtataaacttttctgtaaaagaggtgccctctttagctggggcatgaaagagggaaatggcatgtgaggatttctctctggtgccgcctttgcctttcttttctggagtctctaatcagtgtgccctctgtgctggggaagctcagtggaatactaagctaggtcctatggctccagactaagtatttgcttctcctggctgagactctttagaagaatatgttactaaacaccatagatctcttgtaaagaacatgaaggaagaggtactttggaattcaaatttacaattagaatagaagagtaatctgcaaagttcacgtagtcagcatttttatttttattttttattttttactaaaacagcttttcccttttataagcctggaaccaaatgacttaaccaaaacttcatggtgtttcatctctttctgagtatttctgttctgaattcctctctgaggtcactttttccattgcagcccctagcagaaggcctcttcactgctgcagcacagtggttcctgccaaagtttgtagttcttctatacagaagctctttattcatctgccatattttaccttgagtgtttacatgtgcagaataatgtgctatcctctgagcaattaatagtacaatttcccttctttctggccaataaccgttccttaccaccccctaatcctcttaatgatctttggataagaactgcttgtactcactaaggaaagtggatggaaaaatcaaatgtctagtaggtgggtgtgctattataatgtttaaatgattttgaaaattttcccaaagccaatttaagcaaaatcagagattggccttttaggtttctgggtactaaggggaagtaataagaagtattttattaaaggttatttatcagtttatcttcagacattaactggtatcttagctaggacaaccattacaaaataccacagcctgggtgccataaacaacagaaatttatctccttacagttctggatgctgggagttccaaattaaggtgctagcagacttttaagggctcttttcctggctttcagatggcagccttctggctgtgtcctcacatggcctttcctctgtggggcatggcgagattgagaaaaaaggagagagagagagggtcagagcacgtgcaagtgcatgctgtctggcggcatcttttcatcttcttataagaacaccagcgccatcagattagggccccatccttatgacatcattaactttaattacctccctaaaggccttatccccaattccagtcacattgtgggataggatttcaatatatgaatttgaagggtacataatgcagtccatataaactgggctccttctctgtgctcagatactgtggtaagtctagggatacaaagattggtgagacatgacctctaccctcaaggaattcagacaggcaattacaactctctttagccaaaattctaaacacctgttgttagtgtgaattgagaaatacttgtcttgcagtgtataaagtttgtgtagtttacttaagggtgaaggggtttaacaacttatgataaatagttttcaaacgatcatcatatgtgtattatttgtcccaaagtactcagcattggatcatatgcaaagaaaaagtgcacagtgaacctctaaggagcttattgtctcccttgaaaggagaaaatctaggtacaaaataattcaagagcattacaaggacaacattatatataaatgcaaagttataatcatgttgtactttattcactactaagtgcttcagaaccctatatcttgatgctcacaacagagctgatgttacttacatgttattaactttttatcctcataagatagagaaattagggcacaagtggttaagtaatagctccaggtagtagcaagcaagtggagtgggtaatgcagattagatccaggtctcctgatacctagcactgtattgttttcagaatattatgttgcctttttcttgtatgatgcagagaaatatattagtgtgtgccaaagtctttgggaggaaaaaattattcagtcctggagggagttaggaagtgatttttggatcaattacattatcctctgatacttgaacaaatgtatcaaaatgtcaagctgtttgtgggtaattctgaaaaacatattcataagcaatatatttacagagttttattccagaggataaacacattcatgctcatgcttttatgttggcaaacctaaaacaatatttaatagtaaataaagaagaactcagaaagtttctctgcttgttgacactaaattttgtgctggtacaaacagaaaatccagaaacttataaatgatcattgcacctcaatgaagaagaccattgcacctcaatgatcttgcaccccaagtattcctcagatctgcctgccagtgcttggaatcctaacataattctgtttcttaatcatgaatcaataatccaatttaatttgacaaacattttgttagcaccttcatgggtaagacatcgtgctaagatctggtggaaagacaattccaaatatgttattattagattcaataggtcaaattaatcagcttaactgttacaagaatttctaaatgtttattctcaatttctatacttacatcattgcagagcagcaatagtttgtggattgatacctgtgtatgaactacactttgagtggcatgtgttaaaagctttgatgaggaatgagagcctgaaccccaataatagcctgggcatattagtcagggtgggctggattattatgcagcaacagccagcgagttcatttaacaagtgtttattgcttgctcactttacatgcccattgactgaaacgacccattgcatgccctttactctggaaatcagagtgacagggcctccaccatctgaaatgctgtcagttccagctgcaggaggcagttccagctgcagtgttgcttactgcaattaggaagcagcccatgttactcctgtccacgtttcactagccaaaggaagccacgtgcctggccatgatctacctcaagaaagaggggaagtgcaaatctgtcatgttcctggattgaggaaaaggaatattcagaaagcagcacttccaggtaatagaaaggagaggagagagccggcaggtagatttaacaactggatagctgcgtgaacagagaaggagctggagttaaacctcaaactattgagtcccgtcactttaatgggagtgagtttcgggttgttttgggaagacagtgagaggacattgcaagaaggaaagggcactaagtaccaccaggttgggaaacaggccacctagaggactttttcccacttcatggctcgggttctggagatcagaaagaagatcttgtatggatcagaaacctagggtcattggggactttattcttcccgttcttctgatgcaccagattgttacacagactatgttgtcctggccttttctttacttcctaagaatggaaaaaagaaagcagttgtgcctatagcatagaagatttagtggaactctgcgagaatatttctgaaggaagctggttaaacatggatgcgtgggtgaggctgggtttatgaagagcctggtggcaactcttctgggatggatagttgtttatgtgggatagtgaacatggagtgtttgtatagatctaggacactttcagggtgcattagcatctgacagagagagagctgggggacagacatcagtccttagggtttctcatcagtcacacaggtagtggctgaattgggcatcatcctgcagtgcctgaggtccatctgggtctctcatgactttttctcttgagcacttggaaaatatttggtctggtcctgaactccagggacatgttggggaactttcaggctgttttgggtcctctccatctagatacactttcccagccatatgtgcttctctgctgtcttcatagcatgttgaagaaagatcctaagagtctgagatatgtggagtatgtggagctttacctgggcctggaggcagcagtagggggtatagggtaggagtgggtgctggccatattccctttcatttcctttatttcctttggagcgtctattgtctctcctctgcaccagcaacttttggggtcagagcggagggcacggaccacaggtgtctgctccatgaccagttcaaggttctaactcttccacttttgctactttttatccccaacaggttttttcccctaggtttattttgtcttaggggtaggaaaaactgatgccgaccatttccagatcaattttccttctaaacatattgtttttgccaagattttagattttggaattcaaaagccaagaatttgctctttttgttctgtagcataatcctgttcctgaggcagtgtgccaagaaagcctgtatgggaaaaagttcacagggaacaagaattactgaaaagggaaaatatatcagttaatatatcaaaaattatccagttacattcacaaacagaaggtgttaattgtcattaaaattcatattgatactcacaagacctatttaattttctgagggtacattttatcttatctatcagcttacatcccacctaatgataatgcagtatttgatacagagtagaagctcaatagaagtcttatttgattgcattcaaatattcataaatggactactacccaccccatccaattcctgccattccagtggcagggcaaggaccagctgcttttctgccctgtccactttgtacagaaagcagagcttcatgtacctcaggctgtgagacaaatcaccatcccatgcgattttcttttgtaagcatgcttatgctacaagatcccttatattttgatcccttgccttagagttctgagaaatcaaaataaggatttataaacaaaatatatctgcctgataagtttacttattatttgattacacatcctttcctatgccaaacctatgcatttatttattcaacattttttggggaaatgaaggcatgtaaacactgctaaatttggaaactctacttagaaatggtaattcctctcacataattatacaattattgtggattgtacttctgttgatgaccacagatggggatgctgtggttttgaatattgggtgaaaaattggtcatctcttctcccatcccaagtgagatcattagaaaacttggttcctataaatataaccaagaatgttgcttttttctggattgtacattctctattgtttagatataaatgaatagaattcatccactttggaccataatgttccactcccacaaaatgaaaggagttggtgcagatactatctgtgatcccctctagctctttattttggtgatcctataattgaaagattttgccacatagatctttccttctcaccctcacgctcatcaccctcttccacctctacccctgttaaaaacaacaacaacatattcctcccatcatgggccttattaatccaccattagaattgtgctcctttgaatttttgaggcccaagagacttgcaaggcagagttttgacttcagaaaaccaacagtgacatgggacagttgtgtaatctccctgagtctcagtttctcatctgtaaaatgaaggacaaagtgtgtccttccagggttgtgttttcctcacacattgaaatggttatgtgaggataaatgaagcccagcatacaataatctatcaatgatccttccctttgcagcctccaaactcttcccattgatgtgcaggttgccaccttgggagagaatacatgataactagctgagagccagtcctccaaggagtaggacctagatgtttagcagggtatgaagaaggtagtcttagtccattttgttgtttgatattctgttattctaactatcacaccccatcccacctatgatggttttaagatattatccataaatccttttgattattatccataaatccttttgattattatccataaatccttttgatttatggataatatcttaaaaccatcacaggtgggatggggtgtgatagttaaagagcattttaattttctgttattctgtaacagaatatcagagactgggtaatttataatgaacagaaatttattagctcacatttcttgacactgggaagcttaagatcaagggtccagcatctggcaagggcctgcttgctttatcttatggcagaaggcagaagggaaagagagatcaagaggagtcaaattagccctttataatggcaccaatcctgcccatgagggtggagccctcatggtctaatcacctcttaaatatcccacctgttaatactactacaatggcaattaaatttcaacatgggtctggaggggacaaacattcaaaccacggcaaaggtaaaggaaaagatggggggacaattttaccctttgaaaaatttctcaggcctgatcttgctgctgctgttgctgctgctaatggtgatggtgatgataacactttttttttttggtctcactttgggggatcctttaggtttagataaattgcataggaataagataaacaccagctatgcagtgggagacttatatcaaataagggaaatttccactgcagggaagctgtactggggcaattcattaggactgaaaagaagttaaacttagcacagcacaaaagcacattgaaaagttctctctaaaagagaagggggaatgttcagggtgcatttaagtcatgggatatggcaaggagccttctgttgatggtggggattaggtctcttgaaggaatgaataaattaaaaaacatgaaataataactagcaatttgtagttgtataagcatgcctatattacagtgggggatataaggaccttattttgttcccttctatattcccagaagttagaacagtgtctgatacatagtgggtgttccacaaatatttgtggaagaaaataaacaaatgaatacacataaaataatgtcaagtgatgacaaatgctatgaagaacataaagcagggtatggggatagagtgtgacaggaatgcaattttagttagggtgaccaagaatggcttttctctgcaggtgacatttgagcagagaccagaatgcagtgagggtgggagtcatgcaaataactagaggaccagccttgcgggcaaagggaacagcaagtgcaaatgtcctgagtttagaccatgatgggatctgaaattttgcatttctaacaagttgtctgatgatgtcagtgcagctggtccatggaccacattttgagtagtaagggtatagactagagtttgacccaggagtcagtactagtcaagttcagtactagtcaagtcagtactagtcaaggaactgagtagttctgtctgagaactgagtagtactgactagtcaagtcaggactagtcaaggaactgagaggtgaggtcattgcatgagaaaagaggaatgcaaaactgtatatgaaatatattcttatctatacaaaatgtatgcaaagagggacatgaacaatatcaacagtgttttcctcagtggggttgcacttcagattatttaaattctcttctttttagattattccaaagcttctgccatgtgtatttatcacttttatattcagaaaaaaacatttttggaaagttcaaaacagaaaatatgtgtttagttaagacacaaagttcaaaatgtattaaaatatttctaaattttaaaaaaatgttatggacacatgggaattggttggggtttctgatgaaaggcttcataaaggagatgactttgaatcaaatcttgacatctaagtaggcaaaactaagttagagttcttagcagcttctcttctctcttcctgttcttgggtggaagttggggtggggaagatatagggtatggatggtatattagtaatctattgctgtgtgacaaattatcccaaagctcagctacttaaaacaatagtttttgtggttcagaaatttgggagcagctttttggctcagggtctctcatgaggtttccatgaagatattagctagggcttccattatctgaaggcttgactggggctggaggatccacttccaagatagctcactcacatggctgttggcaggagaaggccttgctttcttgccatgtggatctctctacaggacaccttgggtctcctcatgatactacagctggcttcactcagagcgaatgaccagagtgagagagagggagagcaagagagagtgagagagagctagagagagcacgagagagagaagatccaacacctttgatgacctaatcctggagcacacacactgatgcttctgctttattctgttcattagaagcaagttgccaagtctagtccatactagggggaggtgtattcaagtttaccttttgaaaggggggagtatcaaaaggatttatggataatatcttaaaaccatcacaggtgggatggggtgtgatagttaaggccattttaattttcacttaaaagggactgtataaaattctagatactatggattactgtaggaaactgtcagtcatttagcatgcctggtgtttagcaggatggagggtagaaaggtatgatgaggaaaacatctagaacataatgcaagccacatatgtaatttaaaattttctagtagccacactaaaagatgttaaaaagaaaatacataattttaataatatgcttttagctctatatatgcaaatattttcatttcaatgcataaccaatataaaaattattaacgagatattttagactcttttttctttttactatctctttgaaatctggtgtgtgtttcatacttatagcatcctttggtttggactagcacaatttcaagtgctcaggagccacatgtggacagtgcaggtctagagaactaggccagaagctaagaataggtcaccaagaaccataatctgtatccattgtccaaacagagggcccagtaaagggtttaagctgaagggcaccatgatcagactcctggtttagaagtcactctcactgttctatgtgtagaacgtggagggttggagcaggcaagcccagacataagcacataatcaggagactttcagaacatcccatgtgagagcttgaatgaggttagttacactaaagatggagaggagccgatgtatgaaagatagaaaggaggtggtttgtagtaggtcccatgaccatttggatgtgagaaagtagatgtaataagatagagacacttagaatgattccaaggcttctggcttgggtcattgtgaggaaaattgtaagaaaaggaaatacaggagttaaaacatggttcactttgcggggataacaaggtaagattacagctatatatttggaaaagttttggttgagatagtatcggagatggaggagaagaaatctagtggacagtggatggataaatctggagcttaggggagacctaagctcctggtggaaccaccacaaggcttcgtaattttatgatattgctatgaaaatgccaggcactgtggaaagttccagttttctcttgttgtagaggcagaatcagctgaggaagaaagaccggagccacctcaggaagaggcctctgagctgtgggcaccagccagggaggtctgcttccctggcccagaatgaccggctatttagcagcgagggaggggccatgagagccacactgcggagttatcttagcggtaggagctccctgggcaggctgtgaaggccagagctcactgaggggagtaggaaggggaaggagtgtctggataaagcatcggacgttaaaaacgcctagattctgaggagtctgttgatggcatggactttggtctttttgttgaaaacctcttttgtaatatgttcaataagtggaattctttgctgccaaaaaatggggaggaggaagaggaaaaggagaaggaaggaaggaagagaaagaaagaagaaaagaattcctgccttgggatttgactatttcacatgttgtctccatctcagaaaatacgtatccttgtcagtgaagaaaaaaatgttttttgtatttttttttttttggtagagatcgagtttcaccatattgaccaggctgctctcgaactgaatgacttatatgagtacacatgtcatgtttaattgtgtttttctacttacatttcctattgtaaccttcagtgctcatctgggttgttttctgtttgtttgtttgcttgcttgtttttattctctaagaaacagtataatggctaagaccctatttgttgactaatcctatttctggaaggttagcagacctatgtgagatattgagacccttccctcttttacgcacctaaagtgaagtgtgtctgcccactgcctcttccttaatagggtgatgccttaatgcaagggttgcaaactaaagtgcctgccacagccaggtagataatacactggagtgatgtgagtgtacacagcaaatgagcttggccaaagggagcagctgttgtgaagctccagcagattcttgtgaagtggcaacatgggcgtacttgccagatattcttacttttgtgtgtgaaattttttggtgaagtttccccacttttaacttcacaaaatatcaattttatttaaacactgcagattaaacaaaatatgttggtgggttcttatcaacccacagtccaccagtctttgatatcaatctaaatctttatatatgtatgcatgtcatgtttcattgtgtttttctattacatttcctactgtaaccgtcaatgctcttctgggttgtgttttgttttcttacttgtttgtttttattctctaagaaaaaatacaatggctaaggccctatttgttggctaatcccacttctggaaggtgagcagacctatgtgaggtattgagacccttcccccttttaggcacctaaaacagcagaccatatggaaaatggcatattcccctggcagattcagggccacagtgtttgagagactatcggagatggaggagaagagtggagtgaccctggtgcaactggccacattttggtggtgactcctctaataagtgccaggttacttaaagtagatctcatatttaataataaatgaaatatcaaaatcattcatgagggtactagatagcatgcggaaaaaacagtcattatttccagtgctcaaagttaaacattaaaaaaaaaatcaaatgcaagaaggaagtaggtgagggagaaaataggaggaaaatgtatggaattcaatgggtttcatgtgcatttcccttggatgttattgagctctaggtcaggtttgtagaagagaagcgatgcttccccatcatgctccccagtcctccaccctccaccctatcctgtggggcagagttgctatagattgatgacactctaggacactggaccatgtttgccagtagaatggttgctgcccactaaaaggtcatgcataatgtccacacaaagacctgtacatgaggtttataacagctttattcataacagtcagactagaaataacctgaatattcatcaatgggtaaatgtataaacaaacagtagtaatctttacaatgggatactactcagcaataaaaagaacaagctactgacatacaccacaacatgggtgactcacaaaacactctgctgaatgagggaagtcaaaacccaaagcatttatgctatatgaatttatatgaaacttgagaaaaggcaaatttaatctataatgacaaaatagatctatggttttttgaggcttgggatggagggtatgtaacacaaaagggcatgaaggaattcaggcaaaagatgatggaaatgatctatatgttgattgtggtggtgtttccatgtctggttatagttttgaaactcatcaaacttaggcttaaaatgggtgcatattctttcatgtaaattatacctcagtagagttgatataaacaaaaaggtcacgtacaaagatgtattatctcctgtccctctttcatgtgtgctatagaagcagtctaaagacctaactctcttttcttctcctttcttcctccatgtggcctgaatggggagaaagccagggctctcttgcttaggatgtgcccagccaaaattttgctcttatcttgtctgatcaagcattttcatctatttggatttctgtcttcatttatggcagatgaggtgtggtgaaatgttgaagttgagtttgggcttatggggagaaaaggtgttccatctctgatcctccaggcttgctcaggtgtcccagcccagcttacaagggctgtgcactgtgggtaggggactgacttcagctgagaataggacacttgcttttcttttcttgaccaattttctgtagtatacagctccctcagggacatattggagagggagggctgaggtttacaaaatgatttggatattcctaagacccttgattaattctgtctaaacactgtaattatttctaagtcttccatagacatacttttaccaaaggcctcatcacctttacggaaacgtcatcctctagtctcagtaccactctggctggtcggatacttacttttcaaaatacagcttgagtcattgtcctgaatccttcctaccctccagtctcaaagcacatgtatctcttgttccatgatccaaaagaaggagaaggggcttaagtgtgatgcaagtctgggttcacatcttgacctgctgcttactgagtgggtgacttagagcaagtcacttatcctctctgagccccagaatatatatttttatatatatggtatagtatagtacagtatatatagtcaccaaggctcagaaattgatatatatatatttagtattttttaatttctaaaatagtgatgataattcctacttttcaggattgttgtatatattatataatatagttagtgtatacaatttgcacaacaaagatgcataatatattttagctattattattattagctgtagtggcagagacagcccctgcctctccttgcatgtaggtgtgtacatataacatggagacagtggaatgtaagagctgtgtgtcactcctggggtaaagattttagaaaaggacaggacttccctactgtctctttccatttctgttggctggaagcagaaaacaaagagcccctaggaaatggtgaagccacaagatctatggagcctggagtccttaaattactacctgggagacagctacctgtcacccaggaacacctgcaatgggctgttttataaggaagaaacaaacttattttgggttaggtccctaaaattctgggttttgtttattatagctgttagtgttaattgtcctggtaaatttagaaattggcactttgaagtggaggttaatgtaagaaaaacctaagatatgttgcatcgactcagcagttggatggtgggtggcacagacactgatatcaaaggctgggaagatggagacctgtggaagagatggcagagcatttggtaaatctgttgctggtgattatttaaaaggcatgcccagtgcctgacaagtctttatctccaggggagaggctggctattacttattgtattcagcaaggtataaccagacagatgtgctctgctaagaactcgtttgcatgagtgcagaaattaaacagtctagacagagtccagaaatctgatgtttcacaggattggaaaagcattattgttctcaacccatagaaggtatcactgaaaaaggctttgagcaacataggtccatttaaaaaatctcaatttaatagataccatgctagcatctacagactaggaaataagtagggactgttctctgccttcaaggagtttataacttagtagaaaagagaaaaatgtgtacaaataactgcagtggaagacagttaatgattgaaacatacattgctataaataatgcaagaatcacagcattctagggtagcccagaataggggctctcaaaaggactggggagcttggaccttggtttctcatcaaaccctgaaacccatgaatgaatgaataaacctcaattgtttcccaaactcattttcatcttcctgaaacactagagttcaaatttggtctctggggtagtagctgatcctctgggcattgaggagctccctcaggccagcccatgactttcctatcagtgttcttctctgcctttacaagtagttcagactgagacttgtatgggttccctactgagggcctcatttctgtaacagaagagggctctgacatccttatttttcttcaactgccctgagatgatgagatgccccagacctgaaagcaccgttgtgtttgctgagactgcttgtttttattgtctcttgtgttttaaatagtcattctttgggcaaagaatgagaacttgcagctccttattgtttcctggcatgaacctagtacctttttaacttgcttttattgcctctttggctgtgtggagcatttatctaaatatagactggtacaacactatgaacaggactggaataagataaaattttctttccgatcaattctgttacatcttcttgtgaacactaggtactgttcttttctcagagtggcaagagtaggcagcaaaaagagatgatattgagttgcaaagcttttctaagtggaagtcaatcactgccaggccttttaaagtcacgaggcccaggtactgagtgctctggacactggatctgcctatggccttaggcaaaccacataatcatggtcagcaacatacactgccccttggaggcagggtggtggagtggaaggggcacaggctttgacagaacccaattggatctaatgccctgccacttattttggggtgaccttgggtaagttccttattctcatttctaaaagggggcaatactaataaaatctatctcttagggctcttgtgaggattaaatgtgatgaatatatgtaacttactcagcacattttcaagaaatagcagctattatttttttgtaggtaggtactttgtggcattaatatatcaaatgcaaccatatctttaattttatttccaggaggaataatccatatatatttattaaagatattaacaaaaagcagctctcaccttcttgtgaatcagatccaaatcccttaacgtcttcattgattcaggtgagaggatttcattactgcaggagtgcactatagtaattagagcagagtctctggtctcagggttcaaaacttggtatgtgatattgagccaattgcttaagttcactgggccacaatccttgatctgcgacttcaaattgaaactatttataggctttacttgcttaatataaatctttctattttgggtgcagaaatattgggtttgattctaagggaccaccccagaccttggtgggtgttctgtaatatctgtcatatgcaccctgttgcctttattaattctgcattctgagttgcaaaactcatctggtttccagagatttggggatctatgatataccctcatagggtcgctgagctatagtcacttcatgccccccctccgaatcttattagctattattatcatcttggaatggttttttgatgtggcggttattctcccattttacatatgaggaaaataagacccagaaaagttaaatcaccacatagctcatatgtgatatggtcagaatacaagcaaggcatttctgacatcagatcccatgcattctgttgaattcattctgttgaattcccaggaccctgtacatgccctggcagggccagcctcaattaagattccacctggagagattagagtctacagttaagaaaacacaatcaactgggactgtcctcttcaggcatctcacaagcagaccagttctggtgtgggctcctcaccctcctttagcggctgtgcagaggatggaagggtgggtcccggaaggctcccacagggtctgccaaccacatggcttgagaagggagctggcctgcacaccgtcctttgctgatttctcctaagggatgtgagcagagcattgacagggtctgtgatacaccctttagcataattctgtgccatagcaggaacagtctattttgtgaaaagctcaggatgaaggctgtctctctcactactgttttgatgttcactgacaaacccacctaccatcaaatgattcccaccacactgcctgccatggtgcctgaaatttgtgctataagccatcagtctccagagactaccaataaaatgtctggacagtagggtaggggatgagggaaggataagaggtgggtcaccatcactgaagagtctgggtgaactggggtactagctcccaggctggaggtggcctctgacagacatggcctctgaggagtgtagcaccaaacacggacccaaaagcacccctcagaaaaggaaagggatgaaggggtcatttgcctgttttacacatttatccagatcaggacctggaagggaagacctccttcactgttgctgagactgcgagctcttggaagacggtgactgtctttttgtctctctctctccccagaactcagcagagtaacccatgacttgtttgactgaacagagtgcccatgggttcagtgctctgctctagtctccacctgccagtttccttctgacactgctatgagcaacccccatatttatgcagatgagtgctccataactccacttctcttcaataagaagaaagagcaacaccgctaacaacttattgttggtggtgagactttgggcaaattaatgagctctctgtttattcattgataaaatgtagagaatgcccctggcttcccacacttgtggtgaggactcagtaaggttcttgtggactgattgtgtccctctctaaattccccaattcacacactgaagctctaatctccagtgtgattgtttttggagttaggccctatatggaggtaatcaaattaacagaggtcatgagagtggggccttaatccaacaggactaatattcttataaaatggggaagaaacaggataccagagatctctatctctctcccccttctctctctctctctctctctctctctctctctctctgtgtctctctctctttcccagttgtacacagaagaaagcccatatgaggacacagcaagaaggtggctgtcttcaagccaagaagagaggcctcatcagagatggaatgttcctgcacttcggtctggatttctagtgtccagaactgtgagaaaataaatttctgttgtttaagccacctggtctgtggtattttgttatgacaggcctagcaaactaacgtaaaatgctttggtacagcagcaggcacaaggtagagattcattaattgtaataataccatataaataattattgataatggcactatcaataattgccattgttattgcttctaataaaacacccacccttctgggggagagaggaagaattttggaaactccagtaacaaacagtctgcaaatccactttgagcttctgatgagaaattgagggcactcgaaagaaataaatcacattcactgaaattttctgatcctatttctgtacatatgtcatgataatttgtgtcaagtaatatgacagcatctttcctctgagggacttaatgtgcttatgccaactacttatccatcaggcaaatgtttacattctgaggatgaactaagggaatgtcttagatagctgggagcctgaggctaggactgtgcactgaggggcactaataaaatcagataatcaaatttcttccaccttctctgtggtttaggctgtgcagtctggaagcaggccaggtggttggttttaggaatcacagggttgagcttacagtacaagacagattttacttcaagtctaagttagccttgactaatgattgttccatcacttttagatgtccagctaactcacttacaggcacatcaggaagagggacctctcaagactgttttctcaccaaaactctgaggttctggtttcataactgtattagtccattttcacgctgctgataaagacatagccaagactggacaatttacaaaagaaagaggtttaattggacttaccgttccacatggctggggaagcctcacaatcatggtggaaggcaaggaggagcaagtcacatcttatatggatggcagcaggcaaaaagtgagagagtttgtgcaggaaaactcccccttataataaccatcagctctcgtgagactatcatgataacagcacgagaaagacctgcccccatgattcagttacctcccactaggtccctcccacaacacgtgggaattcaagatgagatttgggtggggacacagccaaaccatattaataacattcacattctttctggacacccaatcaagccctccacatggacctgtgggctgcagactcttgcagacagatcagggaggagggcagaaaaggcctctcagcaactgcagttctttgtgcctgcatttccaattcagatgaatgcattagaaatggtcctaaaatgtatttgaaaaaaacagaaccatctaagatcattggtcagagctccaaatggtttataaagagggggaacaatatgctgacttctgaaaaatgggaagggggttacattggcttgattgaaaccagttgaaggaggttttttgtgtttttcccccaagtttttcttgactaatgattgttcaggtctttaaatcagtgttgtccaactgtccccaaagactacataaggcacagttgaaatctgtattgtcccttgctgttactgcctctccgctgcccttaactcacaggatgaggtattataggttatagaatcccttgctttttattcctttatcacagatggatgaagtgctcaaatctgaatcattaaaccgacttcttttgtacctctcagactgttcactgatttaacgttgttttaatgtattcattagattcaaacatttactgaacactcaccatgtgccaggccctcttaaaggcacgggagatgctaaggcaaatgagacacagatcctgcctccaagggctccagtgtagtggaagggcagagaaatagttactaacatatggcaatggaggagggcaaggaatggagaaaggctttaaagggtgcaccagggacctggaggtgaccttccaggagggaagaaaaagacaggagcattaggagggagaaaatttaattgggaaaaagaagcagccagcaggttgttttgagagaatcaatcttttgctgtatggctgaaggcagctggtgatgttggtattgatgaattgcatgacataattatttggcacagaaagaaaaaaagaagggaagaaaggaaagaaagaaggggagggagggaggaagtcaccttctatacttgagaaaatatcatcaatgaatccatctgcttctgttccataattccaaccccttctctcaggaggagctgagagattggtctattagaggttctctttggcttccataaaatctaacaaaaataccccaccaagtttattgctctccttgtttctcggaagactggagaatggacttgccttggaccaaaccctcgagtgcactgacttaggaaaggcaatggaaatagatgtcttttgttacaagggtgatattaagattgataaaattaaatatatattattatctggtttgaacatatagttaattagcatgtagctttgaatttgttatgttggtggccaaacctgttagaaacaggttggaatgctattctaattgcctgattctaaaagtaggtttccagagatgggtcctagcatatagctacacaaatgtagtactgcccacaaggaaaatggaggtgaggggcaggagaaagatgtagtagctactgaattaaagctcagtttaaggactacttttcaaatgaattgggggccagtagtaaagtgcgtatggtggccaactgaaccagaggaaggggaacggggggcaagaattcttcctgagagcacctgtgcccttccagagctgtgttcttctgaattttctcctctcctttcagtaattaattgggcttaattaataggatttggttgattttatctgcaaatctcttttgtacatatctgaagacctaaacagtggtggtaaaaaaattgactcaaactttttcagtccagagaccagatgactgaaatcatgtcttactcatctttgcaacctgagcacccagagtagatactccatatgttcattatgtaaattaataagcttcttcactgtacctcattttaccctagaaaacctatttcttcaacaaatgtttactaattatctacttttgccgggtgctgagtcaggcactagggatatgagtgggcaagagagaaaagacccttcctcctggagtttgctgcccataaggaaagacaataattaaattaagcattacaagaaattatgatatcatcacaatatggcaagtgaatgctaatagagccaataccaaggggccacatttgttggagaggtggctcaagggacacctccttgtgcaagtgactcaaattaagttagcactctcagctctagtggtgctgataatctatctggagaaaaaaagaatatcatgcatgcaaaagtaagaaagagtacagtgtaggacactctaggttcagtgttagattatggattatagagggtagaaaggggtgatatcaaaaagggtttatgtaggctcagaagtttgcaggaggaaggagcacttggactgtccttggaagatgggtagaagagtggaatagaacaagggaggaaagacagaaataagaatcccacacaacgggggaagtgaagcctcaatgggtagtggcaggagacaggctgaaatcatgcaagacctggtaagtcagtggaaatgaaagtgtaagtgcagttctattatcattattattcttaataatgtgataaaagctactgtacaccaagtcctagtctgggttaggtgctgggtagaaaatgttaaacaaaaggtctacaattcattcttttttgctaccaaagggaagtccatgggaaagaaggaaggaaggtaacttaatcaaatcttcacatgaacatactaatgacaggcctccagataaacacattaatgatatttgctagtgcagggtccttatctatagaattctttttaaaggaggtacctgatctgcctgggttgctcatttgtaacaaatctgaatctatgcctgtattgggtatgggttctgagaaaaggtcaggtcaattatataactatctaagtataatatgaagatatttattgatggttcttttctgtgtaggtgatgtgccacatacatggcttgaagatcttctgtgttaatctggggaagaatatcttgatgtggcatggaaggactcaggacactgcatgggtcctaagccactccctgcttcatttgtaattgcttgttttattgaaattattagcaaagtgtgatactgggtaagatctctattatgtgaatccactttgataatctgatctttttgtgttatgttaggtactttacttaatatattgtctcacatcaaccctacaaggtaagtgcccagagaaatgagttaatgtgtctaatatcacagtgaggaagcagcagactcctaatttaaacccaggtcaaactctgtgctcttcccgctactccatatcacccactgatatggtttgcctctgtgtccccacccaaatctcattttgagttgtaattcccagtgttggaggagtgaactgatgggaggtgattggatcatgggggcagatttcccccttgctgttctcatgacagtgagtgagttcccacaagatctgatggggtttaaaagtgtgtgtgtggcacttccccctttgctgtctctctctctctccttctcctccatgttaagatctgcttgcttcctcttagccttctgccatgattgtaagtttcctgaggcctcccagtcatgcttcctgttaaaactgcagaactgagtctgttaaacctcttttcttcataaattacccagtttcaggtagttctagagcagtgtgagaatgagctaatacacccactttaaaaaacatgtataaaacagaatagagccttgggccccaggaaggccctaaggaccatcaagacccacacaagccctttgaggaccacttaccgaaagaacagctttaatgagaaaaggctttctggtataaaacttggccgggtgtggtggcttatgcctgtaatcccagcactgtgggaggccgagatgggcagatcacctgaggtcaggatttcgagaacaccctggacaacacggtgaaaccaagtctccacaaaaaattacaaaaattagctgggtgtggtggtgcgtgcctgtagttctagctacttgggagactgaggcaggagaatcacttgaaccctggaggcagaggttgcagtgagtagagatcacaccactgcactccagcctgggtgacagagcgagacactgtctcaaaaacaaaatcaaaaacttgatttatgtgagacccaaaaggtagttcttttgtcacattttccatggaaattcattttcaccagaggcaaatgcttatatctccactgggagtctgcaactcatagagtttgtgtactatcaggggaataataatacattctttgaatgcagagagaatagccaaaagactgcacttgatcagaatcagatgatatgaattgaagtttctaattctatttttagccctaaagcaagctgagccttgtgggaaggtttaccaatccctgatgggtgggatcagccatatttcacaggggcttccattttataaggatatttgtatgcattcattcatggctctgagtttttttacatggtcctttgcaaagcattaagatcagcttcttgtcagggaacttgaggatccatgaaaaaagtaaataaataaaaaacaaaaactagtatgtgagcatgaggaaggaggtaggtcatgctaaggaatacatctcttcttttctgcaaatataagtggtttaattctagttgccttgggttaaggagtcccattcctcggggacagctgcctagcacagtgccttagttcctgtttaaagtgccacaggacatgtatagctgagatgtgacagattgcccctgcctggacctctctctcagggctgccagcatctttaatggacagatggagctgtcttccctttcttggctgtggctgtctgatcaactttggagatagcagtcaaacttctagttaataaaagtgcttaataagtattcaaattgtaatatccccagaaagatggttaccttggtagaaaaaccttctgataaaagagtaccagaatctctatttcaagaatcaaagtggctgggcatggtggctcacgcctgtaatcctaggattttgggaggctgaggcgggtggaccacatggtcaagagatcgagaccattctggctaacatggtgaaaccccatctctactaaaaatacaaaaattagctgtgagtggtagcacacacctgtagtcccagctactcgggaggctgaggcaggagaatcactcaaactcaggaggcagaggttgcagtgagctgagatcgcgccactgcactccagcctggctatagagcaagactccatttcaaacaaacaaacataaaaagaaagcagacacacatagacttgatatctatccctaccaatagcttgagggacactttaacttgtgtctttacaagaaaagtaaaaagcttagctgtggattacgaaacctatagagctgagttgagaaaaacaaggttctggtgtagaccttgggtttctctttggaccgcctgatccttttcttagcctatgctgttggtatccttctccagtctccaccggatagtgcttgcttgcttctgggcccttatcatcttcagagtcctccatctttgtttatactcttacccaatattccctttatatacaacctctctccattacaaaggagaatctgattctctccaatacatggcaaaatactggctatttacttcattactatcagcttatttcctgatgatcctgtgtcttctcaaacccagtgctagatgttcttttttggttttgcaccctgctctttgtattctttcttttgcctatcatacagtgaagaaaaagggaagtaaacacctttgtcttttggaggcaagaataaactccagctgaatatagactcctggcaatgcatcacaaagctatttctgtactaccatagtctgtctactgtaatgatcttggctacaagtaaacacaatacccaactaaaagtggctgaaacaatgaggggtctattttctgagggtggttaatacagcacaaaagttgctacaattcttgatgaattgatctgttctcctttagtttctcaccgtgggtgaagatggccgcctaagccatctttggccgaacattatgtcttcacacaactacatccaaaggaagacagggaaagagtccatcccattagagtgctctttctcttttttaaaaaatagggaggaaaagttttctaagaatataccccctagcagattttttcttaggtaccacgggccaggagagggccctgtgcctgtgctctaccttcagtgaagctgggaaaagtgatgaagttgggaaaagtgagtgattggcttctatggtggaagtggactttatgtgtaaagaaggaagaggagaaaagctgtggggtagtcaaccacagccattgaataccttcctgaagtgcagcagtccaggaatagattatatttaatcatttcacattgccatcacatggaccacacctacagttaatatggagtcgtagaagaaaaagagacctcaagagttcacctctactcctctgtggatagatggttggctaccacaagctttcttttttaattgtaaaatatacataacaaaatgtaaaattttatccatttttatgtgtacagttcagtggcattgcatacatttatattgttgtgaaaccatcaccttcattcatcttcagaactagtttctcttcccaaaattaaactctgtatccattaaagaatggatacagatcccactgtcctctcctcccagcccctggcaaccaccagggctactttcagtctctgtgaatttgactgctctagatatctcatataagtacaatcatatactatctgttcatctagcttaatttaaagatatttggtcacccctcttaaagtgcccttcatcttcctccaccttctcttcctcctctcctcttctcaaaatcctttccatccttcaatgctcaacaccaagattttcagttcctccagcccatgaggctctctccctattctggactcagagtgttctgtgtacttgactttcccactttcttgaccttatgtacactgtcttatgccgtatcttgagttattatcttttacttttaacttttattttaggttcagaggtacatgtgaaggtttattacataggtaaactcatggcatgggggtttgttgtatagattatttcatcacccaggtattaagcccagtaccaaatagttatcttttctgctccactccctcctccccctctccaccttcaagtagaccccagtgtctgttgtttccttatttgtgttcataacttctcatcatttagcttccacttgtaagtgagaacatgtggtattggtgactttctagtcctgcattagtttgctaaggataatagcctccggttctatccatgttcccgcaaaagacatgatctcattattttttttatggctgcatagtattccatggtgtatatgttccacattttcattatacagtctgtcattgaagggcatttaggtggattccatttagatctttgctatcgtgaataatgctgcaatgaacattcgcgtgcatatgtctttatggtagaatgatttatattcctctgggtatatacccagtaatgggattgctagaaaatggtagttctgcttttagctctttgaggaatcaccatactgccttctacaatggttgaactgatttacacttccaccaacagtgtataagtgttccattttctccgcaatcttgcctgcatctgttatttgttgactttttagtaataaccattctgactggtgtaagatagtatctcattgtgtttttgatttgcatttctttaatgatcagtgatattgagcttttttcatatgcttgttggttgcatgtatgtcttattttgaaaagtgtctgttcatgttctttgcccactttttaatggggttgtttgtttttctcttgtaaatttaagttatagatgctggatgttagacctttatcagatgcatagtttgcaaatattttctctcattctgtaggttgtgtgtttactctgttgatagtttcttttggtgtgccgaagctcttaagtttaattagatcccacttgtcaatttttgcttttgttgtgattgctttctgtgtctttgtcataaaatgtttgcccaatcctgtgttcaagatggtattgcctaggttgtattccagtgtttttatagttttgggttttacatttaaatatttatttcatcttgagttaatttttgtatatgatgtaaggaagaggtccagcttcagtcttgtgcgtatggctagctagttatcccagcaccacttactgaatagggagtcttttctccattgcttgctcttgtcagctttgttgaagatcagatggtcataggtgtgcagccttttttctgccctcactattctattccattagtctatgctcctgtttttgtatgagtaccatgctgttttggttactgcagtcctatagcaatagtttgaagtcaggtaatgtgatgcctccagctttgttctttttgtttaggattgccttgggtattagggctcttttttggttccatatgaattttaaaatagttttttctagttctgtgaagaatgtcattggcagattgatagaaatagtattgaatctgtacattgcttcgggcagtatggccattttaatgatattgattcttcccatccatgagcatgggatattattccatttgtttgtgtcttctctgatttcttggaacaatgttttataattctcattgtagagatcttttaccttcctggttagctgtatttctaggtattttattctttttgtggcaattgtgaatgggattgcctttctgatttggctcttgtcttggctattgttggtgtatagaaatgccagtgatttttgtacactgactttgtatcctgaaactttactgaagttgtttgtcagctgaaggagattttaggctgagactgtggggtttctagatacagaatcatgtcatctgcagagatagtttggcttcctctcctcttatttagataccctttatttctttctccttcctgattgctctggccagaacttctaataccatgttaaatgggagcagtgagagatggcatccttttcttgtgctagtttttaagggtgaatgcttccagcttttgcctattgagtataatattgattgtgggtttgtcatagatggctcttattattttgaggcatgtttcttcaatacctagcttatagagagtttttaacacgagagggtgttgaattttatcaaaaaccttttcggcatctgttgagataatcatgtggttttgtctttagttctactgtttatgtgatgaatcacacttattgatttgtgtatgtcgaaccaacttcacatccctgggatgaagccaacttgattagcttttttttgatgggctgctggattggaccaaatggatcttatagacctctacagaactctccaccccaaaacaacagaatatatacattcttataatcaccaaatagcacatactccaaaattgaccacataattggacataaaaaatcctcagcatatgcaaaaaagaaaaaactgaaaccataccaaaagcactcttagaccacagtgcaataaaaatagaagtcaagatgaaggaaatcgctcaaatatgtgcaatgacatggaaattaagcaacatgctcctgaatgacttttggataaataatgaaactaaggcagaagtcaagttctttgaaattaatgagaacaaagatataacataccggtatctccaggacacacctaaagcagtgttaagagggaaattcatagcaataaatgccacatcaaaagattagaaatatctcaaattagcaacctaataatcacaactgaaagaactagagaagcaagaacaaatcaatcccagagctagcagaagacaagaaatcaccaaaatcggagctgaactgaaggaaattgagacaccaaaagccatttaaaagatcaatgaatccatgagttgttttttggaaaaaacattaatagtataaataggccactagctagactaattaagaagaaaaaggagaagatccaaataaacacaattaaaggtgacaaaggcaatgttaccgctgaccccgcagaagtaaaaatgaccatcagaaactactacaaacacctctgtgcacataaactagaaaagctagaagaggtaaataaattcctggacacatacaccctcccaagattaaaccaagaagaaattgattgtctgaacagaccaataatgagctctgaaattgaatcagtaataaataacctaccaacaacaacaaaagcccaggacctgatgatttcacagccaaattctaccagatgtacaaagaagagctggtaccattcttacagaaattattccaaaaaattgaggagcagggactccttcctaactcattctgaggccagcatcatccggataccaaaacttggcagagatacaacaaaaaagaaaccttcaggccgatatccttgatgaacattgatgcaaaaatcctcaacaaaattcttacaaaccaaatccaacagcacatcaaaggagttattgtattacctatcctttgtgagtacgtcttatctttccaactagattgggacctcttggagagcatagactatatgcatcttacttttctttctgtcctccaaaacccaagccttctacacaacggtcactcagtaaataggtgtcaggttccattctttctttaggaaatctgcataaattacctttataacgaagatgttttgtcttaagtatgatcatgctctttggggtcaaaacttaagtcattttgtttcttctttgatcttccctaagatggagaacaaatgttcagtgtcctccttaaacctgtaaatatactagaggtaggttaatgtgtcactttagctttcagttttctggattaagccaagataatggggcagaaccattatacttacacaacaccttttcctgagaaattcttaatacttcctttacattaagatcaggtttttccatggtcacaagtcagcataagtttgagaatccagggaagattatctcttctgtagaaaaagtcttgagcctctggcaagcttttattttttacaaagactcacttggaggctgcttaatatctactgaaaccctgatgactgacatacacacatacccaatgcacactctatccaaggattgtaattttgtatatttaaaattttaaatttaacaaggggtagatgtggcttagtctttcagtattgctgattaagtgactaaagattttagcaactaggaatttgtaatgatgaaatattgttctgttaatactagcaaatttaactaaagcaattctaaggaatggtgattatggatatattctaacccactttacccttttcaaaatgtagtgaaaggcatgaaactcaaactgctagggagggcacgaagaagttggggctgcaggctgtatgcttttgtaaacacgtccagctccctgctctgatgatgtgtctgcagggtcatttggaggagttgatatgagggagcagatgaatcttctcacttaaaatatcctgtaacgtcaagaaaatctatttgaaccccagaaagtttataagctagttggatgtgttaattaatattggcttgttgaactggcttgttgaggggtgtcaggaacccttctttccttatgaagaaccatagaaacaacacaatggggccaggcatggtggctcacatctgtaatcccagcactttgggaggccgaggcgggtggatcacctttggtcaggagttcgagaccagtctggccaacatggtgaaaacccatctctactaaaaatacaaaaaaattagctaggcgtggtggtgagtgcctgtaatcccagctacttgggagactgaggcaggagaatcactcgaaccccgggaggtggaggttgcagtgagccgagatcgcgccattgcactccagcctgggcaacaaaagagaaactccatctcaaaaaaaaaaaaaaaaaaaaaaagaaaggaaaaaagaaataacacattggttgggtgaatggaggattacacccaaggcacctgggagggaaactctgtttatttcttgagatttccctttggtttgattgtgtttttaaaggattgggaaaaattaagaaatattaaacctgcttcagattggtttatcaaacactcacatagtaatataataattgtaaggacaataatttctagtttgtataaaatagtttttattggattcctaatgtccaagttcggaggggctggtaagcattctggtaggaaagagtcatttcatcaattagaagaaagagcgtcttgggacatatggcatttggaagtgaagtatttgatcctagagttttggctggccataaaggaaagcttgtataagcaaaaaagaaaatatgttttcttggtgagaaaacagagtagaagggacatttgcagtaggaaataaggatggtaagaagaggccaggcgcagtggctcacgcctataatcccagcactttgggaggccgaggctggcagatcacctgaggtcgggagtttgagaccagcctgaccaacatggagaaactccatctgtactaaaaatacaaaattagccggatgtggtggcgcatgcctgtaatctcagctactcgggaggctcaggcaggagaagcacttgaacccgggaggcggagattgcagtgagctgagatcgtgccattgcactccagcctgggcaacaaaagcaaaactccgtctcaaaaaaaaaaaaaaaggtaagaagaaaaataacattttatctttgataagagcaagtagagcgttatggtgtttttattctattttgaagttctagaaccaatgcagcctcccgagggaactgcaaatgggccaggcactttcataatatttacactcatttgttcatccatttgctgtccatttatcattcatccaaaatcatttattagggacctcttctatttcatgcactggggctatgatgataaatgaattcttcacttggaggaactacactctactggagggaggcctacataaatggggtttagggtaaacctgacaggtgttctactagatctaataacagatttctgtggacatacagagaaaaggtcgcccctctgggttgctggaaaagattcacagaaagtgatatttgaagtgagttttgaaggataagtgcattcatcaggttaagccgttgagaaaggaaagcccactaggggacaggcctgtgcaaaagcactgaagtgtgactgggtatgcagagaacagggaaggtggtgaggtggtgggtggaggaccgggtacagaaccgtgggagaggtgatggggaagagtgaaactgaaactgtagggcaccaggccatcgccctccatgcatccaaactcaagtgccagaaggcacaacctcaacccatgggtggcagccctactgccaacacagatacacacacacacacacacacagacaccacacaccccaccacacacacataccatgcacccccccattccaccccacaacccaccacacacagagatacacacaccccatttcacaccccaccacttacacatcccgccaccaaacacataccctccaccacatacacacatctcacgcaccctactccataccccacccccgacacaaccccacacaccagcacaccccttcacaccaccacactccccacaccactgcacacacacaccctaccacatacaccacataccccccacacacctcccacatatacctcaccacatatattctacatctacctcacacacactctctccccaccacacataccccaccccccacacaccccacacataccaccacatacccctccacacatcccaccacacacccctcaaatcctgccatacacacacaccccgtcacacaccccaccacatacacacacacagagacacaccctaccaccacaccccgaacaatccaccacgtaccccacacctcacacctgaccacacacaatctcccctcacacacacctcacctcatcacacacacacacaccccccatacaccccccaccccacatacagaaacagttgttttggctgaccccctcctgagaaagcagagttgactctgggctgcatcccacagagcacagcccagggtcctgggaacactgtaagggacgttggtaagggggatccagtactggtttttaaacatgggagtgctacacacatcgtctgtggactgtgagtacattgtgtcaggactaggtctaactcatactctgttccttcctctgtgcctagcaccatgctggcatatagaaggtcctccttaaatacttgctgcatgaataaatgaactaaacaaataaggcaatgtggagaatggactagcgtggaaggaaactactgtcagttcagaggctctcacaagaatctaggtgagcgatcacggtgggattggagaggaagaaccagaatgtagaccagcactctccaacagaactttccacatgatggaaatgttctattctgcactgtccgttatgcaaaccactagccacacatggctcttgagcacttgaaatgtagctggtaaggctgagggactgaacttttaattactttaaattttttttctttttttttttttttttttttttttttgagacggagtctcgctctgtcgcccaggctggagtgcagtggcgcgatctcggctcactgcaagctccgcctcccgggttcacgccattctcctgcctcagcctcccgagtagccgggactacaggcgcccgccactgcgcccggctaattttttgtatttttagtagagacggggtttcaccgtgttggccaggacctcgtgattcacctgccttggcctcccaaagtgctgggattataagcgtgagccacagtgcccggcctaattactttaaatttaaatagccacatgtgactattggctaccacattgaacagcacagttctagagatttttgtggcagaatcaaacaaacttgtaacaaactggatttattcattaatttaatcaataaatatttattgattgtttactttgttctgcagtgaaaacgtgtgtggcaatagggtgtgacacgccagggtgtttagactttgtgaggtgcttggtaaaggagacccaacaccagtgtttaagcatgagcagagcaggtgatgtaatttccctctagagctgacattcttctgggggaaggagggaaggaaggaaggaaggaaggaaggaaggaaggaaggaaggaggggaggggaggggagggagggagggagggaggaaaggaaggaagggaagaaagggagggaagggaagaaagggaaggaagggaaggaaggaagaaagaaagagagaaaagaaagttctatgaagagaatgaaaacaagtgatataatgagtggaggagagtggacaagctattttagcaggattggtcaaggaaatcctctctgaaaggtgacaagttgagagttgaataatgcagaagttatgtggattaagaaaaacaaaaacaaacaaaacctcaaaacaagaactaaaataatcattgatgagtaaaagcaataaaattcatcctgaagacacctggtgcaagaagggacctattccatctgcaagtgaaactcactcacttcctttctccagaaagaaaactgaagcctggagaggtaaagagacttacctaaggccagttggcaaaagactcttaacctcctgacctccaactccactccctactgggtaagtgtctcttagcatcttgaatttcatttttcttattagtaaaatgagttattgatagaaatgaaaaatgtaacatagataaggtgctaaaaatagtagctattttcatttttggattttttctaatcgttgtatagtgtgcctctcaaataattaactatgttattattttaataatatagaagtattaatataatatataattatgtataattaatataatagagaaatttagtaattggataatacagaaagcctaagagaggcaatgagcttcaagtcctgactttttcttagtcttcattgtctggggtaaatcttagcattgggcctatgcaatcaacctccagtaccacctgccattcacctggaggcagctgctggagctcttcgaatgctgtcagagaaggaataaccatcccccacactgctggcctgacaacccccaccttattaagtggtggtatgtatcacagtcctaggatacttctgaggagaggaatatgaggctgtggttttctcaacagacacagctgtcatcaagctctttatggaaagctgctgtagacaggggctgaaaagaagatgaaggctttaacaggttgtgaaattgcagtgataaaaagagagcactaaaagcatatggcactggaaagggttttctgcatccaaattgagaatcagaccttcatttgtttactcttcattttactcccaccacacctctgctgtttgagctggtatttttgtaaatattcagataggacaaacaaggtgataaacgaggtcatggctttgccagagggagagacagtgctggaatataaatgttgggtctccttgacttctcaatgtcatttgccttttctagccacacccttgggtctcaacccagggtcttggactatgagcccatgctctagccattctgccgtgttgcatctgagtttggtgtctttggagccactggttcaataatccttagctgatagtttgatctgactattgtatgatcaccagagtaacactgaaaatgaggcattgaacacctatgggttgcatgtgagtgacctgagagccatgtctgaggcttactgcccacagctcatgacctcactgttgcaacctgacctggtcagggccaggaccctctccccaggctggagcatcatctcctcccatcattcctgaatatcacaaagacccattaggataatgcctctgtgcctttcagccctcccatgctcagcaatgcaccttccagtgaacatagtggcatacaaataactgcagagatagaaggatccaagtccttggcccaaatctagcaggtctagataccagaccttgctctaccacttagttcactgtatgagcttgggcgaattactttatttatctagacccctatttcttcaaatgtgaatgtggaatattatctacctcatagaggtccaagaatcaaaaaaatttattgtatatgaaaatgctttgaaaaatagaaagcaccaatcaagtaagtacaggtattattcagtagtctacatacactacaaggatttttttgtagaaaaaaataaaacttaataaatattaaattatattaatatcactttcatccatctatccattcatccatccatccatccattcattcagtaaagttgtattagacaaccagtctggggcaggcactgtattggtgctaggtagatacatgattgtgaacagcaaatatattattccttgggttaattagggttctccagaaaaaaaaactaaagggaaatatatatctcaaaaagagatttattacaagtaattagctcatgtgattatgaaggtgggaaaatcctgagatatgtgggatgagtcaacaagttggagacccaggagaactgatggtttagttctagtctgagcttggtgatctaaaaaccaggattgatggtgtagctgaaggccagcaagctcaagatccaggaagtgccaatgtttcagtttgagtctgaaggcaagaataaaagccagtgacccagttcaaaggcagtcaggcaggaagaattctctcttacctgggggagtcagccttttgttctatgcaggcctgcacttggttagatgaggactgtcacattagggagtgcactctactttactcagtctgccaatctgaatgttaatctcatctaaaacaccctcacagaaacacccagagtaagtttcaccaaatatttgggcaccacttggcccaatcaagttggcagataaaagtaatcatcaccttcctaacagagcttactgtctatttgggagagaaggacatagtaaagcaataatcatgcaaacaaatttataatgagaaagtgtgctgagtgctatgaagaaaaaagtacaggctcccaggagtgatgataacactggaggcatataaacatgaaactttagttgacttgactgatgtgggacaaggggagtgcataggggaattccttcagataggacagcactcagcaaatgaaatatccaaaaggtcagtgtggctggaacacaggaaagaagagggattatgttgccaatatgagcagacagagggaaggtcacagacaactcttagggttgtctatgagaaggctgaaaagtttgaggctggtgaaggaagtatgaaatagaagttgccagactgagagaatgaccttattcattgacaatgtaatggaataatatggttgtgtggtctgtttaagttgagctagaataaattcataaacattgtaatctctcaggttgcatgattttttttttttctgagacggagtctcgctctgtcacccaggctggagtgcagtggtgtgatctcagatcactgcaagctctgcctcccgggttcatgtcattctcctgcctcagcctcctgagtagctgggactacaggcacccgccatcatgcccggcttatttttgtatttttagtagagacggggtttcaccatgttagccaggatggtctcgatctcctgacctcgtgatccgcctgcctcagcctcccaaagtgctgggattacaggcgtgagccaccacgcttggccaggttgcatgatttttatagccttttgtttgacaatttgatgcagacatataaattaattttaacattgattgttgtgactttccactttatactattttgcatgaatatttccacatgtttgtttttcataattttgttatttttaatagctgtgtagtattccatcatggtttccatcatgttatttctggcccttctacacactcctgtggtttttagctctgtacactgtttttctgaaaaatagttctgctgagaatatcttttggaacagtgttgtttcttatgagctatttttttaggttgcatcccctcatgggttgcttctctgcatgtcacagcttctctgtagcacacagcgtctgtggtgtggtgctttgtttgtcttgtctggatgtgagaaattcccatggcaccagctgctgctgcggagttggctggggaggagtagtgacaggcaggaagaggatgaccctcattaggagttcagagaatgcaggttattgtgttactgcactgtatcctccaggatgtggcctctgtgagtggtttgttctgcactgagaacctccatggcccttaacctaacagggagctctctgcctttgccaccttccccaagggcctattaagttcctggtaagtgttgttctatgtagaacaaagaatatgtaaggtagtggcaataatgtaaattattgttcataagcctctggactgtaattaaattaaagttatgattatatcatctaaggcaaatggttccctaggtgccatcatttttgtttattcctttatgtagtatattcattcttaatttctacatattattgagaaattagtaggggaccagctcatcaagccaagcaggtatcagggaaactcatataacatcccttctttgcctaatcatagtgcacccactcatttgacccagtgtatctcttaagcatttagcatgtttaacactggtcaaaaagttaatggaacaaaacagagtaactgaactcatttgagttgggacaaggataaagtttaaattcggttttctgggggaaaaaattctattacttttgtcaaacataatatcatacagtagtaatttagtttaatgttcttggcaattggaaaataagttccaaaggattcctctattttatcaaagcaaagaaagacaagtacggaacataataaccattttgtcctcttacccacaaagggtatgtaggagaggaggcaggctcctgctagaatcttagtcattttggtcagaaacatcatcactgatggcagtgatatctgtagttaataacagcaatgatagtaacacataaaaaccatggagtgttaactgtatgctaggcacagtgctttatattgcatcattacctccctcccatgaaatgggttttctcaaaatcacaaagctggtgagtgatggactcaagattcaaacagtagacccaaagccggtgctcctaatctctctctaccctggtaatacagtggttggaagcagtggggtggcaggaaaaacccacaccaagggatctcagcattgcattgcgaagcacatgccatgttagctttgaatctgttatgtaaattgaattaagtcacattatgattattattattttgagacagggtcttgctctgtcgcccagctggagtacagtgacgcaatctcagctcactgcaacctccatctcctgaattcaaggaattctcctgcctcagcctcctgagtagctgggattacaggcatgcacaaccgcacccggctaatttttgtatttttagtagagacggggtttcaccatgttggccaggctggtcttgaactcctgacctcaggtgatccacctgcctcagcatccccaagtgctgggattacaggcgtgagccactgcgcccagcccacataaacttcctgatgttccattttctataaaacagaagagacgcttgtattttttaactcccaatgtgggtaatgctagataagtgtggaagttctttgacaaccagccagaaagtcctatagatatctaaggattcattactttgtattgtggttgctatgatgatgatgtggcaggattcttgtacttaaaatatgagacatgcaacagctgctctggggtgaggctactccaatgggctaaattcaaatgtctcatgcagtggagttgcgtttcaatgagtcatctgatatgctgatgtgccagggaatcagatacttcacagtcagaaggcagcaggaatcatgtgtgttgtggatgtgatgtgactgacgtggtgacagatacattcaaagcatcagcaggctctctaaacaaagctccttctaggaaaactgatcactgtggcaggctccctccaatgactgcaggctgggaattgaccataacagatcatgatgtaggttctagaacaagactgaggggtggaacaggagtcaggtggtcttcagagtgattttattgacattagcccaaccaaggctccaccatgctttgggcaatcagcacatctcagggcttggggttctggatgttggaatacattgcataactggtgcagtagcaggacatgaaggccaaggcagaaatttcatccgtactttatgtaaacccagtagactggtggtctcaaactccagagaaactaaaatccaactgttgggtactacgctcactatctgggtgatgggattattcatatcccaaacctcagcatcatgcagtatactcatgtaataaacctacacgtgtacccctgaatctaagtaaaagttgaaattatttaaaaaacaattgttcaaattcagatttctggtcttcattcccagagttcactattccactggtttggggtgggggccaataatctacattcaacaagccctttaagtgattttgatgcggataatgtacaatttccattttcaggaaataaaatgtagtagatacaggaaggactctggatgagagtgaccataataaaaaccaaaaagttaacatgtattgagtatttactatgaactgggcactcttcaaagtgctgtacagaaattaactaattatcatgccatcccatgagctaaccactaatatttcctccattttacaaatagaagacactcgtgtcctggtttcctggtaaaatgtgaaagtttgaatgtgtcagaagaattttgtaaggaagggatagattgctcaaattccacctagaggaacagcatatactgccatcactctagtgttttaatatagcctgattctaatatgaaaaattcacagcagcctggtagcttagggtagggatggagcttaggagaaattgcccactgtagcatctatctcacagggtaccaacattgagactggaagacattaactccaattattccttgccctctgaatgctgaaattgcccttacctcaaccttgtttttggctgggacctgttgaaatgctgcaagcctccagcttgctaatcaggtttacagaaaaaaagagattttaagcctctactaattaaagatataatgctaaccatctatgaccagttaaccatctatgaccagttagctcatttaattagagcccattgagaataagagtgaactaatcgaacctaacatttactttctattacagaagaatttatttgaatctctcttttccttggctaagaagaatgaagaggcaggagacttgggggaccccttaactggggataattactgggacaaatcagccagcacaaagaggaggtaatatttggatggttagttagaaatattctttgctgatttattattcatgtactatgatttaaagaaccttgaagttgtctgaacattgtttaaaattttggaggtctagaattccagatttatgtttctaagtgcctacctgctaagatgttccattgggttgttcagctagtatcccttccccaaaacatatcccaaatcaatcccatcatactccccaccaagtctctcttctctggatgacactacttctgttcctgatcacactgttctcccagttctggttcagaaacacagccatctttgaatccaccctccctagagagttggttgtaagataaattcacatgttttctcaggttagcttttgctcttccagcaagaagagcatcactatcacccatagttcaatccttttcatctcatggggtctgaaccacattctggagctttcctgaccagcatcttctccgtttgtcctgcagcttcttcttcctacaatggctctgccatattgaaatataattctttagcttaaactctctgtgatttttattgcctcctaaataaagttgaaatttactaaactcaaaatctggtgtacaagtccttctataatcttttcccatactatttgtctagccttgttttctattaagtctttaaaaacaattttactactcacagggctgatttacctattagatacaggaagtacagcacctaggtcccacaatgcttttagaggtccaggatcttttaatttctttttcaatcaaaagaaaaaagaacacaatccaaattgtattgtatgcataattatattaacacagttgtaaaacataattttaatattttttggacaaagatacctatgaaagcaaaagtgtcaagtcccatgaaagtcatgtgactttccccgaaatagaaaatatagatttaataaatgaactttggtgaaagatttaaagacaagtaataaggtatgcactcattaaatgtaaaataaataaataaaatcatcaaccctgtctcaaaaaatgtttaactttcatttgttcgttaataactcaattactcactcattcaatcaacaaatattaattgcactcttactatttttcaggcactaaacaatcagtcctggtctctgttatcagagacttttgatgctaccattggagtcagacaagcagacaaacatcaacaaaatgattataaactatgacacactatgatgggaaagaaggaggctgacagagaggacattggcaggaaggagccctactgtagatgtggtggtcagagaagggcctttgtgagaagctgacacataatctcacagttgaagttgtgagaaggagctggtcctccagagagaagtaggaagagcgctccagcagaatctctgggtgagacttggacatctgtgttgttgctctactttctgggtacatctgatgaaggaggagcccctgctgttggtctcatccacaaatacagtttaagctcttcatttccgtggttttgttcatgctgctcccttgccctagaattccttctcttctgcctccctttctctatctttcaagccatactcatcttctaagacccagttcaaatgccaccaccaagccactgtctctatgccaactcctctggccagatgcctgctctcctttaaagcccccactctaatgcttagcagttgtcatcccctaccctcttcttccatatgttttatctccactacttggtggcaatttcttaaaggtaaagactgtgttttatgtcttagcattgcttgaacaacctccacagtgaccttcacacattagaaatttagtaaaaattttctggatacatgaaaaatgaatgagtcatgattccaaggtagactatgtattcacatcatattcttgcaatctttcccttatttcctttgcagacaagtgcagctacgactgctgctgggaccgcgatactgtgatgagactttgcatatttaaaaggatgtcgagagaggaggaggaatgataaatgaactcaggaagatgtgatgtcttctgtgatgacactaatagatggaatgcagaattcagctccaatacttagggttggaaaccaaacataaacaagcaagcaaggaaaatgaaaaggaatgtgtgtgtgtgtgtgtgtgtgtgtgtgtgtgtgtgtgtgtaggtgtgagagtatatgaaatacatgaaaagataaaaagttagatgctgctaaagggacagacatgtaggaattttacattagggttgttctgattttcattttcttgccttttaaaatttaatgataaacaagtctccagagatttttacagcctgggagaccactggtaagacaacaatataggtggtcctccagcaggatctaaatcagagccttcatagtggactgtcgggccaggtgcagctgtagacaatgcatcttcaggagtggggtgaagaaatttaatggactagtaatgcaacaggaggtagaagaaaagtgttctctcactaaagcatggtgggtgttttcaaaatgtttaaaaaacatttttaggccgggcacagtggctcacacctgtaatctcagagcttggggtggctgaggacccaaaaggaggatcccttgatgccaggagttgtagaccagcctggtctaacatagcaataccctgtctctaaaaaaaaaaaaaaaaaaaaaaattaattagccaggcaggtgacaagtgcctgtagtcccagttactcaggaggataaggcaggaggatcgcttgaacccaagaatttgaggttgtggtaagctgtgatcgtgccattgcactccagcctgggtgacagagtaagacctcaattctttttttttttttttttttttttttgaggcagagccttgctctgttgcccaggctggagtgcagtggcgcgatctcggttcactgcaagctccgcctcccgggttcacgccattctcctgcctcagcctcctgagtagctgggactacaggcacccaccaccacgcccagctaatttttggtgtttctagtagagatggggtttcaccatgttagccaggatggtctcgatctcctgacctcgtgatgcacctgcctcggcctcccaaaatgctgggattacaggcgtgagccaccgcgcctggccagacctcaattctttaaaaaccaattgtgttatgcttttggttgctgggttcttagaaggaggttctcaaggtggcaagtcagagacattctgttctgtctgtcagaaatgcaaaataatggagcaaaattccaaagataaagtgaaaaatatggcaatcaggatagcaagagctgagtgaatggtgtgagtttgaggaggtgttttcgattaacttgttttaacattgagctgtaaaaagaagttaagatagggaaggatggggtgaaatattgcctggtctccaactgaaacacatgggcctgagatatggtgaagttttactaatgggatgaaaaagtggagtaggcctggtgtggaggagcacagcatcctgagcctcggaagtgattcaggttaaagggcctctaaggctacactctcagagccttggaagagctacctggcttgagctctactcatagctacttttctatcccctggttgtcagctcttcagccctttattcattcaaaaaatatttattgatggcctactaaatgacaggccctgggtgaacagctgtgaaaaaaaaatgggcaaatgtctctgccctcctgggattcatatactaaagggtcaagaatataagaatttattaaaagaacagtccatggaggaaaaaatgaagcacaagtataatggatctattgacctgtgtaatgaccccagatcaagaccctgatcaccccatttatttggtgcctgttattgtaatgtcttccgccatctgttattactacttaccacctctcctctgagacgtatggtccaagccacataccctcaaaaaaaaatctgtattgaagtataatttatgtaccataaggttcacctattttgagtgtataattcaatgatttttaataaatgtatagagttgtatggtcttatcattacaatccagacttagaacatttctgtcagcctgaaatgtttctttgtgcccatttgcaatcaattctgcttctactttcaaccccaggcaaccactgatctgttttccatatctatagattggccttttctggacattttatatcaatggaatcaaacagcataagttgcgcattcctaacccccaaatccaaaatggtcaaatttgaaaattttcaagcatgacatgacaccacaaatgaggaaagaaaagatgcctgacctccttacatatgcacaccacaagtggaaaatttcacacataacctcattcacatgatgagttgcagtcagtcaaaatgcaggcatgcaacacacagtttattcagccttctcaagacaaatagacccacccagcccccatcagctgcaatacatcttttctacccaatgcccagattcccccatgcaagcacactcacaaagggtaataaaaatgacacacgtgcaggccggatgtgccaatagcaggttccccatgatgccccatggggagccaagatggcatgtattactcattgtgtttttttgcttattctctgctctgtggtataaagatattgttgaaaatgtcaaaaaggtctgcatatgggtaatagtaataagaaaaagagaacacatttatgtttgtctgtagaacagatactgaacagcagtctaagtgtgaaatgtcttatggaagagtatggtgttggaatgatcaccatgtatgaaaataaggataaactgtggaatttttatgcttaaagtgatgagcagaatttgattaaaaataggaaaacactgcataaagcttaaaatgaagatctcgattgtgtattgaaggagtggatccatcagcgttgcagtgaacacatgccacttaatagtatgctgatggtgaagcaagcaaagatctatcagagtgaactgaaaatggaatggaactgtgaatattcaacaagctggttgcagaagtttaagaaaagacatggcactaaatttttaaagatttgtggtgatgaagtgtctgctgatcgtgaagcaatggaaaaatttattgacaaatttgccaaagtcatcactgattaaaatctgacaccataacaagtctataatgctgatgaaacattactcttttggtgttattgccccagaaagacactgactatgacttatgagatgacccctacaagaataattgaggatgccaagaacagaatagctactgggatgtgctaatgcagcaggcacatattggtatatacttgctgtgatagtcaaaagcttacatccttgctgttttcaagaagtgagtttcttaccagtccattattatgctaacaaagaggcatgtatcaccaggaatatcttttctgattggtttcaaaatattttgtaccagtagcttttgctcactctagggaagttggactggatgataactagaagcttttgttattccttgacaactgttctgctcatcctccagctgcaattctatcaaaatagtgtttatgccatggactttcccccaaatgtgacataattcattgatcatgtatccttaaatcaatgaaaagtaaatatacaaaacttttttttggaacagcatgctggcagcagtgaacagaggtgtaagtatggaagctttccaaaagaagttcaggatgaacgatgctgtgtgtgctgttgccaatgcttggaatccagtgactaaatacacagttgtatatttctggcacaacctctggcctgcaatgatgttcagtaatgatgatgaaccaggtggtgactttgaaggattccacctgtcaattgagaaaaaaaagatatttgacctccttacatacgcaaaaaatatatcttcagaggctgtcagtaagttggaagaagtagatattgaagatgttttaacattgataataagcctctggttgttcattcactgattgatggtgaaatagctgaaatggttctgaattgaggtgatggcgataataacgacaatgatgacattgttaacactgcacaaaaagtatctgtagaggacatggtgaaaatgtgtgatgggtttattgaaggactagggcagtgtggatttgcgatggaacaagaaatcatgtagtatataaaaagagagattgttaagacaaaaagcaacactgttgatgaggcagatgacttgaggaaacattttaaaaatctatccagcagaacgcctcctcattgctaggggacccattttctggtccttcaactgcttctgatgttttttctcaccttaaaaaaaaaaaaaaaccatacagagtacagtaaccttttagtcagaacacagcactgcaggtggagactgaaagcctgttgttcgttgctgctgttgtctgacagctgatacagggattctggtgatgctactgtgctgcttaattaccctgaacacatgtttttttaaggtattaaagataaataatattttttactgttaagtacttatgtgtgaataagtataggaacatgattgcttattggtagcatttacatttagagtcaggaaatgtggtgatgccaaacaaccacagattgtccatatgggtgggtggctgagatagtgacacttgtgctttctgatgattcaatgtacctttaagctatgtgtataaagtgtatatgaaacataaatgaatttcatgtttaaacttgggtcccacccccaagatatctcattttgtatatgcacatgttccaaaatctgaaaaaaaatctgaaatctgaaacacttctggttgcaggcattttggtttaaggatactcaacctgtatgtatgtttttgtaggtggcttctttcacctagaataatgttttgttttgttttgttttgacagggagtctcgctctgtcgcccagattggaatgcagtggtgcaatctcggctcactgcaacctccgcctcctgggttcaagcgattttcctgcctcagcctgctgagtagctgggattacaggtgcatgccacgatgccgggtttaattttttgtatttttagtagagacggtgtttcataatgttagccaggatggtcttgatctcctgaccttgtgatctaccagcctcagcctcccaaagtgctggaattacaggcgtgaaccactgcgcctggcctagaataatgtttttaaggtcaatctatgttgtagcatatatcaatagtttgctacgtttcattgtttcaatagtattcagttgcatggatatagtatattttatttattctttcattagttgatggacacctggattgttttcagtttggggatattatgaccattaatacataagtctttgtatggaaagaagtttgtatttctcttgtgtaaatatctacatgtggaattgctgggttgtatagtaaataagtgtttaactttatgagaagctgccacactattttccaaagtggctctaccattttccattcccacacgtatgagagttctaatttctccacatcttcaccaatactgattatcgtctgtcttttaattattgccactctagtaagagtgtagtagtatcttagtttgattttgaattttatttccgtaatgactagtgatgtgagcattttttcatgtgtttattagttatttctgtatttcatttggagaaatgtcttttcaacttttttggccattcttttgtttttgttgttgttttttgtttgtttatttttgtttgtttgttttttgagacagggtcactctgttgcccaggctggagtgcagtgttgcgatcatagctcactgaaccttgaactcctgggctcaaacaatctctcgcctcaatctcctgagtcactaggactacaggtgcctgccaccatgcccggtaattaaaaaagatttttttttgagatagggtcttgttatgttgtctaggctggtctcaaacttcaggactcaagtgatcctcccaccttagcctcccaaagcactggcattacaggcatgagccaccatgagcatgagccaccaaccttttggccattttcaaattaggctgcttgtcttcttgttattgagttatattagttatttatgtattccggatacaaattcctttatcagatgtatgattcataaacttttctcccagtttttgccttgccctttcattgtctaatgattttttagaagagcaaaaacgttaattttgtttaagttttttcttttgtggattatgcttttgttgtcatatctaagaattctttgcctaatcaatgtcactatttttcccctgttttcttctaaaagttttataattttacttagacattaagtcaatgatccattttgagttaatttttgtgtatactatgaggtgtctatgttcttttttctttatgttttgtacatgtatatccaactgtctcacaaacattagttgaaaacactgtcctttcccgaattgaattgccttacacttgtcaaaaatcaactgaccataaatggaagaatttatttctggactctcaattctattctattgatctatgtacctatcctgtgccaatactatattgtctcgattattgtacctttattataacttcgaaattggggagtgtaagttctccagctttgttcttttttcaagattattacagctattctaggttctttgcattttcatacgcattttagaatgagcttatcaatgtctaccaaagaaattgctctgctagaaattttatagggattgtgttgaatctatacttcattctggggagaattgctatcttaaaaagattgaatctccaatttatgaacatgaaatataactccatgtatttagcaatgttttatagttttcattgtataaatcttgtccttgcatttcttttgttaaattgatttctaagtattttattcttttgatgctatgaaatattcttaatttccttttttggttgtttctttgctaaaacgattgacccttgaacaacacaagggattaggggtgccaactcctgtaaattcaaaaattggcacataacttttgactcccttaaaacataactactaacagctcactgttgactagagccttactgacataaacagttgattaacacatattttatgttatatgtgttagatactgtattcttgaaagtaagctagggaaaataaaatgttactaagaaaataaaaaggaagagaaaaatgtatttactattcattaagcaagtgaatcatcttaaaagtctttatccttgtcattttcatgagtatgctgaggaggaataggaagaggaggagttggtctcactgtctcaggggtggcagagacagaagaaaacccacgtctaagtggaccctcatagaaatctgtgttattcaaggatcaacagtacatgaaatacaactgacttttgtagattggtcctgtatcctgcagacttgctaaatttattagtgctaatagattttttaaatgtgtggatttattaggatttcttttttacatacaagattatgttgtctgtgaataaaggcagttttacttcttccatccaattagaataacttaaattttttttcttgccttattaaactggctgaaactttggtaaaatgtttagtaaaaggaacaagagtagagaacattgcctaattcccaattttagcaaagaaaacactgaatcttttattattaagtatggtatttgctatagtttgtttatagattccctttaccaagttaaagaagttcccttgtattcctattttgttgatagtttttattactgatgggtgctggatttttaaaatgctttttctacatctattgagatgattacatgggttttcttaattccatcaatatggtatattacactattgatttttgaatactaaacaacttgaattctttgcataaattccacttagtgatggcatagaattctctttatatctttctagatccagcttcttaaaattttaaggatttttgcatttatgttcacaatggatatcagtttgtggttttcttttcttgagatgtctttgtttgacttttgtatcagggtaatactgggttcatataatgtatttggaagtgtttccctttactcttttctaaaagtgtgaagtattagaattatttattttttaaatatatgttagaattcaccattgaagtcatttggagtatttctttgtggaaagattttaaattaccagttcaatgtctttgcttgctatagatctattgatattttccaacttctcttgagtcagtttaggtaatttgtgtctttctataaatgtgttcgtttcacgtaaactgtccaatttgttggtacaaagttgttcataatattcacctataatcctttaattttaaggttggtagtgattgccccactttttttcctgatattggtaatttgtgtcttcttttgttttttgatcagtctagctaaagatttgtcaattttgttatttttttcaaggaatcaccttttcgtttcatagatttttctctattatttttcttttttctatgtcattgttttcttttttaaaaaattttattattattatactttaagttttagggtacatgtgcacaatgtgcaggtttgttacatatgtatacatgtgccatgttggtgtgctgcacccattaactcgtcatttagcattaggtatatctcctaatgctatccctcccccctcctcccaccccacaactgtccccggagtgtgatgttccccttcctgtgtccatgtgttctcattgttcaattcccacctatgaatgagaacatgcagtgtttggttttttgtccttgcgatagtttgctgagaatgatgatttccagtttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcaataaacttacgtgtgcatgtgtctttatagcagcatgatttataatcctttgggtatatacccagtaatgggattgctgggtcaaatggtatttctagttctagttcccttaggattcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatggggttatttgattttttcttgtaaatttgtttgcgttcattgtagattctggatattaaccctttgtcagatgagtaggttgcgaaaattttctcccattttgtagattgcctgttcactctgatggtagtttcttttgctgtgcagaagctctttagtttaattagatcccatttgtcagttttggcttttgttgccattgcttttggtgttttagacatgaagtccttgcccatgcctatgccctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatccttaccccattgcttgtttttgtcaggtttgtcaaagatcatatggttgtagatatgcagcattatttctgagggctctgttctgttccattgatctatatctctgttttggtaccagtaccatgctgttttggttactgtagccttgtagtatagtttgaagtcaggtagcgtgatgcctctggctttgttcttttggcttaggattaacttggtgatgcgggctcttttttggttccatatgaactttaaagtagttttttccaattctgtgaagaaagtcattggtagcttgatggggatggcattgaatctataaattaccttgggcagtatggccattttcacgacattgattcttcctacacacgagcatggaatgttcttccatttgtttgtatcctcttttatttcattgagcagtggtttgtagttctccttgaagatgtccttcatgtcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagttgcttatcagcttaaggagattttgggctgagacgatggggttttctagatatacaatcatatcatctgcaaacagggacaatttgacttcctcttttcctaattgaataccctttatttccttctccttcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttactgagagtttttagcatgaagggttgttgaattttgtcaaaggccttttctgcatctattgagataatcatgtggtttctgtctttggttctgtttatatgctagattacatttattgatttgcatatgttgaaccagccttgcatcccagggatgaagcccacttgatcatggtggataagctttttgatgtgctgctggattcggtttgccagtattttattgaggatttttgcattaatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtagctctcgtacaattcggctgtgaatccatctggtcctggactttttttggttggtaagctattgattattgcctcaatttcagagcccgttattggtctattcagagactcaacttcttcctggtttagtcttaggagggtgtaggtgtcgaggaatttatccatttcttctagattttctagtttatttgcgtagaggtgtttgtagttttctctgatggtagtttgtatttctgtgggatcagtggtggtatcctctttatcattttttattgcatctatttgattcttctctcttttcttctttattagtcttgctagcggtctatcaattttgttgatcttttcaaaaaaccagctcctggattcattaattttttgaagtgttttttgtgtctcgatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctgtacacactgctttgaatgtgtcccagagattctggtatgttttgtctttgttctcattggtttcaaagaacatctttatttctgccttcatttcgttatgtacccagtagtcattcaggagcaggttgttcagtttccatgtagttgagcggttttgagtgagtttcttattcctgagttctagtttgattgcactgtggtctgagagacagtttgttataatttctgttcttttacatttgctgaggagtgctttacttccaactatgtggtcaattttggaataggtgtggtgtggtgctgaaaaaaatgtatattctgttgatatggggtggagagttctgtagatgtctattaggtccacttggtgcagagctgagttcaattcctgggtatccttgttaactttctgtctcgttgatctgtctaatgttgacagtggggtgttaaagtctcccattattattgtgtgggagtctaagtctctttgtaggtcactgaggacttgctttatgaatctgggtgctcctgtattgggtgctgatatatttaggatagttacctcttcttgttgaattgatccctttaccattaggtaatggccttctttttcgcttttgatctttgttggtttaaagtctgttttatcagggactagcattgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaaattaatattgttatgtgtgaatttggtcctgtcattatgatgttagctggttattttgctcgttagttgatgcagtttcttcttagccttgatggtctttacattttggcatgtttttgcagtggttggtaccggttgttcctttccatgtttagttcttccttcaggagctcttttagggcaggcctggtggtgacaaaaatctctcagcatttgcttgtctgtaaagtattttatttctccttcacttatgaagcttagtttggctggatatgaagttctgggttgaaaattcttttctttaagaatgttgaatattggcccccactctcttctggcttgtggagtttcttctgagagatccgctgttagtctgatgggcttccctttgtgggtaacccgacctttctctctcgctgcccttaacattttttccttcaactttggtgaatctgacaattatgtgtcttggagttgctcttctcaaggagtatctttgtagcattctctgtatttcctgaatttgaatgttgacctgccttgctagattggggaagttctcctggataatatcctgcagagtgttttccaacttggttccattctccccgtcactttcaggtacaccaatcagatgtagatttggtcttttcatatagtcccatatttcttggaggctttgttcgtttctttttattcttttttctctaaacttcccttctcgcttcatttcattcatttcatcttccatcactgataccctttctttcagttgatcacatcagctcctgaggcttctgcattcttcacatagttctcgagccttggctttcagctccatcagctcctttaaggacctctctgcattggttattctaggtatccattcatctaatttttttgcaaggtttttaacttctttgccattggtttgaatttcctcctgtagctcagagtagtttgatcgtctgaagccttcttctctcaactcatcaaagtcattctccgtccagctttgttccgttgctggtcaggagctgtgttcctttggaggaggagaggcgctctggtttttagagtttcctgtttttcttttctgttttttccccatctttgtggttttatctacttttggtctttgatgatggcgacgtacagatgggtttttggtgtggatgtcctttctgtttgttagttttccttctaatagacaggaccctcagctgcaggtctgttggagtttgctagaggtccactccagacgctgtttgcctgggtatcagcagcagtggctgcagaacagcggtggctctagaacggcggtgggtgtagaacagtgaatattggtgatccgcaaatgctgctgcctgattgttcctctggaagttttgtctcagaggagtacctggccgtgtgaggtgtcagtctgcccctactgggtggtgcctcccagttaggctgctcatgggtcagggacccacttgaggaggcagtctgtctgttatcagatctccagctgcgtgctgggagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttccaggctgctttgtttacctaatcaagcctgggcaatgggcaatggcaggcgcccctcccctagcctcactgctgccttgcagtttgatttcagactgctgtgctagcaatcagcgagactccctgggcataggaccttccgagccaggtgcaggatataatctcctggtgtgcctttttttaagtccgttggaaaaatgcagtattagggtgggagtgacctgattttccaggtgccgtctgtcacccctttctttgactaggaaagggaactccctgtccccttgcacttcccgagtgaggcaatgcctccccctgcttcggctcacacccggtgtgctgcacccactgtcctgcacccactatctggcactccctagtgagatgaacccggcacctcgggtggaaatgcagaaatcacctgtcttctgtgtctctcaagctgggagctgtagaccagagctgttcctattcggccatcttggctccacctctatctcattgttttctagttttgtctttattacttcctttcttctgcttgctttgggtttagttagcttctctatttctagtttcctatagtgggtgtttaggttattgatttaatatctctcttctgtcctaatgtaggcatgtataactctatatttcctgaactttaatcactgctgtagctgtatcctacaatttttcatatgttgagtgtttttgtttagctcaaaaatttaaaaattttcctaccgttttatttgacaaacagtttagatagaagtgttttaatttttaagtattttgtgattccttaaacttccttctgtttttgtctaatttaattgcattgtttttgaagaacatacttttgattatttcaaaccttcaaaatttactgaaacttgtttttatggcctagcatatggtctattctggagaatgttctatgtatgcttgaaagaatgtctattctggtgtccttgagtggaatgtttcataaatatcagtgaggtcaagtggtaagtttaagtcttctatatccttgctgcttttctgtctagttgttctatcaattattgagagtggagtataaaaatctccatccaccatttttgagcactgtcatttcttgctcgggttattgaaatagcttggcactccttatccaccatgcctactttactttttcccataggatttatcttcacctgacttagtatatattttatttatattctagaatataaaggtcccatgctgtcaggcagtttttatcactgatgtatgcctggcaccaagaacagtacctgacacatacttgtcactcaaaaatataatatttttttaatgtatgcattcatcaccaaacaaatggcaccttctagtttctcgggtgagtgtgagactcctcatcccactatctggaataatctgaagtgggtcaataccagtggaatcctgagaaattcagggcaaagggtgggagatataagggggtaactactgctactgcttttggccacagggagaaactttccctttctccttgtgttttttgtttgaatttatctctccttgaatttttattttattttattttatttttgtctcaacctcatgggctcaagctatcctcccatctcagcctcttgagtagctgaggctacaggcatgcaccaccttgcccagctaacctttttcttttcctttttttttctttttttaaatttttttttctttttttcctttttcttattttttttttaagagatggggtctaactctgttgcccagtctggtcttgagctcctggacccaagtgatcctcccacctcagcctcccaaagtgctgggattagaggcatgtgccaccacacctggcctccttgctctttgcattttctagttatcaaagtggtaggcacttcaagaccagaactggatataggtatcaaggaaatatgccactgtgcttgattttgatccagactatttggctgccttctccaggcaaaggcatcaggtgaccctgtacatcttagtaggtattaaatcacaagtggggaaggaaaagatgggttaaaacttcagaacaatacacaaaaatgttttcccctgcatctgtactttttcctcctgaatctgagacaagtttccataggtgactggttcaggattaggtgctcaggaccccggccaagtattgttccattttagcatgattgacactatctgcttagatacatgtcttggtgtagctttgaaatttaatgcatatcctgctttggagggctgtaatatacaacaacttcagaaaaaaccagcatgcactatttattattgagtgcttggcatatgatagcaagatacttttcatgtatctggcatatcagttactttacataatctatatgcttaatcaattaaaaatgaaagaaaagattaactgatatttttcttttacttatgaaaattaggcctaagttttacaaacttttctcatatggtctgtataaccaactggaactcagggaagaggtctgggctggagaaaacagtttgggcaccatgaataaatctatggtcattaaagctgggagatgggtcacgccttctacagaatgagaaggggaaagcatctggataaaactttgaggaacagtgatgtttaatgagtagaagatgatgagcctgaaaaggcagagaaggagcacacagaaaggtaggaggaaaatgaggagaatattgtatccaggaaggtatgcatcatctttctgaaaacttgcaattgtccttgctttgggggagtctcgctactggtaaagcacttatcatttaataataaattctcattacgtgaatgatcctgcaattgttcttgactcaaatagttctcatgcagagatacttataacacttggtaacatgaagacttttgtgttaataagactctgtgctgggtgcagtggctcacacctgtaattccagcactttgggaggctgaggtgggggaacaccttaaggccagaagttcaagaccagcatgggcaacacagctagaccctgtctctataaaattagccaggcatggtggtgtctgcttgtagtcccagctacctgggaggctgagatgggaggatcgtttgagcacaggagtttgaagctgcagtgagctatgatcacaccactgcactacagcctaggtgacggagcaagacactgtctaagagaaagaaagaaagaaaagaaaagaaagaaagaaagaaagaaagaaagagagagaaaggaaggaaggaaggaaaagaaagatgctgtattttcatcaaaataatttcactccagagctgggcatggtggctcgcacctataatcccagctactcaggaggctgaggtaagaggattgcttgaggccaggagttcaagaccagcctgggaaacataggacgacctcatctctaaaaaagttttttaaaaattagccagacatgatggtgtctacctgtagtcccagctactcaggaggctgaggcaagaggatggcttgagtccaggagttcaagactacagtgagctatgatcatgccactgccctccagcctgggtggcagactcaatctctttaaaaaattactttacctcaatccttgtgcaccctgcaagtatgatatactctctcaatgactccagaatccatccgtgaccttttggcattctagcggtaatttgaataacgtcagtgaaacatggcaatagcactgtacaaataaattgaatttattattacggctctcccatgatgaaattatttatttttgtgtttaattttttcattttaagaaagaaaagtctttctgttacccaggctggagtgtagtggaataatcatagctcactgaagccctcaactcctgggctcaagtgatcctcccacctcaacctactgagtagctgcgactacaggtgcacgctaccatgcctggctcatttaaacaatgtttctgtagagatgaggtctcacttcgccgcccaggctgcgaactcctggcctcaagccatcctctagcactggcttcccaaagtgctgggattacaagcatgagccaccatgcccagccagtcttcaatatttgtggcagtaaataaccaatgaatttttattttaatgctttagtctcaataacaaatttatttgtaagagtgctattttatatgatttatacattcactcattcatccatcaaacatatattaagtacctactgtatgccagacatataatgttaagatgcatgaggcatggttctcaagtttaggtgtgcactgaaatcatatggcaaacttgctaaaaatacttatgaccccatcccactttttgtattcagtagatccagggtgggtttcagaaatctatttatagcaagctttccatgtgattctgatgcacaacaagatcttggaactattgctctacataaaaacatttagtgaaaaaataaaatgtaataaagtataagaggtgtcagaagtatacacagggtagagtatatattacattttataacatttgtctcttactatagtagtagactatgcactcaacaatattattgcaatttttgactgtaatagaatattttattagggttttgaagccctagcagtataatttactttcattatactgcagacatttttaatgtccttaaaaatgatcataaaggtaagaggatgctataaaaattcaaatgttattatatctatgcttataacttactttagtaagactgagaaaagcatctggtggttcctacttaaaactctggaaagctttactgtgtcattataggagtagttgtcttataaatgaaagtgttcttttctctcttttttctttgtctgcaaggctcttttgcagcctgttgatacaaagcttcaaacagcattcgaggaatattcatagcagtttcctactaagacttcagcaatgatgcaaaatgcaaaactcttgagtcttgcattgtgggaaacaagctttcttttaaaaaattattgctttcttcttaaaaggagatactcgttcaccatggcattgacaaggaaacttaggctgtaagaaacagatcaaccaaagtcccattgtagggaagctatgatatgctttgattataagactttacaagaagagatgtctatagatagaagcaactatttagcaagtccaactcaaagaccgagtgaaaacagcaacggaaatgtgaaaaaagttctggaatttcttcaaaatgtcttttcaaaatgtcacttgctttcgaattaacacttcaggaagtgtatcgaagagtactagcttatccaaattgctgtttctcctctccttcttgggcacatacagaaaggaaacttcccagcctcctttgtgtcacttgtggtcatgtgactaagtgctagccaatggaatatgagtagaagcgatgtctgccacttctagatttgacctaaaaaatcttcccgctgtggttctcaatgtgccttctccatttgctactgcatgatgactcccaggcaacctggaagccacaggttgaaatggcagggcctctgtcagcctgggtctttgaataactgtatagagcagagacaccgcaccccgtctcctccccatcccagtgccaatagactttgcttgagagagaaataaacttttactctgttgagcgtctgaaatgctggggtgtttttttttgtaaagcagttagctaactttaatacaagatgtaagaatctaggcaaatctataccatgagaccatgcactgacctgtcatttatgaagccagagccctgaacatagttctgtaattctcctgcagaggttgcctataccacaatcccctactgaaaagctgtctagaaaggattcctctgactccaggagcaggactcaggctgtcaagagtattctagttctccacgaatggtttaaaagccaaagtttggccgggcatggtgactcacgcctgcaatcccagcactttgggaggctaaggtgggcagataacttgaggccaggagtttgagactagcctgaccaacatgtcgaaatcccgtctctactgaaaatacaaaaattagctgggtgtggcggcacatacctgtagccccagctactcgggaggctgaggcacgagaatcacttgaacccaggaggtggaggttgcagtgagccgagattgcactactgcactccagtctggggaacaaagtgagactctgtctcaaaataaataaataaataaataaaataaaataaaagccaacatttctcttagcctttagggcatggtcctagcactgtacaaagcataaaataaacactcagaaattctaactcaagaatctggagagaacaaaattggatagaaggaagccagaggcatagctgcaaaggagcatgacatgtaacacggacagagtcacagcataaggccaccttctaggccctgcactgtgtacttgccacagactggcagactgtcattaaggtttaagagagaattctctaggtctttaagatgtttatccaaattattcctctcagccttaaaatccttcagtcattttggatacctctctctctcctttctttggatacctctctctctcctttctagtccattaagtaaaatagctcctacccatgcaatagttattctgatcaggcactgtgcatggctttacatatgttgtgttatataatcttcacattaagtacataatattattatccctattctgcagatgaaaaaactgaggcaccaaaaagttaagtagcttgaccaagctcatacagctagtgaggggaaaacccagagctgaaatctaagcacttggactccctgccaaatcatctgcccttaaccattgtactatactgtttccagcagtaaaattcagcagatttttgctcatgtaagagacctctcaggagagggttgatccttcaaaagggccaatagatagaatccagttcattggcccttcatatttgcatcctttttgttttttattttgtccctcgtgggatttgggaagctctcagcatgatgctggtgttcacccttggaggtacctcccttctctaaatcttagcagttccctagcatggtgagatcctggggctgctgccacaatcctctggaaaagaaaagcttgaagagaagcttcttggctccagtagattcttaatgctgaggagaagagctgttctgtggggccaatctgtcactgcatctatatttagcgccatctgccaggaatatttcaaactgcctattttagcacatgctgtttcgtgcaaatgcgactgctccaccactagttcgtgggaaaccaagggcactaagtggattttctgtttttttatgttaagtgttgcaagttggcccttcagtcaaccttcaaatgagatatgggagagaagggaggtggagttttcccagggtgttagtcccaggagcccacacattcagctgctcaaaagtaacccaaggatggcagctgtagaggaggcggaggtggctctgggggttcagggggaagggcaagggaatataaaagcccaggactcctatccagcagccccaaggcaaagtgatggccttatccacttcagtgttctccactccaactccgagatcattgtccagactcttgcagccttaacatacccccaggagagccttcttgacccatctcagtgaaaaacaagggctcccatttactgaggactttccttgtgccaattttcagtgcttgctttgatatgcatatttgtttctggcatacaacctctttatgggggaggctctattactagttctactcacagataaggcaattgagtcttagtgagggtcaggaacttgcccaagggcacattgcttgtaagtggtggagtcagaattcaaacccagccccagctaagaccaggtcttatgatcttaaacactgtgtactgaccaattctatacatcctcccatccagtatccctgttttcttcccccaggtataggcacacactatattttttgcatatatttcaatttccaacttattctccagacttgatggttaactgcatttgaagagctctgaccataggtttgctatccagcccccagtcagcaatgatgctaactccctaagaagccctcctagattggccccagcaatagcccagtgagggagagtggcttctaggtttgccccaactcttgaggaagaactggtgggtaggaacaaccaagcagccttatgacaggttgttatagctgcagaggtgagtttgactggaaaggtacagattctggctttatagatggtaaggactgcctggaaaaggaattgccaccagggactggcatggggctgggctgagaagactgacagtggagtggggctcaataacacagctgtcctgtatgacttattaatcttaagagcgactgactctaggcaaattctaaattgtgatcataggaaaatctcaaaatatatacatattttttatagacacaattcccaaggataaccaattttcattaaatcaccctgggataaaggctagaagagatggctccatgtttgctatggtttgggaaatttggaactgagtccttgggctgtccagggactgaagaatatgagtggcatagaatagaggctagatgttagatcttttaatagccaacttcatatcccatctgtttcagttatttattcctgcataacaagccacacttaaacttagtggtttaaaacaaaagcaatcactgtattatcatctctggggttgaggggttgactggcctcagctaggtggttctcactggggtttctcctgaattacagtcagataatgcatgggcttgaagccatctcaaagacctcctcacatacattaaaataggtgctggctgtcagctgggacctcagcttggctgtctgtcaggacacctacatacggtctctccatatggcctggacttccctgcagcatgggagctgcattcccagagggagagacctgagaaaatgcggcaaatgctatatagccttttgtgatctacccttagaagttacatagtgtcacagcacagtcacaccgtcacaggtcagcacccacgcaagagggcacaccgatattcttcttaagtggaaaggcattaacattaatttgtaagaaggtcatgtggtatgggatataagattgtggtgatcatctttgaaaaatgcaatctgccataccaattacatagggccaggggaagaacctggatttggtgaacaaattggggtggcaaagtagctggcatttgaatacaagaggggtggccaggcagcagaggaccaagactccacgcacatccttcatagtttcaactaatgcttactgggtacttaacatttgccagaaattggggctgtaatagcagtgagcaagagacaaggtgcctgccttcatgcacgttacagtctggtggggagacagcaaacaatggctcaaataaacacagaagctccataaagaaatataacagttgggtaaggggagtgacactattagggagaggggtttctattttagataaagtgcttagggaagaccttgctgaaatgggaacatttaagcagagacctgaatgaggtgagggagcgaaacaagcaaacctctggaagaagggcattccaggctgagggaagagcaggaacagtctcagggataagcttggcatgttcaaaaaataacaagaagcccagtgtggcaagtgaggaaggactgagtggaagaaggataggaaatgacgacgagaagttaccaagagtagttaatgcttaactgggggcaaaatccatttcaaaacattgcttctgttgatatttgttttcctggtcttaggatggaagaacaactcctcctcttccaaatgtaaatgactatgtttccatttggggcagagctgactgaatacagatttcagaaggcatctctgacacgcatgtagaggcatctggccaccttggggtaccttcccaccatgtaccacagtcaatctggtctttgtcagggcatctttctcttcagaaagtaactatgacaacggagttggatgctgcgagtctgcggcagccctctatttgcacacaacatgtgatgctatcagaacacagaattatgaatcagtgcagtgtcagcttttctctttgtagtgaacaagttatctgctctttgattcaattaatgttttattattggttttgtttttattatgactgttccataacaagatgatcaatatgttctatagcgtcgtttcccagacacatctgagcagagccccgtatcagttttctattgctgctgcaacaaattactgcaaacataacagctaaattacacaaatttatcttacagttctggaggtcagaagtttgatacgggtctcactaggctaaaatcaaggtattcacagggctgtgttcctttcttgaggctcaaagagaaggatcggcttcctttgtagttcaggttgttgggagaattcagttccttgccattacaggactgagggctccattccctgctggctgtcagctgagggccctctccagcttctggaggctgcccacattccttggctcacagccccttcctccatcagcaaagctagcaatagcgggtcaaatccctctcatattttgaatctctcctccttctgtcttatctccctctgaccacaaccaggaaagattttcagcttttaaggacttatgtgtttagattgggcccacctggataatccaggatactctccccttctcaaaggttcctaacctgagtcacctcggcaaagtcgcttttaccatgtaagtgaacattgtcatgggtttcagagattacatgtggactttggtggcaggtgaattattctgtctacagcaacccttatttcctgactacattaaactacagtttaatggaatacagtttgggaagcactgcccgagaggtatcaattctagacaggtaagaaactaattctttatgggtaatgacccaagcatgggtgagcacagggccaggtggaggatggattcctccatgtggttcgggagtggggtgcaggaaataaggataaagcataatggagttcagtgacagatttcaccttcttgccaagccacaagtataaatcaggtagatttcctaattgggcttgtctgtcaagaacttctaattgtagtgcctgaagggaaaggggtggacaactatggcactaggtgattttcacagtcatctcatataagggtcatgctaacttgtgaaggcaaaccctgcacttgaacctcagtgtggtgggttcatttggtgtcccactcagatcccctttatcaggctggtgtgctcatcctacagggtggtaagctgacagctcacagattctcccttctctggaaattatccttaaagcccttgggagctgccttagctaggaagttatccccccaatcaccccttacctccaacatacacacatacatacatacacactccacagaaagtctgtgacatcatttatgctccaaagtcctctggggatcacatttgagaacacattcttgtttcactcttcccccttcaatttcctgcttcccctcctccattacaagtttttcttgactaaatcaatacatctcgtgtcctcaaaaccctgcctcaggttctgcttccaaagaaccaacgtaacttgccacggctccctaattccaaagaccttgctctttgtagctacctagcctagaatcagacaagcactaagaaaaagactggagaaaatatccctgacacacctgggacatgctgtcttctagatatgtcactgaataaatcaaaggaagtttgtttatttgcaaaagttgggtgggagttcggtgtatgattctaaagacttaggttgtggaaaagaacaggaagtgagagttgagagttaaagttgaatacaatggtccactccactataagctccttggggacaggagccatgtccatgttgttctctactgcatccctgtgcttagcacaacagctggcacgtggtacctctgcaacttgtggaataagtaggtgaaaaaagtagagaaaagcaatagggggtcaggtttctgtgagtcaggaggttcaactgggagaaagctggggaaacagagtctgttctcgatagtacaggctgctttgcactcttccaagatcttctgtgatagcctcacttctggaatgtttccaggaatcggctcatgtaggccctcctctggaaaatggcagcatttctaataagcctttctccttctacacacgggaaagaatccagcagccttgtcctaaaccaagaacatatcttgcctgttagaggtctagtggatccctagattagacttacattatttttatttattaacaggttatttaaatttgtacagtataaaaccaggtattagctcattttactttagtgtttatatacaactaacatatttatgttttaaataccaaaaagtcacaaaaccggtaaaattgtaattaataacattcatgaaaggtgacctaatattgtttttgtaaaatgaaatctctaccacatgtagtgtggtactgactctccaagcccatgcgcttttgaaattagcccgttcatattaccgtgtacctgatgcaaacatcttctctgatctctcaatttctctctattcaaacgacttctaaaccttcctttgtataaaatggaccctgctgtgcaaacgcatttttgtgttaagtccacctttttcattcctcactagctttgaaaataaatagctttacttagcattaatttattacacattgtgttatacatgtaaatacatagaggcttaaatcatgcagtgcctggattataaattggacattcagataacttagaatatgtaaacttgtaagtacatatatgttatatttatatgtatggatatacagttgacccttgaacaacttgggtgttacgggcaccaacccacatgcagtggaaaatctgcctataacttttgattcccccagatcttaacgactaatagactactgttgaccaaaagccttactgataacataaacagccaataaacacatattttgtaagttgtatatattatatactgtattcttacaataaagtaagctagagaaaagaagatgtttataagaaaatcataaagaagagaaaatatatttactattcattgagtagaagtggatcatcataaaggtcttcatccttgtcatcttctaactgagtaggctgaggaagagaaggaaaggaggggttggtcttgctgtctgaggggtggtcgaggcagaagaaaatatatatataaataaatctgcacagttcaaatccatgtggttcaagggtcaactgtgtatgcatctatgtagatgagataatcatcaaagtctagttttaaaatgaaaaattacatcattcttttagaaaactcctggaaccttgaggaacactgctttaggcataccctggtctagaatgccacctgtctatacagttctccctcagtatctgaagtggatcagctccaggacccccacagatgccaaattccacagatgctcaagtcccttacataaaatggcatagtatttgcatataacctacacatatcttcttgtatacttcaaataatctctagattacttataatccctaatagaatgtaaatgctatgcaaatagttgttatactgcattatttttagttgtacctttttctattgttgtattgctatttaaatgttttcaaatattttccaattttccaagattggctgaatctgcacatgtggaaacagcacaggcaaaggctgacagtatgcagctttatttctctttctgtcatgcccatgcattcagtcaaaaattaaaattatttctctttacctctccacttgcatattcaaccattatacatagttgttcatctattttagaacaaccagccacatttattgcatgcctatcatacctacatcttgatttcacaagaacactgcaaaatagtattattaatattaatatgttatggtttacattttaaaaatgagaaatctggagatcagcgtgttcaggggacttgcccaagaacacgctcatgtcaaaggctgggctttgactcaattctgtctgatcttagatcccataattgtgccctttgctatagccccaaggtactgaaaggtgcatcgcacatagtgggtgctcaataaacattttttgaatgaatatgagaacaatgaactgtttccattccatcagtctgcctgtactcccagcctgttggcactgtttcctctctaggcatgcaaagcctaggggagtacaaactaaggtttgactcaccctggtatcccacagcatgcctggccacatagtaggttctcaaatactcattaatttgaattgacttgaactcctcccaagaccccgcttggaaacttttttgaaggttaatttagaatgagaaaagagaacttgaggaagagagtgtgctagtgatgatacaagcccccagctagccttggtaactggaatgggaagcattggccacctcctcctgagactgggctccaagccctgcttggtaatgcaggcaaaagcatgtgattcagacagcagcaaagccacagaacggcacgccaagttcaaagtcattgaagcaagtagtgtaagtgacaaaatttaaaagacagagacctctgtagaagaagccagggtacccagaattgacagcattgaaagctgggcttaggtggaaatgacaagaatctctgccctacccctagcaggaggtcctcggtgagtagcttataaaatgcccttctaagtccctaaaggagcccactgctggatcagccaaggctgggaaggtcctcgtgatcatgattgaggttctcacagtcttcctgccaaggctgctcttcggggcagacaaaatgtaccgggagctccgcgggtcatttgtgtttacattttttccctctttactgctcttgatgttcactcttccaaaattatcaagctctcactctagcctagttcaacagaaacatttctctacttccagactgtttagagcttcctctccagccagcaaaaggcccagcccattactggtgcacaggggcactgaccagcagcagcttggcttgtcctgtttgacggggcttggcctcattgcccttctgaaggaggcccaaatgcccatgtctattccatccccagatgccagcgaaattgcaaggtgttttcagtgacagggcaccttgcaaaagtgggagcatctttgcatacatcacctgaaatggggtcaaggaagaaaagattcatgcaagacccatcagggacagacactggtacccagtggatatcagctcatagcaattctgtgtgcactttgcagatcaggaaactgaggttctcctgagacacagagttgaaaatcagggggtcagttccccaaggtcccagcttcctcatcctttacactcaaatacattgcaagggcatctctctcactgaccccacctctcagaagggaatttgttctctcctttttcctcctccctcaaccactgattcaggaagaaactaataaactcatgatttgtaaagttttgttcctcagctcttctcagatacgcttcagttgaaaacacagtgttcattcattccagatttcccaagacacttccaatttcatgcaatgttataattgtaataaattcatttacttcaatttgtgacgaagtataatttcatttcatatcattttaaggtattgcatgtacacaaattcagaaactggaaagaatatgttttgttaaatgccatgccctgatttttgaattggaaaatataaaatgtgttccatctctgctgtgcatgcacatagcataacatgatcacaggaaattcttcaccttagttcttctttggtctggcttttttttttttttttttttgagaggaggttctctgttccaggcatagggagaactgttgtatatccctcattgcaggcacagccccggaatcttccagccctttcgccaaacagattcttcaccatgtggtctcagtttccctgcccgaaaaagtcaagatatgtttctcaatcttgtagcaacagctgctcccaccccaaggattcccctactcaaacccgagtgaagaatgaagctggtttctgttttaggaaccaaacaaagtcctgcccctcctcaggggcccccctttggactggctcccttccctctgtttggatagcccactctttccaaaccactgagtcatttcctctccgggactttctcattaaaatcttcctgtttgctatagttctggagcccctctctgagttaccgtttccttcctcatccccactgagctgattaattaatagcccagcaccgccctgcaatctctcccactgcggcgttccttcccactctcatgtcggctggaatctctacacttcgtacacatttgtacaaagcctcggagttcctaaagctgtgaggggaatggaggataccactcctctccggcaaggtattgcttgaaagataaattgggaagatgagtgcctagaaacgggcagcagagaaaaaaaacctaccaacagcttgtcccagagccgccaggcacagcaagtgcagcagttgggatacaggctctaattaatgcgctaggagctgctcgaccctgagcagccccttcctctcccagaagacagctgcggtctcctcgaagccccggtttggagggttgtgtgcacatctgagacctgctgaccctgacaacaggcaacagattgcagcaccaaggcagaactccatgggacagaaagacagaagacaccggggctctttcgttcagtgacggcgtgaagaggactgtcacagtcaacatggcaccttcattcttctattgggcttttttttttttttggcggggtcggggaggcagttctctgttcccggcacacagagaactgttgtatctttctcattgcaggcacagctccagaatattccagccccttctctaaatagattcttgatcaaatgaaacatcctgggctgaactgagggcagtgccatttttgcccagtgggtatttggtaaatgttcatggaagcaagtcaaactgaagttcaaaaagtacatgatttgcattcgttgaagtacaaaaaaaggtacataacaatagagatggactgcaaactcatccactgactcaacaccttccattatctattcatgttatcccattgcttctcattgtgaaaagcccccgggagatagtttgggggtgacgggtcattggctgtcccttaaatcccatcatgttggcaatccccttccccagtaacgtatgaggttcacatgatctcagagctgcacgtatggctctacagtaatccccatagcagcacattccacttggaaaagttgctttcaaagtgtacttataattgctaatcatcactgtagtctggcagcttccatggaagcgtgactggcatgttctggggctggccccttgccctctgattcacaggacacctgtctcagtcctccccaaaccccatcctgcttcctctgctctccacctcattcccacctctgcacaagcctggatcctgtggcacaagtgatccttccttctcctcctagatttccaaatctctccattccctgggacttactgcaaattgctaaactcttctccatttccaaataacttgttcctcctcgtgcttcccagggtcctccttttcatttcctcccagggggtaccactcatagcatatcctggtagtgatccaggggttttcattcacaaagaatacaacctgaatggcgacggctctccttgtgaaaagatgggcacacctgccccctccacaacaacctgtgtctctccttccctccattaccaacttcttacaagagcagcctgtagttcctcacccctccctgggtaaaagtcttcatgcatttcccactgtgaggtcagaggcctagtgttaattaaccctcatcctgcctacctgtctgcagcgtttgggacctgatcattcctgtttctgggaacactctcctcctctggctttcctgcttcttctgttccctcatggctcctcctcagtctctgaccagctctccttccagtcttctctctgaaatcttgatgttgctaaaagctgtttcctcagccaccttcttgtttttcacatgctcttccctgggcaacgtcatttactcccttggctttgattaaacttacacacttaaactgataacctttctgcttactaaattaaaaacctcttataattacaaagcagcccatgtatagataaacaaaaataagaaaataaaaatacactattcccaccatccagagcataccactgttaatatcctattgtacatccttccaaaatttttaggcatgcatatatatgcagacatatcttttttttacaaactgagaaaaataccgttttatgaattgttacatactgtttttataaaactttccatgtcaatatatgtcactatattttacctaatatccagtctatatctgatgatctaaatcattcccgaaacgtcttttgtagttcgtttgtccaatcaggaaccaattcaggcctacacattgcatggatatttcttaagcccttttccaagcataaacatgacattaggcttgttaaatgaatttggccatttagcctaaggaacaacccattttctggatttgacaagctgctttcttgtgggttcatttagcttgtttctctgaccttcttatttcttataaactgaaagtcaaatgtggccaggcgtggtggctcttgcctgtaatcccagcactttagggagctgaggcaggaggatcacttgagcccaggagatcgagaccagcctggtcaatatagtgagacctcatctcttaaacaacaaaacaaaagagaaagtaaaaggcaaaagcatggtggattcaatttaaaccttgttagctagattatatcataggagatatgtacttcttattgtattttgtcatgatatatatattttctggttcgcccactgttagagattctagtagtgaccagtgaattaaggcaaacaacaattttcttcttccaagaaacattatgttttccctcctgtgactacaaggtaatctgtgtggtgttatctgggcaatgcacaaatgttcagttccccctcaacaatgtgctaatgctttaataccagtttatacttgttgctgaagtcaatacttttaataaggcatttgtaaccacccactgggttcatttttcatggtgcccagatagagccaatttatcaagataggggaattgcaatagaaaaagagttaaatacacttcaagcttgctaaatggaagactgcagttttattattactcaaatcagccagcccaaaaattcagaggctagaggtttttaaagatattttggtgaacaaggggctagggaatggggaatgctggttggttgggttgaggatgaaattatagggagttgaagctgtcttcttgcactgagtcaattcctgggtagaggccacaggaccagatctgccagtttaccagtctgggtggtgccagcttatccatcagaattcagggtctgaaaaatatctcaagcaccaatcttaggttctacaatattatctataggatacaacattatctataggagagcaactggggaggttaggaatcttgtggcctctggctgcatggcttctaaaccataatttctaatcttgtgattaatttgttagtcccacaaaggctgtcttgtccccaggcaagaaggaggtttgttttgggaaagggctgttgtcatctttttagttttaatagttctaaactataaactaaatgcctcccaaagttagttttgcctatgcccaggaatgaacaagggcagcttgaaggttaaaggcaagatggagttggttaggtccctttcaatgtcatcaatttctcactgttagaatttttccaaaggtggtttcagtttagagcaattttcagccagagtttctggtttaagaatatttttataaaagagctatttactcaggtatgggcagggctaaggcaaccatctagggatcatgaagttcccaggggctagtgtcagtgggcggctatcgccagccctcatctgagggggcaggagaaaggaatgttcctcctggtgcctggggctagctacaaccctgggacaggagctgcccaacagaagctgtggctgttaacagaggaattcagttataacccaaatcatgaccaggcagggcactttaatgaagtaaaacttttctgatgactgttttctgtttcttgcgtgaaagacaattgcaggacaggggagattatacatcaggtattggagacaactacaatatgcccttttaatgtctgtctgtggaccaagtttactgtttgcatttgtagccatgggaaagaacaggggaaacaaggtggacacaactctcaggggaaaattggcccctggttgccaaagcacaggtgggggtagtgtgatgtgatgacgtttgcaatggataatttgtattagttaacagctctgggtcaaagctgttttgtctccatgcaagaagtaatgaaaaaaaaaacaatgttagttccaaggaaacatatcctcatccgtgaataattatttgctttgactccaggacacctttcatttaaaggtgtaaaggcacagagagggggaagtgaataatcactaactaaccttttatcaccataggagaggacatgctcctggtgctaactattatgaaacttcaaagggagtgattgtcaggtgcccatagttcagattattttcctcagcatgggaataaaacactgctgcttctcactcactacaggtaaaataaatagaactgataatgtgtattatataattctaccaagccttggagccagaaaacacattggtttcctctgtctctggggaagggtttcttattacattttcttctagttgacaagcaatttgggagtatccctcaattacatgggatgccccagtgtgggactgagaagaagattagattgtaggctgctctattacttactaactgggtggtcttgagtatgttatttaatcttcccaaaccactgtttacatccataaaacagtgataatcttcattcccctggctacaggagaacgagctttgatgaggcaaagtggataagaatgggttctggagtcagaaagagttcaaaatctaggttatgcttcttaccgattgagtgaaatggggcaaagtcacctaacctctaagccttagtttctccatctgtaaaataaagtaatagaaatagaaacaaaacagaaacacaagatagaaacaatgttgtattattttaaagattaaatgctaaaaaacacttaacacagtgctggcaataaataagcactcaatagtttgctattattatcagctgccctgtggtagacagaattctaaaacagcccctatattcctactcgtgatgcacatgccctgtatagttctattcagtgtgaatggaacctgtgaatataatgacatattactcttgtgaggaaaattatcttgggttgacttgacctttcaggtgagtctttcttcttcttctttttttttttttttttttgagacggaatctcactctgtttcccaggctggagtacagtggtctgcaacctctgcctctcgggttcaagtgattctcctgcctcagcctcctgagtagctgggattacaggcacctgccaccatgcccggctaatttttgtattctttgtagagatgaggtttcaccatgttggtcaggctggtctggaactcctgacctcagatgatccacctgcctcagcctcccaaagtgctgggattacggcgtaagccactgcgtccagcctcaggtgagtcttttaaaagcagagagctttcttcacttggtgctgggaagaagtcagagaggtgcactctcactagcctggagaaaatcaaacatccctgccatggcagcctatggggactacgtggcatggaatgtcagtggtctctgtgagccgagcatagtccccagcaggcagctagcaggcaaaggggaactcattcctacaaccccaaataattgaattttgccaataacctgaatgagcttggtagaggacctccagtctcagataagaactacagcatagctgatatcttgattgcagccttgtgagaccctgagcggaggagtcagctaacctgtgctcagactcctgatccacggaactggaaggtaataaatgtcttgttttaattcactgtaggtggtaatttgtttgaagcaatagaagactaatacactattcagagttaatcaacattgtttctgtggctcttgctgggtccatttctgttcctaattgctgttgtctaatgcaatacttggttgcataaatcatgacagtgcaagaatgacaagaggtgctgttctccaacacaacccctttagattgtcaatactctgtccgactgtcttctcctgctaatgggctggtgatgatcatgggggaggagaggtttatagacctttgtggcttcagaaaggaataaaaatatcgtcggggctgagtctttcctggaagatgcaactcgttatgcaaaagccctttcttcatagttgtttcctgtttgacactacaaatctctcaatttcaaagggcttatatgaacttcaggccaaacttagccagatgatctgttgaatagctttaggtcttcactgagcttgcagtatattggaaaaaggagacatcaaacaagtaattgcacaaacccagaattatcaactgcattgtgtgccttaaacagaaagcacagactctcagagaaacttgagcctgtggattcaggggaaacttttctgcataagaatggaaggatgagtaggagttgactaggccgagggatgattaagagtacatctcccaggaagaggggatggcttgtgaaaaggccctgaggcaggaagaggcatgactatttcaggaaacctgaagactggagaacgagcaaagagagtgaggagaagagactgtggggccatgctaaggattttggtctctccggtttgccctttcagaaaatcatccaggttgcaatggagaaaaagaaattgtagggagcaaggactgatggcaggaatactagttaggaggtaattgcaaccatgcagacaggagctcatggcagctatgactaggatcatggtggtggagacggagagaagttatatagatcaagcagatataatgttttatttttgcttttaccaatttttttaaaattgaggaaaacattttctcatcacttctactattctgtggagaattcacattcattcacatatttattcaacaaatacgtactgtgtgtcttttatgtgccagataccattttgggcataggaatataatcttgaataaaatagtcaaaaaatctctgctcccaaggagtttacaagggagttagacaacaaacaaggaaaaaaatatatatatatgtgacagcaataaatgctgaaaagaaagttgaaagttgacaagggggaatattaagtgttcaaagaaggttgcattatatgttatgtcctgacaagatctcactaagatgatgacatttgagaaaagatttgaagttggttagggatcaaggcatgcagctattggaggtaggaagactgagaggaagtattctagtcagagggaacagccagtgcaaagactctgaggtagagaggtgactggcattttccagaaggctggagaataatgggcaaagtaacgcatcagtcatcaatttcgcaataatgctgagtaacaagcaaactcaaaatttcagtggtatacagtaataagcatttaggttttcccctcagtctcaagatcagctagatggttttgctgatctgagctgatcttggtggggcttactcatgctttcacagtcagctgcaagccagcacagctttgctgatcttatctgagctctcttacatatctgagagttttgacaagatgactgggttgatttaggtctgcttccatatctctgtttctcatatcctccagtagcaaaagagagtcagagagagaaagggagggagagaggctagagagagagagagagagagagagagaacacacataagccctcttaaggcctaagttcagaatggagactgtcacttctgccacattctattggccaaagcaattgataagacaagtttagtttcaagggatggagaaataaactccacttcataggaagagcttcagagtcacattgcaaaaggtgtgaatatagtgaagggtggagaattaggaccagatttgccatcagtctgccacattgagttagtaggagatacagtcagagagataatggggatctagaaaatgtggggccttgtaggccagggtaagacctttggcttttactctaagatgagaagccattggagagtttccaggagaggagcaacacaatcctactctattttaatgaaatcaccctggctgtcagattacgaatagactgaagtggggcaggagaccagtgaaaaagacattccagtgatccaggcaagaaatgagggtggctgggccaggaaacatagttaatagaagtgctgaaaactagtcagattctagacatattttgaaggtggagttgtcaggatttgcttacaatgcaaatgtaggatgttagagtaaaagaggagaaattttggaaagagcaactagaaaagctgtgttgcaatgtactgagatgattaaagctatgggaggaggaggctgcagggggaaatattcttgaaaaatccccaactacttgccagttttttactatctttgaatgccatcaacttgacaggaagatttgactgaagtcagccagggactctcccacagtcctttctaccagcttagacttgggttctcacagatccagagataacctccactgtaacatactgcgcagcctgcttcatgtgtacagccagcatccttgtcattagctgtgacatcagctccgactggttgcagcacccactcttgtttcatcatccattctgattggtcagaaccttatttaattattgttctccatagcagagccaaaagaaacacaatgtgaatggaagtgcccctctttctaaaaggcaaagaccacgtcttatccaactttgcacttctagataaaagaaagtgaataagtctacttagattctctccattcatagcaaaagcatctcaagttgcatactctactaaggactgatgtaacatttttttactctgaagaaaaggtgcattgaaagataaaaatgattccaggcatgattattataattcaccaaatattctgtgcagaatttttaaaaaatccctgtatttgaataggtaaggtaaaagttaactattgaaaaggaggaatatttgtgttccttttgactccttaaattctcatcttggctcatggaggaggggattgacaccaaaatttcagtcctatcttaacatgagaggaagtgcagggagggaggctctgttacagtaggtagctagtcagacataagcatggcaggaaaggactccccttgccccaccaggaaagtcaggcgaccatcaggtgatggttaggtggttgttacaatatttctctaaacataacattaataattggttgtagccagcccagggaaaggcagtctcccaatagatagaaaacacctgaaaccggtgatcagcagcttcctgataagatatcaggagttgggcgggtaggctctagcatgtgcactaaggcaaaatggcgcaacttaactggtatatgaccttctaaggacatgcaactggtaagggaagaacgcctcaagtgagcatgtgtacaactccagtacaaacactgcgcatgctcccctcccagatgctagcaggctgttgcacatacggacagcccctcccaagggaagaatccgggagaaggaatgcaagaccctgggagcatgccaacatataaaaccctaagtcaaaaggtccaactgtgcacttgatctctcagttcgcccccttgggcctcttccaagtgtactttacttcctttcgttcatgctctaaagcttcttctttttttttttttttttttgagacggaatctcactctgttgcccaggctggagtgcagtggcgtgatctcggctcactgcaagctccgcctccgggttcacgccattctcctgcctcagcctcccgagtaactgggactacaggcgcccgccatcatgcccggttaattttttgtatttttagtagagacagggtttcacagtgttagctaggatggtctccatctcctgacctcatgatccgcccacctcggccttccaaagtgctgggattacaggcgtgagccaccgtgcccggcctaaagctttttaataaaccttcactcctgctctaaaacttgcttcagtgtttccctctgccttatacccctctgtggagttctttcttctggggagtcaagaagtgaggctgctacagacccatatggatttgtctgcctccctcagacaaaaatggcaactctgggctgggcatggtggctcatgcctataatcctagcactttgggaggccgaggcgagtggatcacttgagctcaggagtttgagaccagcctgggcaacatagtgaaaaccttatctctaccaaaaaatacaaaaattacttgggcatggtggcatgtgcctggagtcccagctactagctgagaggtgagagaattgcttgagaccaggagggcaaggctgcagtgagctgagatctcaccactgcactctagcctgggggacagagtgagaccttgcctcaaaaaacaagcaaacaagcaaacaaatggcaagtctgattggcaaatgtgtaatatttactaggacatgctttattaatgggtaggaattgactctgcagagtgaaaccagcccaacgcattcccttcactgggagcatgctgccaaggtgtgggccttcactctgtcccattgcggttcatttatgaagcagccttagtccttgcaactggctatagctggtgaatttgggtgggctctgcgtacctaactcttctctcagatacatgaggtgagcagttcccaaagtctagtttgggtgaagagtaggaggcctcatttgacctcagccatgctctcttgcatgcagaatcacttggccagtgccccatctagctcccttgtgtgagctccccatcagtcagagatgacagggatgagtcatctctgaagaacttgaagccctaacatcagcatcaagcccaactgagatatttaaagaactaggattttctctcatgttaatcctcagcataatctcccttctccttttttttttctgcttctagaatagtccttctttatccctttatttccttttctgaggcatatttaatagaatgtgaaattgcatatttattaatgatggcttttttggtttcaagtaacagaaacacacttgagctctccaaaagcaaagagatataatttagtttaagaaataggcctgtctcaaaactcaagggcaaataaatagctgaacttcagaaataaatcagagcctccagcgtagtcaggacccaccctcccatctctagggtaggtgaccacacatgccagtatgtgccggcctatccttgttgacatctgtcaccctgcccctttcacttttgtgtcagtctttgtccatgagggggcagaaaccacagtgacttaaacagagaaagtttaatataaattttttaaaattatgttaaaagagcaattataatatataagataactctatgtggtaccctaaggctgagtacccaagagagtacccaaggagggatgaacataaaacataaaacaggatgaacataaaacaggatgagcccttccccaaggctcagattgcaaccactggatggcagagaagtttgctgatttgcccaggccagagctggtctgcagccactgggcaagcaggaagcaaccctctggggcacaggtggcacattacaaaaactgcagccaatggcttggcacgtgagcatgcagagggagtagggacaccattgcagacaaggaggtctggagcctgcagtgtctgtggtaagaaggccatgggaaagtgggcattaggccaggacagagctgcaaggacatcaaggaatcatgagttctgggcctgtggctggaattagaacaccactgatgttcccacacccacactgctgcctgatggtgcagccaccactaacaccaggaaggctcctttctcctgtaatgtcccatcagggccctctactgagaaagcttcacatggtgaatgatcaaatcattttttctctgtaaagaagaaatgcccaatggaattccgtccattattgcagagcaggtattgaagggtgaatttgaatctgaaagtcagtaaattattagcacaactctcaacagtaccctggtaagaatgattaattcccagaagagtgaaatccatagggaaaggaaatagaataatagttgccaggagctgtggggctgtgggaatggagttacccgttaatgcttatagagtttcagtttgggaaaaggaagacattttggagatagactgtagtgatggttgcacaaaaacgtgaacataatgccactgaattgcatgctcaaaaagggttaaattgtaaattttatatttggtgtattttaccacaattttaaaaatgatgaattcctggtcactctattcatctctcatctctgctcttctctgaacatctacttcctttttcatttccgtttcttagaccacacactaaaaaatacagccaccaacagctcctggagttacctctcctttgcttaagaaaccagacggatggccgggggcagtggctcatgcctgtaatcccagcactttgggatgccgaggtgggcagatcatgaggtcaggagatcgagaccatcctggctaacatggtgaaaccccatctgtactggaaatacaaaaaattagccgggcatggtggcgggtgcctgtagtcccagctacttaggaggctgaggcaggagaatggcatgaacccgggaggcggagcttgcagtgagctgagatcatgccactgcactccagcctgggcaacagagaaagactccgtctcaaaaaaaaaaaaaaaaagaaagaaagaaaccagccagactaagtgctgcactcccatcattctctctttcaaattgtcctggaagatctgcagcagctttggtccaatgctcactttggccatttgggccagtgtcatggtcatatggtatagacctgttttcagaggagtttgtttgtggagggggaagggaaccacactgacaaaaccagaggaatctactataatcatttaatgactcctctcccctccagtcttccaactaaataaagaagccaggaaaaagtgaatattaaaaaattcacattaagagtgaaaccaatagtaaaaatcatgtcagatcagtccattttttttcttctctccacctatgttagtagtatgaatcagtaagagaggcatatggcagaataatcagaattatttatcaagctaattaaccatagattgtttcctaagtagtcacaaaatggcagaaatctttatatatatagggagacatagtacttgtattaagataattaaaaattatttgtgattgttactgtgattatcatttttttatctttgctagcacaactcctcaaactgatatatattcccatcaggtgctttagagaagcactggcctttctcttgacaggcagtgtgcattttggcaacagattttgaatggaaaaaatacaagcttttcccaagccctaaacacagaatatgccatctattagtttggatttcttccttaacgatcactgtaccaatatgtggtggtttttctaaggagaaatcgatccaaatctttctttggactcagaatccaagaagcctgagttttatccctggcttggtcacagatgcactgaaaatgggcaagttacttccgtctttgtctgaatttctccatctggcaaatgtagattctgacactcaccatcagataatgtttgcaaaatgtttgatggtccttgctggtaggcagtatgtaattgcaaactgttggttcattttttttctgtcctaaaaattcttctctttcttgagaaactatttttaaattaaaaatatcacttttaaagtatgagcacacagtaataaaaattcagttggtactggagagtaatttttaaaaaagtaaaggttttactctttggcattccccagaggtaatagcttaaaatttttctattttgaatctttctaaggccaacctctacaataataacattattcctttactttttatatatcaacttcaaagtatgtctgattgctggacccccttgtgaaagatgaagctcttggctcatttatacttccccttcaacagcaacttccagatatattttgtttttgttattcttttagacacttctatagctttatacaatatgttcatctttcaatttcttttaaaagacttatttttaattatgggtacataatagttgtatatatttgtgcatgtgatattttgatacaagtatccaatctgtcatgatcaaatcatggtaattgaagtattcatcacctcaagcctttatcatttctttgtgtaaggaacattccaattctactcttttagttatttaaaaatatgcagtaagttattgttgactgtagtcaccttattttgctaccaaatactagatcttattcattctaactatattattgtacttgttaaccatcctttctttacctccccctcctccacactacccttcccagcctctggcaaccatcattccactctctatttctgtgagtttatttatttatttatagctcccacatgtgagtgagaacatgcaatatttgtctttctgtgtctggcttatttcacttaacacaacatcctccagttccattcatgttgttgcaaatgacaggatttcattcgttttattgctgaataatattctaatgtatatattccccaccttttctttttccatttatccattgatgaacacagtttgcctccaaatcttggcaattgtaaacagtgctgcaataaacatggaagtgcagctatctcttcaatatactaattccctttcttttggctatacacccagcagtgggattgctggattctatggtatctctatttttttttttttttttttttgagatggagtctcgctctcttgcccaggctggagtgcagtggcacgatctcggctcactgcaaactctgcctcgcgggttcacaccattctcctgcctcagcctcccaagtagttgggagtacaggcacccaccactgtgcccggctaattttttgtatttttagtaaagacggggtttcaccgtgttagccaggatggtctcgatctcctgacctcatgatccacacgccttggcctcccaaggtgctgggattacaggcatgagccaccgcacctggcctatggtagctgtatttttagttctttttgagaaacctccatactgttctccatggctatactaatttacattcccacaatagtgttccagggttctcctttctcagtatcctcaccagcatttgttattgcctgtcttttggataaaagccatcttaactggagtgaaatgatatctcattgtagttttactttgcatttctctgatgattaatgatgttgagcatttttcatattcctatcagccatttttatgtattttttaaagaaatgtgtatttagatagtttgcccattttaaaatcagattatgtttttttttttcctattgttgtttgggcttcttatatattctggttatcaatcccttatcagatgggtaggttgcaaatattttctcccattttgtgggttgtctcctacctgtgttgattgtttccttcgcagtgcagaagttttttaacttgatatgatcccatttgtccatttctgcttttatcacctgtgcttctgaggtctcactcaagaaatctttgtccagaccaatgtcctggagtgcttccctaatgtttccctctattagttgtatagttttagtcttagaattaattatatagtccattttgatttctatttttgtatatggcaagagataggagtctagtatggtgagagataggagtctagtttcattcttctgcatatggatctccagtttccccagcaccatttattgaagagactgtcttttctccaatgtacattcttggcacctttgtaaaatatgaattgactgtaaatgtgtggacttatttctggttctctattcttttccattgccctatatgtctgtttttaagtcagcaccatgctatttaggttactatagctctgtagtataatttgaagtcaggtaatgtgattcctccagttttgttctctttgctcaggatggctttggctattctgggtcttttttggttccatataaattttagatgttttttctatttctatgaagaatgtcattggtattttggtagggattgcattgaatctgtagattgtttagggtactagagacattttaactaaattgagtcttccaatccatgaatgtagaatatcttcattttgggttgtctttttcaatttctttcatcaatgtttcatagttttcattgtagagattacttctttggttgactttattcttggtattttattttattcgtagctattgtaaatgagattactttcctggtttctttttcagattcttttctgtgggcatatagaaatgctactgatttttgcatgttgatttttttatcctgcaactttactgaatttgtttataggttctaactgttttctggcagagtctttaggtttttctaaatatgattttatatcgtctgcaaagaaggataatttgacttcttcctttccaatttggaggccgtttatttctttcttttgtctaattgctttggctaggacttccagtactatgttaaataggaatggagaaagtgggcattctcatcttgttacagatcttagatgaaaggctttcattttttccccattaaatataatactagctatgggtttgtcatatacggcttttatcatgttgaggtatgttccttctatactcagttttttaagagtttttgtcataaaggatgttgatgttgaatcttatcaaatgcttttttggaatcaattgaaatgatcctatggtttttgtccttcattttgttgatattatttatcacatttattgatttgcatatgttgaaccatccttgcatccctgggatgaatcccacttgatcatgatggatgatatgtatatatttttttcaagatggagtcttgctctgtcacccaggctggagtacagtggcgcaatctcagctcactgcaacctccgcctcccaggttctagcaattctcctgcctcagcctcccaagcagctgggattacaggcacctgccaccacacctagctaatttttgtatttttagcagagatggggtttcaccatgttggccatgctgctcttgaactcttgacctcatgatctgcccaccttggcctttcaaagtgctaagattacaggcatgagccaccacgcatgactgtgatgaatggtatttttaatgtattactgaatttggtttggtagcattttgttgaagatttttgtatctgtgttcatcagagatactggcctgcagttctcattttcaactttccatttcttgattcattgattttagccagtacctcttgacttgcctctaagacaatgaaggatttaacagccctaccttcctgtctctgtctcctcccctaatggctattcccaatgtcacagcttcagttcatcacatagttaattttacattgccaaaatttatagaagttatactttcctatataattatactttctttttctgtgttttggctgtttgttaagtctaaaagtagtcagaatttatattttatttaaaagaatattactatacactgtataatcaattccattcaattccaataaaaatatttgtttattacatactttgggccagacactcttctaagtgctaaggatacatcactgagtacaacaggtgaacatcctgcctttaaagagtttacattttaatgtatggttagactcatagaaaacatgatgcaactctatgtcatttaaccagtgccaatagaaaaataaatgaacatacttaaattgggagaaggagagaggaagtagagaaaacagggtgctgaatttttataatatattattagatatgcctttactttctgtctatgataacccagaatcctcagcattttagaagaaatgtatttctttttcttaaagatattctttccaaggcctcctgacttgccgatctaatttgctgttttcaatttcatcctgctgaaggattctttgtttagtttattgtaggggttttcttgcttttgcttttcccggttttattttgtattgaatggctaggttggttgcttttataattccaggtctttctcttttatttatactgctggaataaattctcaaacaattatttcaagaagtatcatatattcagataaggactttattttcaccatttcattatcccatttggtcgatagtttttgctgggaatagaattatttattaaaaatccatttctatcagaactctgaaggtattctctcacaccctgaagaaaagatcagatgccaacctgagttttgctcccctgaggctatcctgccctcctatcaacccataagtattacatattcttttctttagccttggcaaaagaaattttacaaggatatatttaagtgtgggtctttttataaaactaattttgctgggtatattatagttgccccctctcatgagacttgcctgtcttcagctatggaaaaatcccctttattctatttatttatttatctatttatttaacttttactagtcatgtgcagtagtgagaagcaggcaaagagtagaacaaggagtttgatctgtaactgactgaacaatcaattgaaataactcattaccctcagaccagcctttctttgttctttgtttcttggacaaattcctagccttttggaaatcatactgggtagatgtgggccttcttatattgcttctccatatttattcactcttctcataattcatgtcttagctttctctctctctctctctctctctctctctctctgttctgggaaatttatttaactctttggtccagtctttccattgaattttttattttaacaatgacatttttaatttccattaattctttcttattctcagatagcagccctttttaatttaatggatgcagtatcttattcgtttaaggttatcttctcttctttgaaccatctgtttcctttgcgtcctttgctctgctatccataggggtctttgccttttgtgctgatcactttctctccctgtgtatgaaggattggactgattgcctcagatagctgatatgggttgcctctgccttttagggcctactcatcaataagaaggctggcctcatgacctgggtatgatttcagggtcctggttccccggcttcactttagggcatgtgggcagagggctaggccccactgcctccctattttacactgccagaagaggctctgctgtgaggagccagtccccactctgcaagccttgtaccctctagagtgtagttcttggttttagcatgagggcagtgcccccactatagtctgggagctggttgtgaaagaaggtgaggccaatctggacaaccatcctgtaaacaagtctccaaccaagcccccaattttgtctcatatccatggattccagtgtcacagtcttgtgaaatattctgaacttttacaatcttcttctacgcgtcttctaagctgtgtctccctttctcttatttttctaccaataaaactcttctgtcttccattccagatgtcagtaaaaatcttcctccccctcatgcacccacctcttattttcaatgtctttctgaacatattcctatttatctcttttctaacatttcaaaagattttaagagcaaaaaggaagatagagatgtatgccctacccagcatcttgtatcagaatctcctttctttttcccttataagatactgaaaatatcaccttaaattgtgtttcattactgttgttttcaagtattgaaaagagactttttgtcttgaataagttggtggctatttttgtctttatttctgtcatagcaggtgccagtccaattgtgaatttaaatatattatctcagtaactgggttcaaattatgggatgtgtccagcgctgagaattgagggttaggcaagaacctctgtcttctgaaaaataaaatgttcaacatgtggggtatttgtttctgagacacaagtctaagagtgcagagttgtggggtttttcaactcaagtgagtgtccttccttggatttggtagtggtttcttagatatgtcaccaaacacacaaccaaccaaacaaacaaacaaaacctagatcttcattaaaatggaaaacttttgtgctttaaaggacactgctttatctgaatatttgtgtccctccaaaattcataggttaaaatcttaatccccaagataatggtattaggagatggggcctttggaaggtaattaggtctcaagggcagcatgtcatgagtgggattactgcccttataaagaaggcctgaggattccctgcctcctccaccatgccagattacagtcaaaacaaaactatctatgaggaagcctcgctagacaatctgccggcaccttgatcttggagttccaatctccagaactgcttgtgcgttacccagttttatagtattttgttttagcagcccaaatagactgagacagagacagtaagaaagtgaaaagacaacccacaggaccatgtgcagtggctcacatctgtaatcccagtgccgaggtggctggatcacctgaggtctggccaggtggattagcctggccagcatggtgaaaccccatctctactaaacatacgaaaattagccaggtgtggtggcacatgcttgtcatcccagctactcaggaggctcaggcatgagaattgtttgaacctaggaggtggaggttgcagtgagctgagctgagattgtgccactgcattccagcctcagcagcagaatgagactctgtcaaaaaaaaaaaaaaaaaaaaaaaaaagacaaaccaccaagtgagacaaaatatttgccaataatatatttaacaaggcacttgtattaataaaaagacaatccaatttttttttttttttttgagacagagtctcgctctgtcgcccaggcgggagtgcagtggtgccatctcagctcactgcaagctccgcctcccaggttcacaccattctcctgcctcagcctcccgagtagctgggactacaggcacccaccaccatgcctgactatttttttgtatttttagtagagatggggtttcaccatgttggccaggatggtctcgatctcctgacctcatgatccacctgccttggcctcccaaagtgctgggattacaggcatgagccaccacgcctggctgacaatccaatttttaaatgggcaaaaagtctgaatagacatttctccatgtatccaaagatacgcaaacagcaacaagcacacaaaaagatgcttaatatcattggtcaacagggaaatgcaaatcaaagcaacaatgagatatcacttcataccactgttatggctagaataaaaaagacagataatgacaagaattggtaaggctgtagagaaattggaatcctcatacattgctagtgggaatagaagtggtacagctacttaagaaagtcaagcagttcttcaaaatgtgaaatagagagttaccatatgatccaaaaatttcacttctaggtatatacccaagagaaatcaaagcatacatccacactgaaacttgcatacaaatgttcacagtagcattatttatagtagccaaaagctggaaacaatgcaaatgtctattaattgattaatggatgaataaaatttggcatatccattcaatggaattttgatttatttatttatttattttgagactgagtctcgctctgtcacccaggctggagtgcagtggcacaatctcgggtcactgcaagctccaccttccgggttcacgccattctcctgcctcagcctcccgagtagctaggactacaggtgcccaccaccacgcccagctaattttttgtatttttagtagagacgggatttcaccgtgttagccaggatggtctcgatctcctgacctcgtgatccacccgcctcggccttccaaagtgctgggattacaggcatgagccaccgtgcctggcctattcaatggaatattaatggcaataaaaaagaatgaagtacggacatattctactattggggcggaccttgaaaacatgctagctgaaagaagccagtcacaaaagaccaatattgtttcattccatttatatgaaacgtccagaacaagcaaatctatagacagaaagtacgttagtggttgcctagggctgggcaggatgttaggtttaggggtgatagctaaagggtacagagtttctatttggtgataaaaatgttctaagattgattttgatgatgtttgcacatctcttgaatatactaaaaatcatcgaactgcacaattaagaaaataagattgaatcaggaggccattttgagtagggtttaagaatacagactttggaatcaggctgacctgagttcaattcctggctttactacttactggttgtatgactttactgaggtactaattctcactgctcctcaattcccacatctggaaagcaaaaataatgatatcagaattggagtgcacgtgtatgggcacacaccccacacacacgcttctcaaaatggccagaaagtgttttgtgaaagcagaatggtggaggccagtcaagtcttcctcactccttctctgcaacaacatacccctctccaacactcgccttggtgcggaagcagctatgtcctgctttatcctgaggtgcttgactcaggggagagaagacagatctaattcagtgagaaaccaactaattgtcaccttctcttggtcctttcttttcctctgacttttatcaatcccagtcccatatgcataaagtcccttcctcaaatttgaaaaatggataggggtgaaagacagcaaaaaattaactttaaaaatatctcactattttgatgttataccccaggtcccagggacagagtagacaaggactggacatttatcaattacaaactccaaggctaggataagttacttcaatggttgtggaaattacaagtggtacttagatgctagctgactttggcaaagaccaagcagattaatcattatggtgtagtacaaagtctagatgaaaccaagtcagcccagtaattctagctggagagggcatgtaaacacttcaaaaacaatcaggcaaaaaaacataggctgtggggaatagccatttccaaagccacagaaaacttacggatgagttttctaagagaatgttttatctcaagccaaatagacgtaccattaaagcaccaagcctatagcctgctggacttaccaatccatacttctcaataaaggaccactcacccaaaaggaaaaacatttccaactcctttctttacctaccttactctgatctaaaattgactctactgagaaggcaaggaagatgtgactaatagtttggcaggaagcaaatccaccctacagtggcaatctaggattggtactagccatcaggatggttggttcttagcaagatggtggtgacatagagttataaaatttctaggttaaagcgaagataagaataatgaacatagtgatgataatacaataatcatagcaaacatttattaagaacttactatgcccaggaagtattctaaatacttcatgttttaacccatcaaattccaaccataaccctacaactaatattctcattatttagaagacaaaacttaagatagaaaccagcctcttatttggtagcacctagaattgaggccaagggaagtaaagagatcttgcatataattattgaagtttgttttatttgccttcagacttccttcttcatgaattcatcttttctctttaccgtatttcaggttctcaatcctttttatttattcatttattttaaatagagacagggtctcactatgttgcccaggctggtctcaaagtcctgggctcaagctattctcttgtctcagcctctcaaagtgctggtatcacagatgtgagccaccgtgcctggacaattctctttatttataaagaaacctggccgggcacagtggctcacacctgtgatcccagcactttgggaggccgaggtcaggagatcgagaccatcctggctaacacggtgaaaccccgtctctactaaaaatacaaaaaattagccaggcgtggtggcgggcgcctgtagtcccagctactcgggaggctgaggcaagagaatggcgtgaacccaggaggcagagcttgcagtgagccgagatctcgccactgcactccagcctgggcaacagagcgagactctgtctcaaaaaaaaaaaaaaagaaacctgttttcatgaaaacatcttatgtcagccatttatcctttactcatcaaggtcactaacatctaagtgatattggtgcaaaacccaatgtttaatgtcttcctcttgcttgtcccataggcagtgtttttttctttttgtttgttttttagaatttcaaattttattatagactaaagggtacacatacagttttgttacactgagtaatgctgaggcaactgggtaaattgagtgatgctgagacttggggtcccacatggcaaaaggaatgcacaagctccctcaggcctcttttataagagcactaatcccaattcatgaggtggcgctctcatgacctaatcacttcccaaagcctccatctcttaatatcattgcattggagatgaagtttcaacatgtgattttttgtggggatacatgaatattcagaccacagcaatgtctgagacatctcaaacttactatgaccaaaaccaaagacgtaatttcctttaccaaacctgcttctcccacagcctttccctgtatcagtaaatggcaactctgccattccttttttttttttttttttgagacagagtctcgctctgtcacccagactggagtgcagtggtgcaatctcggctcactgcaatctccgcctcctgggttcaagcgattctcctgcctcagcctcccgagtagctgggattacaggcacctgccacgatgccaggctaatttttgtatttttaatagagatggggtttcaccatgttggccaggctggtctcaaactcctgacttcaggtgatccgcccacctcgatctcccaaagtgctgggattacaggtgtgagccaccacgccaggcctacctctgcccttctaggtgcttaggtgaggagtcttggagtcatccttgactcctctcttcatctccatatttacataaacaaatcctatggctctacaatcaacacagatccacaacttaatattttgctcaccatctcacaattgctgtggtctggtccaagcctcaaccttcctgcctggattgttgtgacagcgctgaaaacagtttgttcttccacctctgccccactgcagcatatagagtgaaattttgaagccatgaagtcaaaatcctacaatagcctcatatgtcactcagtcaataactgaattccctcaatggttcataggctgtacatgcttcgcaggtttcctaacctcacccaacaatccctctgatctccttctcgtacagtatctcttaattcacttgctcttggtctccttgttgcttttgtgtgtatcagtcatgtcactactttaaggtctttgcacgtgctatctctcagtctggaacactcttccccagataaacgcatggctagcatcttctcttattttaggactgtgctcaaaaatcattagagaagccactcaaaatgattagaaaagaagccactgaatataaatgacaacatatcacttctgcattcctgatcccctttctcttgatttgttgtgagccgtagcaattataaccacttgattattatatgtttaattgtttattgttggtctctccatattaactctaaaccacatgaaagcagaaactttgtttattttgttcactgtaatatccccagcatctcaaacagcacctgtcactgttaaatacgtgaatggataaagttaaatcagagtgtaacctatcacaggactacttgttattaggatttaccttaataataaaataataaaatctgcaatttactttattgcagaaataaagacatttcttctgtcaaagaacttcaggacctaaatatggtgagggtgaatgtatctgtggaattattcttcatggggtccctaaccctaccttcatattgatttatcctgaaaactgtttctttaaagattcacttataaattaaaatcaatgatagaaggatgaccatatttctttggtttggtcagggctttttcaggcgttaaaatgtgttgataattgcggctgtgtaactatctgttgacttgactagagtccttgtgacatctgtatgttttgggaaatctttttttttttttttttcacatcccttgaggaaaaacatgaagacctgagagtacagtggccacagctattctctgggaaccaacttaagggctgtcttccttttaaaaagcacaccacatatacccactcctattatgaatatgatagccatgagtgtgactgccatggagacccagctgcaccacagacctcatgtcagatgaacagacagttaaatgaatgaatttgctgaagagactgaatgtttggtttgcttacagactgtttttttaacctttgcccattcagcaactgttagtaactgttttgtctccttaccccacagtacagttggtcctccatatccatgagttctgcattggcagattcaaccgtgtattgaaaatatctgaagaaaaaggatggtttcatctgtactgaacgtgtatagactttttatcttgtcatcattccctaaacaatacagcataacgactatttacgtagcatttacattgtattaggtactataagtaatctagagatgggccaggaacagtgactggcacctgtaatcctagcattttgggaggctgaggtgggagggttacttgagcctaggagttcaagaccagcctgagcaacatagtgagaccttgtctctataaataattaaaaaattagccgggtgtggtggcgcatgcctatggtaccagctactagagatactgaggtgggagggtcacttgagccctggagactggagctacagtgagctatgatcatgcgactacactgcagcctgggcaacagagcaagaccctgcctcgaaaaaaaaagtaatatagagatgatttaaagtatatgggaagatgtgtacaggttatatgcaaatgctacatcatgttgtataagggacttgagcatccatgggttttggtatttctgagggcgtcctggaaccaatcccccatggacactgagggatgactgactgaattgtgtagggtcaagcttccactattgagcatctgacttgtattacacttctcctttttgatattcatgtgagtgggcttgatttgggtaaaaggaaaggcagatttccatgagttccagtttccaaggagaaggggactctgttgacactgcactctgtgacacatcacctccactaccccagaggtcacctaccaatggctcccacacaccctgattggctcctatggctctgcctgaggacactgtctggacataggcctaaatttggccacgctcccatatgctcttaggagtggggcaggcccaatgcgccagcgagcccatgctgcaggaggagccctcaaccaacagagatgggagttgctgaacaagtaactcagctttttgtcctctcagggggacagttctggggtgtttttcatccattttctaagaatgtacccagaaatattaaccctgtcacccatgatggcaacctattcattaactcccaatgtattggctttactctctttcatgtcttattttcccactccctcaatgtccttcttggactcgcctcccaaagaaactacttgtactgaaaatcttttctcagattttgattacagggaacccaaactgaggtggggcatatgttcctacttgaagtggcctggtcctactcttgctcttggagaggacaagcacttagagctacagaatatctgaagtagcagctgttgctgccactgagctgcgtgaagtgatatggcagggtggaaactgaccatgtattttatcagttgcatattaaataaaattacttgttggttaatgagtaccaaagacatgatactcatttcttcacatactttattgatttaaatagatatgtaagttatcaatatgaataacagagcaatgcatgttatcattggatgatgataagatttgttgtctgttatacagcacttttaagagataatggtcatttgtgaatttaatttatgctcaatatcattagccatcagggaaatgcaaatccaaactacaatgagatatcacttcacatccactagaatgactggaatgaaaaggcgcagacaataacaatgttggtgataatgtggagaaattggaaccttcatacaccactggtgggaatgtaaaatggatcagcctctttgaaaaacagtttggcacttcctcaaaatgttaaacatggagttagtgtatgacccggaaattctattcctaggttgacacccaaaagaaatgagaacatgtgtccacataaaaatttctacatgaatattcataacaacattattcataatgaatggcttaaagtagaaacaacccaaatatttatcaaccagtgaatggataagtaaaatggggcaaatccatatgatggaatattatctggcaatgaaaagaatgaaacactgatataggcaataacattgataaaccttgaaaaacccttgtgctgaagtatccagacacaaaggctatatattattctatatttatgaaatgtccagtatagaaaaatccgtaaagacagaaagtagattagtggctgccagggctgtgggtggggaaaataaggtgtgaagctaaaggatatgtggcttctttttgagatgagaaaatgttttaaaattggttttggtgatggttgcacaactgcgaatatactaaaaaccattgaatttacactttaaatgagttagttgtataatgtgtgaattatatatcaataaggctgttagtttttaaaaagtagaatgatagaaaaagttataccatgcaaaaactaataaaaggaagctgaaatagacttcagaacaaaaatattatcaggaataaagtagggtattttataatattaaaggcataatttcattatgaagatatgacaatcctaaatgtgtatgtacccaaagatagagctttaaaatacacgaagcagaagttaacaaactgaaaaagaaatagacaaatccacataaatgtatggggatttcaacatttctctctcagtaattgagggagtaagtatatttaaaaaaaaaccagggatattaaagtcataagcaactttgtcaaccaacttgacctaattggcacttagagatactccacctaacaaccagagaatacaaattctttttcagtgtacttggaacattcactaaaataaagtatttgttgggctataaaacaaatctcaatcaatttaaaacattgtaatcatacagagcattagacaaaatcaatgagaacaaaagctagttctctcaaatactcaataaaataaacctctaaccagatggataaggattgaaaaagataaattacgagttatcaacatcagtaacaaagagtagatatcactataggtctttcagatattaaaaaaataaaaaggaaaaaatttttagaaggaggtatgggggaaatcttcatggccttcagacagtcaaagatttcttacataatttttaaaaaagcataaactttaaaataaaaaagataaattaggctctctcaaaattgaaaattcctgctctttcaacgatatcattaagaaagcggaaaagcaagccacagacaagaagaaaatattttttcaatacatgacaaaagacatatccagaatacatttttaaatctctcaactcaatcaatagagaaaaacagtattaaaacagggaaatatttgaacacacatttcacacacacagaaatgatataagaatgctcaataagcacatgaaaaatgcttgatcgataataaccaggaggccaggcgtggtgacttatgcctgtaatcccagcactttgggaggctgaggcgggtggatcacctgaagtcaggagttcaagaccagcctggctaatattgtgaaaccctgtctctactaaaaatacaaaaattagctgggcataatggcaggtgcctgtaatcccagctactcaggaggctgaggcaggagaatcggtggaacctgggaggagaggttccagtgagccaagatcatgccactgcactccagcctgggcgacagagtgagactccatctcaaataataataataataataaccagggacattcaaattaaaaccacaatgtgatgccactacaaactgactaaaatagcttaaaatactgacaagtgttgcaaatgtggagcaactagaattctcatatattgcgggcgggaaagcaaaataatacaaccactttagaaaagagtttggcagttccttggaaagttatacataccacacaaaccaaaaattctatttacttaagagaaatgaaaacatattttcacacaaaaatttgtatacaaattttcatggcaactttattcatgatagccaaaatctgggggaaaaaatccagtttccatcaagagtttgtataaacaaactgatatattgatacaatggaatactactcagtaataagcagaaatgaactactgatatatacagcagcataggtgcatctcaaaaaacattatcctgagtgaaagaagcaagacacaaaaatgcacatactgcatatttcattttttaaacttgagatgtgctttgagtctgaattttgctgattgcctatccgtgttgcagttcaacatgaacatgtatgtcttgcaaattggaagctggatccaagagcttgatcacactcagatttgatgtctttggactcaaatggtggcattttttttttcaccgatgggcacgtaatgtctagttattgctcttggatgatgttaacaaaatgatgattttccaatctgtcactatgctggttggaataatttcataaagagatactccttctcatctactatttgattttccagtggtacagttcttttttttatatatatactttaagttctagggtacacatgcacaacgtgcaggtttgttccatatgtatacatgcgccatgttggtgtgctgcacccattaactcatcatttacattaggtgtatctcctaatgctatccctcccccatccccccaccccatgacaggctccggtgtgtgatgttccccttcctgtgtccaagtgttctcattgttcaattcccacctatgagtgagaacatgcggtgtttggttttctgtccttgcgatagtttgctgagaatgatggtttccagcttcatccatgtccctacacaggacatgaactcacccttttttatggctgcatagtattccatggtgtatatgtgcctccagtggtacagttcttaaaggaaagcaaggataagcatttgatgattctttctttttatttaatctgtttccatagtaacgctttagttgtttatcatacaattagttgttgttgttgttgttgttttttttttagaaacataagttatctgttgcccaggctggagtgcagtggcacaatcatagctcactgcatgtccaactcctaggcccaagggatcctctggcctcagcctcccaagcagttgggactacatgttgcacaccaccacacctggctgacttttaaaaaaattttgtagagatggttgggggtctcaatttgctgcccaggctggtctcaaattcctggcttcaagtgatcctctggcttcaaccccccaaagcactgggattacaggtgtgagccatcacacctggccctaattagtttttttaaatgtctgtagaaatgcatggactcaaagatatttaatgggttccaatttattgcaattcttatctttgttgaaagtcaaattgttctatcttcggcaataagaaatgggaatagaatagagtagagtagagtggaatgggcggaacggaacggaacagaacagaacagaacagaataggtgaacctcattgagttagcttctgagcctttacacaggactctagtggttttcttaatagtttccttggtatgtagtatatcaagatgtttcagattcatcttcttcatttgctgcctcatatctagaatcaacatattcaagaaatgttgatttctttgaatatgcaatggcatttgaagaccacaatcttagtacagatatgcttagtgctacttacaaaagatatatccagaatatatattttaaaactctcaattcagtcaatagcaaagaagaattaaaaatggggtaatatttggacagacattttaatgaataggtcatggcttctggccttttcagtggacggatggatagatatagttgggtagaatatgttgtgagtatgtgctatttattctggtgttttcattaaattcagaaatatcggatttttatttaacctcttctatactacatctccattttctttctttcacactgacaatcccagttctgaaggatacaggggaaaatacagttagaatgctgtataattattcatttacattctctcatatgatacacataacaatcagagaaaagcaatattaatacaaccaccaccaattataatgactaaaaaacagtttaaaacattattgaatctgtcattcctattttttctactttttgtgcatacaaatgtaatcttttcatatactctcagggcttatacctatcttgaagccagtatatgggtcttaatataaaaataactattcttcaatttagttatcttacaatctctcctcattgaaactcaggtatggctaggatacactttcctagtgtagtcacataaggaaaagcctttttcatgcatcactggttaaatagaccatctttggccaagtgtttgcagtgctacctctgtcatatattaactttccatatatgtaaacatctgtttctgagctctatttgtctatctgtgtgccaacaccacatagtctcaataagtattacatctggtggagcaagtgtccctgcctggtagaaacaaacacaaattctttctgaaggggaaaactttacaaccaagtctcagagaaataccatagttaaagttccatgccttacacatgcttactgcacacataggaaacacacaaccatgaatgagactcagcaaaaatagaaaacctcagaatcagacgtgcaaagactcacattattcaaattattagataccaaatatagaacataaaataaatatgtataagttcattaaaataccatgtattaaataaatttgaaaatgagctctggaaagaatctccagaagtgaaaattataattgaaagcagaatctggatggatggatttaatactatattaaactcagttaaagaaacaattagtgagtttgaagacaaagctgaagaactcacacataatgtggacaaagacagagaatagggacctttgaaaaaaagattaagaaatgtgaaagacagaatgagtagatccaacacacatataatctttgttccaagaagaaataataaggatgagggagatgcaatattgaaagacctaatgactgagtgttttccagaaggggttaagaacaccaaatcacaaattaacccttacccatttgccccaagaatacttgctggcagcacttgcagttgcagcgtttacccagagataactttgccacaaaatattttgtctttattattattattgcatcgccctagtatatcaactttggaaaccaaagacatcattccatttatagcattctgtttttagtagtggtatttctgttactgtagatagctggccaggcatgagggggcaggagagggttccccccaccacacccaccaggaatgtcaggtgaccatcaagtgatggtttggcagttgtcacactgcctctctaaaaatgataattgtcagccagtgccagggagaggcaatttactgatggtccgcagttgtcacactgaagtgatcactgattacaggcaccagggagagacaatttcccaaacagaaaaaaacacttgaaattggtaatcagcttctaataaaatctcagaaaactggggaagtgagctcaagcatgcacataagagatataatggaagggtatgaccttctggggccattccactagaaaagagaagaaagcttcaggtggtcatgcatacaacttcctaaacacactgtgcatgctcacctcccaagcataaggagggcactgcatgcagtcagctcaccctaagggaagaatcatgggaaaggtgtgcaagataccggaaatgggccagcatatacagtcctaggatcaaggttaaagggggcacttgaccttcacagtgcccacttgggtctcttctaagtgtactttcctttctttcttgctctaaagctttaaataaacttccactcctgcactgaaacttgcctcagtatctttttctgccttaggccccttagtcaaattctttcttccaaggagacaagaattgagattgcggcagaccagtatggatttgccactactaacatttccatttacaaaatatggtaattctttatcgctgaaaatgtcaaatcctagaaaatgtagcattcctatgtgtaatgttaacattgctctcgaacagttgttgacagaagattcatttgatgaatctgatttttccaaaatagacaattctgatgattcagatggttctgatgattcagatgattccgatgttagttctgtttagaaataactccaagacccatttttatattttatttccacattgaaaatcagtcagattttcttcagcctcaaagaatgtgtttatgtaaaattaaatgagctctggcagtgaactgcatttttttttttctaaatgggaaaaggtttaaggaagtttcccaaagtgtttcaccataggtgaaaagaaacacacaactgagtgccaaattcagaacaatgaaaacacagagaagaaaatagaagcagcccaacagaaacaaaatataaaagaacccaaaaatcatctgtaatgactgacagctgacttttcagcagccagattaaaaccagaagctcagaaaataaacttccaaagtactgaaagtaactttcaacctagaaccctatattcagcaatataatctttcaaaaacataggcaaaataaagacatcttcagacacaaatccaagaggatttactattagttgtacattcacaaaaggaacttctaatgagggtacttgatgtcagaaggaaggtttgcaatacatgaaaagagaatacatgtgttgactgtttcaatggtaaaattaatgcctaatttgtgaggctaaatatcaagaaagggtaacatataactttgggtaggtagttattggcattacagcactttaagattcttatatgatttagaggagagtaaagccgttaatattaaaatgctaattatgcatgttaaaatttctaggataatcacgaaaagaatagaaatagctataaatattagttcttatcattattatgattattatcatattccagggatcttatagaaagaagaacacacacacatacacacacacacagacacacacacacgcacacacgcacgaaggattctgtattcaaaacagtttgaattaaacatttcctgcttgatttctttatatttttctcagctaatgtgtattataaatccctaagtggagactgtagaggctttgcagcatttcctatgtttatgtgacatcaaaacccttatcttatggaatcggataagatatggaattacctattaacatcttgaggtacttgacagtttggggaacaccttttaagttaaatctgaattcacgagagtttgtctgtttaaggaaataatagaaccatgtgggcttgaagagaacaatagagtcaatgttagaaagacctcaggtttgggaaaataagacattaagaaagagttgaaaatactattgatcaatgataccagaaagagtgggacatattgcaatctgttaaatggaaagaaaaaaataaaatcaccacctagcaaatagattggaaagcttctgctacaaggctgttgggacatctgggaacactgccaaacaattctggggaacagacttggcactaattgtggccttgtgttctttatgaaagaaaaaagattattttataagccataacacactacctagatgccaaattgccagttaaaattctatttgcaagcaggtgtaggctttcaaaaaagctttcacccaacatcataggatgctgccttttcataatcaaatatgatgcaaactatcttttcatctacatgttcagtgtttcaaaatgttcccaaaatggcaggttcactgtgtctttaattataatgaaatcctatgcatttgctttaaatgtagctgtttggttgaatacagagatcatataaaggagtttttgctcttatccatccaattaattattagattggtgcaaaagtaattgtggttcttgcaattacttttaatggcaaaactgcaattacttttgcaccaacctaatatttccccttcaacttacattttaaatgtgtccaagcaaagagaagggtgaatggtatttggtagtgtttctaatttcaccctgtttataatataggatgctatcttttatttcagtccataatatttctattgcaattgatgtaatttaatcacactgatgccttatgctgtgcatataccaggcttgttttctccgaagattcaaagaaatctgcagacattaatcacagtcctcatggtggaagatggaaagggcagccaaatctaagctctggcatgaaacgattttgataggtggaaagaagagaagcctttcaccctctccaattctactagaatgccctcagcacaattttctcttcctctctgatcctagtaagttcaaagcctacctcttccatgaatcttccttgataaccctggtccaccttaatctttttccttttttaaattcccacagcccatatctctagttctcaaggtagcactcaaatcctactgcccggcattgcccccaattattagctggatcttttcctctaaacaatgaggtcttgtatttctgattcctgctcaattcaatgatggctttacagagtgcagtccataaatgctgttgataaagtgattagtgcaagaatccaagaattcgattgtttaggagccaattatgctggcagtagggaggtttggggttatcgtggggatatgtcatcattcttgttatctattttcaaagaccttaaggaaacacactgagtactcctgagagcatctaatctctcagaatccttgtttatctgtgcttattattagattagaccaaaggcaagataaggaccttttcctgggatctaaggctctttatgtgacaaagaactgccccaaagggatggtgaggagagaaggcagggcatgaagtggtgctggagacatatctatatttttcatttctcctgccctgcccccctcccaaccaccacattgttgtttgattgctactttgttctttgatttccccttacagtcccctacacttgtatcttaaaggactgctttgaagatgaggatttggaaacgtgtgtttagcaacttgtaaacgcctcctccaaggttttgcgaagtcaacaggaggcattttgattatagctatttgttctcaacacattgcgagtttgcagattagagatcagatcctgcctcttcttgccaatcaggataaacccgtgcagcaaggctccccatggggcacccaatggagctctccatggaacgggcctggctagtaaggcctgaatcaggggagagggtggggaacacagccctgagctctgctggctttggagcgagctgcctcctctgcagagaactgatgcagccttggctgtgcggaggagccaacatgcggtctccaagaacgcgatgctgactaaagcacagggctgtttcagcgcgaacagctggctgatttatttcagaggcaccgtttccaggggaatgggaaattgtttagtctgagatccttggctggtttccttttacatcatttctgtgtctttcaattatttgcacatttggggagttctagggccgtcctagagcatataggtgtgtacttttaataaaatgcaatttatgaaagtccaagtttataaaattggtaagttatgaggatggattatttttaccacaaaaggattttgtgatgaaatttaggatccgttttattagtcaataatgttcctggtgtatatagcattatatttatggatttcttttatctgacttcagaagtaatccctgctcctagctacgtacacaatggaggttaaagccacatgtgttgacttcagacaaaacctaggtttgagaccaggttctgccacttagttgttaatgtgtttgaatagttgcttaccttctcaaaaatacaagttaaaatttttgcaaggattagataacatacctcaggcacttagcatatagtaagagctcaacacattaagaagaaattcttatttttcttattattagagtatttatatgtaaaggttggtttacccacatttgatgtcaatgccgctttccttgtttgtttacatgtgagatctacctttaatgctgtgacccgcctccttcaatcattctaccctttgcctctcctgcctagcagttttggttctaaggctctgggactgccccagggaacaaaccaatgagtccttccctggaccactcatcacagaatggggtagaaaaagggatgctctgccaggcatggtggctcacgcctgtaatctcagcactttgggaggccaaggtgggaggattgcttgagcctaggagtttaagaccagactgggaaacatagtgagaccccatctctacaaaaaataaaaatattagctgggcatggtggcatgcgcctgtagtcccagctacttgggaggctgaggtgggagaatcacttgagccagggagatggaggctgcagtgagctgtgattgtgccactgcactctggcttggacaacagagcaagctcttgtctcaggaaaaaaaaaaaaaaaagaaatgaaaagaaaaagggctactcccagatcacactggctctagatagagattctgaaactaaatgaggtttctctctaaaataatgtttcttaaattgaagttcatggaccactctatcactttgttaaaatgcagattcctaaggtcctgcccagggcttttgaagcagaatctttctttggttgggccggggcagggttgggggtgggagggtggtgggataggaatatacattgtaataagcacctaggttactccttgtgtgtttgtttacatgtgagatctaccgttaatgctttaatttccagtgtagtttccaagcttgcccaactatagagtggcatgaagggtgcttagtaaagatagaagttcctgggcctatcccagaatatccagtggtggggcctgaggatgtgtacttttaagaagcaccctcagatgcctctaagaaatgagtcagggaaatgctgccctagagtgactggccagtgatgtgctcagtgttgttgttggtcacagtaatggggtaggggtaggggttagggaggggcttggaggtatcattgatccagagagtgacctgggttgagttgagcctcccttgtgagggctcacctttggctttctaatgtctccttcaggtatgatggtctgtgtcccgccattcccacagtgtttgaggtaggaatgccaatctgaagagaggaggcaagcccgagagcaaatagcgaagcttgtgggcagagaccagcaatcccagatgagctgtcatgggaccctggataaatgggaagaataactgcttatataacagccagccctggccctctgtcatatcatggttgcaattcctgcctatggttttttcctaaattgcctcctttccttaagacagtctgggtaggtttgtaactcaaatgactttacctaaaactatgtcctaccaccaggagctggcctttggtgacctgtgactgaactgcacctcacataccccccttctgtgcctctgcagctagattcattctctcagagctcatgctgcatcccagcttcccctcggcagcacctgccagtgatgacaagccatcctgccttatgcccaagttttgatctgtggcaagcagaacagtaatgcttcaacctcatgtttcattgacagacatggctaccagcttgacaaacataatacttttagagatgctctcttgagacattcatccttttcccatgatggtcttcttccagcaaagctggacaatgctcctcttacgctgcccacccagtgatgagaaagcagcctacaaccagacagcaaagtgtgtctctctgtctttgtgtggtgcctgcctctgctgtttgcccccatctacaattgcacctgacctacccctcaagacaacactgctttttttcttttctttcttgtaggcattagctgtcatccaaagggtgctataagagtgtgttttatcacatttcagccagcaaacatttgatgatgccagcctcctccaggtgagatattgcagtagactcgggggcattcaaagataaacaaagtccaacaaagaaagtaattcaaatgaagaatgctgtggcattccaatgggtggcatatccaaggaccagccgtgttataaaaaatacgagtcaggatattaagtagagaaaaaatgtcggaacttttggtcacaatatatgtgtgtgtttctatatttgtatctacagcatactgaaatcttattaggaaagtgcatcagtcatgtgcattgtatcaagtactgtgttgccagctgacctaaaccaacttgatcatttacaactgttgggttcttttagtgaataatggtgatttccaatgactaagggaaggggaaggttttaggtctccttactgacaaactcactaccaggaagtaaattacaaggaaagcaaatctcagaccaaatcctgcaacaaactcacacacaggcacacatttattagcacataaacacaaaaagagtaatacaatatgctcttattggctccctcccttggaccctctgccagatacctttcataccatttccctttggcagatacagcagtattctctagggaggatcagctagacatcaaatcagaatcagacaataaatcctctgataaaagatgggacacaggaccaaatggaacttctagactaagttgagtctatctggggaaattcaaaaagctaatattaactcatttcctgctttttggattttttatttaatagggccctatcctagagggtagtgagtatagatagcccttttgccctaaatgcagggaaggacagagatctaatattagaaaatgctggagaaagaagtataggtttttctacagaatggaagaaaattcttgcaatctacacatctgacaaaggtctaatatccagaatctacaaggaactcacataaatttacaagaaaaaagaatcctatcaaaaagtgggcaaaagtttgagcagacacttctcaaaataagacatttatgcagccaacaaacatactacaaaaagctcaacatcactggtcattagagaaaagcaaatcaataccacagtgagataccatctcatgccagtcagaatagtgattattggccgggcgtggtggctcacgcctgtaatcccagcaccttgggaggccgaggtgggtggatcacgaggtcaggagatcgagaccatgctggctaacacggtgaaaccctgtctctactaaaaaataataataaaaaaaattagccaggcatggtggcaggtgcctgtagtcccagctactcgggaggctgaggcaggagaatggcatgaacccaggaggcagagcttgctgtgagccgagatcacaccattgcactccagcctgggtagcagagtgagactccgtctcaaaaagaaaaaagaaaaaagaatagtgattattaaaaagtcaaaaaaaatagttgctggcaaggtgtgaagaaataggaacacttttacactattggtgggaatgtaaattagttcaaccattctggaagacagtatggtgattcctcaagaatcttgaatgagaaataccatttgacccagcaatcccattactgggtatatacccaaaggaatataaatcattctgctgtaaagacacatgcacacatatgtttattgcaacacaatttacaatggcaaagtcatggaaccaacccatatgcccatcaatgatagactggataaagaaaatgtggtacatatacaccatggaatactatgcagcctgtaaaaaggaatgagataatgtcctttgcagggatgtggatgaagccggaagccatcatccttaggaaactaacacaggaacagaaaaccaaacactgcatgttctcactcacaagtgggaggtgaacaaggagaacacatggacacagggaggggaacatcacacaccagggcctgttgagggatgaagaacgaagggagggaacttagaagatgggtcaataggtgcagcagaccaccatggcacacatatacctatgtaacaaacctgcacattctgcacatggatcctggaacttaaagtaaaatttttaaaaaagaagtataagttttttaaaatgcttgctctctataaaggcaatgctggtagagtatgtgaagggctttgatagggtgggccatagagtcacaagaatgcatgagaggggcatttagagctgactgggaagttccaggaaggcttcctggaggaaggagttagctaagtggataaggaggtttgggaggcagagaaagtagcacaacagagggctgcaggcctgatggaggttatgtcatatttctgcaagcaatttggtatgactagaatatagtctgtggtaggaagggagcttagtaaaatgtgaggttgaactgctaaacttggctcagctcataaatcttaaaggtggtagaaagtcacaggatttttgagtgggagaatatgagtatcaaatattcactgtgcagaggtcagtctgccattgtgagaactaacttaaacgcagttttatagcaggcagggaggccagttaaaatgagctttcaggaaccaagaaagagattatgaggctctgatctgctataatggcaagtgagggtaaagagaaagggaaacgttgcagacataatgggtagactcgatttagcaacagattgaatgtggctgtgagaatgaccccgtgtttttagtcaatgatggtgacattcctcaagacaaagaatataaggggaaaagctgatttctggggtgagacgggaggatgaggtaaaaatattaatgtctgcaagacatccaaacatatgagggttgggatctcaggcaacaaacagaggctggagatgggaactgaggttcagttccacagagaaggtggctcatattatgggagtgaatgaagatcatagagaaagtacacaaggtacacagagaaaaggaataagtctaacttcttaaagatcattatcatttaacattcagttccttttgtgtattattttctgtttcccaagctggtttgcatcagaatagtcattctctgtttcaggattttaatgccaactgcagataactctgtctttctgtttgtttacaattgttgaaagccctgactttgaaaatagtgtcttcaacaactgtgttcaaccactttggagatgtggttggagcatcatgtttctcttgttaaagcacttgtctgtgctatgcctcttgttaactggcacatggcatctccctctctagcttgccctgtggtagaggagggggcaggaatgttttatggcttccaaacctagaggagagaacaatgtccaaattttgtgctgccaggatctccatctcctcagaagtcctcaactctcccttctttctgaattacttggtgaggcatctcctgggctgtaaaaagaatttcttaaagttttgatgtcacaaaacataaactgatgacattttatgcacagacttataaaatatttctctaaaaactattttgttaggacaacaaaaacccccaaagtaatatatgataaaaacaaagcaaaatcatttgatcttgaaaggtaaggaaataaaatttctttagtatttttcatgattatgataaaatgattatttattgtaagacttgaaagtagttttccatgtactcacagcacacctgcaggttattcacagaacaccggtattctgtggcacacaatatgagaaacactgtcgtggggatttcattgtgatggtccacagttccgtgctcaccatgtggggtgccattatctttgaatccgaaaggcaattagagaaaagaagagggatagcccagagaactggctagttctgtcctttagtctctactattcttgttagtgatgttggagagagcagggctctagggggccatggaaagaccctgcagagtagaaggcaatgcttgctgattctgggaagcagctgcagcagtgagaggcataggagcagtcattagacaaaaggccgcccaaagagcagagcggccaagccactgatggcaatcggcttagttagcaacaagccagccccaccacatcataggagagggctggaaaaggctggcgaggatgccctggccttaccttatttcctgcgttgtgttttttttttctctctctctctgaatatgtatgcataatagattgttaaaggattttttttctaaaaaaaaaaaaggtaaaatcaggactgtcatacaaatagaaaatgaacgtctgtcaaatattgtgtttctttatttaataaattagggaacaagtaagatgttacaaccagtttaaagaacctattgcccaggctggggtgcagtcgcacaatcacagatcactgcagccttgaactcctgggctcaagcaattctcttacctcccaagtagctaggactatgggtgcatgccaccactcttagctaacttaaaaaaatttctttagagacagggtcttgctatgctgcccaggatggtctggaactgctggcctcaagcgatcctcctccttgggcctcccaaagcactgggattacaggcatgagccactgagcccagccctaattttttaatcagtgtgtattatatctattttgtgaataatgaagaatagaataatgtttataaatacccagtatagtgcttagcacagagcaagcattcaatagtgatagtatatttttactattaaaattgatcattttaataatgccgaaacttctgtttatgtaaccaactgttgccattttcattacaagtataatcagctaaaattccttttggaattttggatataaagttttaaattatgaatagataaataaatagatgccaaatattgagtctggcaaaatggtgcttattatgtctgtgcttgttccaaaactattgagtaggcctatgttttgctttgctttttttctttcctaaatactagacataagtgcatccctgtccctagacatggaaaagggttgtcaatgctccctaggaataaaacacatggcacagaaacttttatcaataactacttatgaaacagatgattcaacatcatgagtcattgactgtcctttctatgaatccattgattcatagaatggtaagataggacacttcaggaaaacaaatccattcattcctttacttttgagataggaaactattattcagagaagttaagtacattgtcgaatgccacatagccatcagcagagctggagccagaagccaaatctgctgattcctaagttagttttctctgaattcccctatattatctcttcatctctttggccatagctaaaaaacagaagagtagccttcctctgtatatactgagttgagaaatcaagccccatagaaatggcatgcaagcttccctgcagtactcaggacaaaatggacatgccagaaaaggaggttccacttgagcagagctgagcaaccacagcccaatgtggaatgaacgacctcctcgtctgctgcacctcatgatttattagctgctactggtggccatgaaatattcatccactctttcctagagttactgcttcactgcatcaacaaaccattgctttcccatctgtttaggtgtgcagcttggagaagaaaagcttcacacaaaatggaaaagaggcttattttcatgtttagcccagaggcagaacaccaattcacatcttggttcattgtcgttttcccagaggcacagtcagggctgactccctaggctcctgaacacagagaagccctgtcactcatgtaagcaaaggttgaatagctagaaagaagagtgaaagacttcatgtggttggctggctggttgtaacactcccagctctagcctcagcttattttgctctgtaagcagtaaagcggggcacaaagagccagggcttgcctgacatggaggctccttgttgccaaggcctagtgtcaagcaacgaacctgagttgctccatgcagcctctcctttgggattagaagcactgcttataggagcagaaggagttaactctgccccacttccctactccctcttctttttaggcttcatcatagacttttcttctgcataccccttagctgtggttgctacccttcagccctcttctcactcgctgcatatattccccatagatgtttgtattcatgatcatgcattctccctccaccaatagtcatttgtaaatctctctttctccagcttcagatctataggttcaactacaccatctgtctataccaggatagccaattgcccttcaacctccataggtcccaaactgaatttattattactaccctatgatcccttcccatcctccattcacatctataaatctttcagaaaagattttaaaaaggaagctttcttattataaattcatatgttgacattgcagctttgaaaccagtttcttttaaaggtagttaattagaaacatatataaatatttcagaaaagaagctccatcatattatcaaaactggttgggagtcatccttgattctctcctctttctatttatttttttatttttatttatttatttttttagagacagggtctcactctgtcacccaggctggagtgcagtggtgaaatcatagctcactgcagcttcgaactcctgggctcaagccagtctccctccccagcttcccaaaatgctgggattccaggcatgagcacttttcctggcccctctcctctttcttatctccatgtttcagttatctatttactgcttattattgaggcaaaacttagcgacttaaaaaacaacaaccaccgtttattttgttcatgaatgtgtcatttggacaacctcatttttactccacatgatgtcagttgggatatcttgaccgaggacccattttcaagacagctcactcacatagctggcaagatggtgctggttgtcagtggggagttcacccagggtatttggccaggggatctcagctcctcttcactggggcctcttcatggggctctttgggctttctcacggcatggtggctgggttccaagaataagtgtttcaagagacagaaagtggaatatataggtctcttaaggcctgggtctgaaaactggcacagcattacttctgctgtattctattggccatgtagtcacagagcccattcagactcaaagaggaataatacagaccccagctcttgaggggaagtgtcaaataatttaaggctatcttgaatccaccacattctacatccaattaaactcttgcaatcctctccctgtatccacgccttttcacattctgttcctttggtcttgaatgcctttctccaccttgtcctcttctctgctctttctccaagattgtgctcaagagttgactccccaaacctttctcaatccctcctccagaagaacaccctatgttagcatttattattttgtgttgcgattgtttgtatatctttcctataagactgactgaattattcatgacacagtcatgaaagactatgtcttattcatttttgtatccccagaaccatggagatgggcagagtaaaggacctcagcaaacatttactgaatggataaatgtttccttgtttcaatctctcaatagtcctgtgaggtggcagaaatggagtgttattcctatcttactgcactgacctccttattgtagataaaaagaaacagacagagcaaaaagtaattgcattacccaaagtcactcagccaggaagataattcagtatagtcaataggaattcagttccccaaagtaagttgaacatcatagatttaggcacaaagttaggaaggcttaagaaaaagcccaaccatgaatggacttagttgtttagcagaaaatgccttcgaggttaccctactagtctatgtatactggtgcctactcagggggcgcaattgattttctgtacactgctaggaaactaaaaacaccagaaaagatagaagatggtctgatagaatctgttaaagaagagaatgggcatggtacagtgctttgtgcaaataggaaatgtggatctaatgtagagtcacaaaatgacagtgggagagtgtgagttcacagtaattctcaaatgactcttcagggcagagaaaggcagctattctcagaatgagaggctgtttctaggggcccaagtgtttgggtcaattggataattcactggagttaaaaccttagctgcaataaaacacccctcaaggacagctgacatcctgtgctctgatttcatacttaacaagccccttctgtgcactagtttggtttcttacatattttttattacaaaaatattcccttggtagtggacatgggcattccagtcaatagaaagaaactttcttattataaattaataatatgttgacatgctttgaatgtttcttttaaatttagttaattagaaaattaactaaatttgaaaccagtttcttttaaatttagttaattagaaaaattctcctgcacacagatgaatagattttttatttgagttttttgattactttagttttttaaaaattacacaaatacttaatactgtattagtccattctcacattgccataaagaaatacctgagattgggtaatttataaagaaagaaagtttgattggcttatgtttctgcagactgtacaggaatcacgattctggcatctgctcagcttctggggaggcctcaggaaacttacaatcatggcaaaaggtgaagtcagagcagataatgtcttacatggcaggagcaggagcaagagagagggaggtgctacagacttttaaacaaccagatctcatgagaactcactattgcaagaatagcaccaagtggatgatgccaaatcattcaagaaggttccgcccccatgattcaatccctcccaccaggccccacctccaacattggggattacaatttgacatgagatttgggtggggacacagatccaaactatatcacatatatactttcttattgtaagagatccaaacaattaaagtatacttgaaaagccctttcaacatcaagccccgtcctctcagcctctgagataatcagttataagttcaatatgcagccttcagtcccttttctatacacttatttatagagatgtgtgtatatttataaatgtcccttttaattttatacaaaattgatcgtactatacattttcctttttcatataattccatcccatgaagatccttccacattaatttttctacattctacaagaaacaagaaagctctgccttcttgtttcttatggctgcatcttttaaaaaaataggatgtattattcatgattcttcagagacacaggaaagataggatatatatatatatagagagagagagagagagagagagagagatttactataaggaaatgacttagcagttatggagactggcaagtcccaagagccgcagagtgagttgcaagctagaaactcaatggtaggagagccagtgggtgcagttccagtgtgaaggacagcagacttggaaccaggaagagccaatgtttccatttgagtttgaaggcaggaagagagcttatgtcccagtttgaaggctatcatgcagaaaaaaattctctcttactcaggaaagggtcagacgctttgctctattcagaccttcaactaattgaatgaggcccactgacattatggaaaacaattggttttactcattctacctgtgtaattttaatctcatcaagtaatagcctcacagaaacactcagaataatatttgacgaaatatctggacaccctttgacctattcatgttgatacataaaatcaaccctcacacaaggttatgtaattattccacttttaatgaatagcttttttatttcttttcttttttctttctttttattttcttttctattaggaacactactgcaataaaaaatatttggacacacgttttgggtacgtgtgtctatttctgtagaatatattcctacagctggaattgctgggtgtaataggtagtgtaatgcccctcccccaaaatgtttacatcataatccctgggacctgtgggtatggtaggttgcatggcaaagggaaattaacattgcagatgggatggagtctcctattcagctgaccttacaatagggaaactatcctgaattatccaagtgggcccagtgtaatcataaacatccttaaaggtagaaaagggaatgaaaagacagaaccaggaagatggaagagtgcaaaggagtaggcctggtgttgctggctttgaagatggaagaaggggccatgagccaaaaaatgtgtgcagcctgtagatgctggaaaggacaaggaaacaggttctcccctagagactccagaaaggaacataaccctgccaacaccttgattttagctcaaggagactcatttcattcttctgaactacagaactataagacaatatacttgtattgttttaaaccactaaattggtaatcatttgttatagcagtcacagaaactaacatactgggaattggagaatgcatattttaaaaacatgatgagtaatgaaaatggctatggctttcacacacacatgagaaggtttttcagtttacagttctatcaccagtgtaaaaaaaaaaaaaaaaaaaaaaggtcattttcccttatcttcaccagctctggattttatcaatctttcttagtaaattaatgggtgaaaaattattattactttgttgctgaagttggggatcattttagtgtttacttccctatttacaaattggatgtttatctttccttatttttatgcaagtttggtgatctttgttattgacttacagatgctctttagatagtatggctctcagtcctttgcctgatatatatgttgcaaatattttctttcaaccaatcacatctctattaactccaattatggatcttttgttacacagacaaacttcataactagagttttgtgtcttggttaggaagagaaagctaatgtcttaactagaaatgctgcagatgccagcctgagctgagtcataaatagcttgagtgaccttgggtaagcccaacactcctttgatcattagttttcttatcaaaatgattagcttccttatcaaatttattcatgcaaaaattatttactttgaatccactttatgccatgtctagatgttatagagacaaatgaacacaatattcaaggaatatacagtctaatgggagatatggacaattaaacagccataacaataaccatgagaatggaatatgctgtgatggaggtttgcgcagaatcccatgaaaccccatggaaccccacatccagaccatgaggttttataggagttgtccaggtgagataggggaataagaagggcccattggtcagagggagttacaggaacagagacttgggggcaagagagaggaactacaacaagttcatccaataggggtgatgatgttggtgtgttatgaatctggaaaggtaggcggggactattgcagtgcctttcattctgtttggcctttttcctgaggacattaggatgcctttaaagtttgaagcatgggagtgagatgtggactagcctttagtaaagatcactttggcatttctgtgaagaggataaaagagggcacagtcagaggcagggaggccagcaaggaggctgttgtactggcctgggaaggagatggccaacacaaatgaagcagtggggaggagacagacacgttggatagctttgggagatttgtgcccgtgtttcccatcactcatatttgttgtgaatcaaaaacaatatgtagcattgttccacgtggaagttttttgtaaactaaaaaaattccacttcttagtggaattgtaagcactgtgacaggtgagtggagatagttctgaatacagaagactttccaggaagaagaaatggtcactatatttaaagtagaaaatcattgtgtattcaaattgtacttactttgtctttcatattttggttttctttatatggctgtgaatgtataacctaagcatcagctcatctgccctcccctttcctcctcccaacctcttattctttttgattacattcccatgatatatgttagcaaagaccagggcttattttagtctttcctgagagttctaactgccactctgcaattggccaccagctatctcccagccattcactaccctcactgcacttgaggacaagtgtctgctgcctcagccaaggagccagtgaagatgtgaatggggagaaagaaaactctccaatatttctccatccctttattcttcatatcagcacttatcaagctgatatggggacttcatactttactgaagcactaaattagacaaacgaaattacaataaagaagagaaaattattcaaacaatagactcactgtaattttcaccttgctctaagggacaagtgcttcttccccccactccacactcatcctcagctctgcttctattttctgttcccaagtgagtggctgaacagtactggagagaaaacatgccctttgtcaggagcaaaccttttctcatcacagtattgtttcctcagctctctgtttcacttagaaatggaaaaaatattgaatgccatttcccagacccactgctggctaatagcttcaactgctaatgttttatgaaatctgtcccagttgatgtggtgcattaagcagaacccactgcgttgactttgctcctctcctcctctctcccggttatttggcctgtgctgatatgtgaagaagctctgcaggtccaaagctctgcctgtgcacagcaacggcaatgggaaatgactgccatctgcatgctgccattttccttttggtgctgacatggattctttggcagatcttccaaagaaagctgagtgtgttgacactgtgagtttggttatcacccactttcctaggacaaaggctcaaggcaacccccagtaacatttggttgatattaatttcatctatttgtattcctcgtggttaaagacagtaacagcattggtgatgtggcatcaagatgcacagtcctacgaatggggcatctggcctaaaatggcaacaggtaattggagaggacagaactggaaatcaattcagaaagctttaataataataatcttaatacatttacaggtgctctcttatttgatccttaaatgaggtaggtattgtttttatccctgttttaaagataagaacactgaagttcaatgaccagaaacttgcccaaggtcataaaccttggagggaggaggtatggatttaggtgattcaagccctaagagttccaatatcttatctggatcctgttgttaaaggaaaaaatgttcgtgacatttgttaagacagtaaggcagattttactcaagacaaacgtaacaggtgtagggactaccacagtggggtttagcagtaggggagacagattgggttcaactctgaacataagaaaaagggggaatttagagtcaagggggtggaggctgtcagtagatggagaataactaagagggtagggtgatactttgctaaactgtcctaacaggattcttgttaggggcaggcaagccttggtaatcagatataacctggggatgatgggagtggtgaagaatttggtcagatattgaggatgatcagatattgagggtgggaaatcctggccaaaccaacctgacaaaattcttgctgaaactggatgatgcaagaaaggacacagaagtccaaaagtcaaggactaccttggaagaggatagtggtgacaaagagtctctccttgaccaaattttagtcaggctccaccactgtgaccctctgcccatagctgagggctgcagcatccgggaaagtaaggttcagtgagttttgagtttggtcgtgaagaaggacagaaacaagatctggcaaacagaaagaagtaacatttgtttggagatggtggtggaatgggaatgatcctttattaaatcctgggcattaggtacatctgatagggaggaaccactaacactcaagatcctcctgaggcagcagctcccaagtccaccattttcctctgggaacttttgtgtttagtctgtaatcagctgagcattaagggcagcatcatcctggaaagtaagtaaataggttcaggtgagttttgagtttgtgaaggacagaaacaagatctggcaaacagaaagaagtgacatttgtttggggatggtggtggaagggaacgatcctttattaaatcctgggcattaggtgcacctgatagggaggaggcagtaacactcaagatcctaccgaggcagaagctcctgagcaccgttttcctctgggaactttggtatttaacctttaatcagctgagcattgtggattgctagcctctacaatccctacatggtttccagttctgttaggaattgggagcagaggaaagacaggtctgaaatgggctgggtaatggaaacctgactctttctcttagagctcaaaagagtagcccatgtcacaaacaggagcctcagctgggcaccgtggggctatttgcagcctgacagcctctgctgaattattgatgcccctcagtacctcgggacctcctccatgttaacaaatcacactgcatattaaaatttaaagaggcaaatgagggcaatctctttccctattatttccctcttcttttgccatctgagctctaagttttaagtcaatcagcctgaaaggcttctcttaggagatggcacagctcagagagccaagcctaggaaaggaaaactagaggccatgagtgggcccaggactgagtcctgagtcaattaatggagtctgggggctctgggccaggtgagcactgactctctgagtcgtggaaacacctgagaaaaaaaatctgttcattcccttcttacgacagttatgccactgcccagtgtgccatatctcaagtgtttccctaaagcagaagataaaaacttttaagttgtggtccaaatttgttgttgttgtttcttagtgaaaagagttgcaaaaattttaaaatcagaaggttttacctaaacctgtttttttttatatttgacgtgctattttgcatgcaaatatagtaaaaactgttttactacctagattaattattccttttattagtataaatgaccttttctctttgttttcatgcatttctcctcaagttctactttcactgaatgtaatttcttcttttttgtttattattattattattattttgagacagagtttcactctgttgcccaggctggagtgcagtggtgtgttctcagctcactgcaacctctgcctcccaggttcaagtgattctcatgtctcagccttctgagtagctgggattacaggcgtgcaccaccaggcccggctaatttttgtattttcagtagagatggtgtttcaccatgttggccaggctggtctcgaactcctgacctcaagcctcagcctcccaaagtgctggggttacaggggtgagccactgcgcccagccttatttcttcctttaaacataagattttctgacttctcttcagcgatctgaagacttgggctttcatctgcacattgtaccccttactggggatgacagtggctagtccttcaaatgaagtatggcctcttaaccatggttcttaccatttcccattagtggttgaatttgcaacccctgatctcaagaaagatggcaaacaagtttttctatgtgccaactcaggtctattagcaagactgcctgtagcaccaaaatgaatctgaggtcagctgtggtagattgctgtgtactttgcaattgtgcacccccccttccctctaagaggattgcatgtctctgacctttgccatgtgaccatgtgcagatcattcaagcagaagtttttaagaggcatcataagttgtcgccacctctctggcgctttcacattctgctgtgggaatagcacaccctatgatccttcagcctggatcccagaaggaaaaggacacatggagctagtagctgatttacagcttggagctgagccacagtctggagcagtgcttcagccaacccacagctttcagtaacatgagtgaatagcaaatgttgctgtaagccacagagaattggaggttattcattaccacagtaaagctgaccaatacagcaagactagtctttatagaaaagaatactgaggtttttttttttaaagcagcatttttctattttctgagaagaaaaaattaggtagcattaggaaattcctgaatattaattttaatttccttcaatttaaaaatataacttccaggattctgaaaaaatcatggcattggcagtaaaataactgagttggattcctgaatccacacttatgaccatgttataaaatattgaatgacgttccttttattaaagataattatctttttttaaaaaaacttcttgtgtatattgaagttgtagtatctgtcaatttcatttctaacagtgagcagagaatatagatattgttatacaaagggagtctggcatctgatagggttttacccactaccttattgtgaggatcaaatgaccttgattgaaaatgctctgtcagccttacgtgattactagtgatttctagtttttgctagtttcgtaaaaaacggcatctctttctcactttctccattaggaggcaggttaggcatgactatcaccatctgacagatgcaaaggcagatgaggtggcaaacgggtcagggccggaggggatttgccagctagttaagggcagaactgagaggcagtcagtttatcacggagtctcctgaccaccagtaatctgtccactgccttactcaaaagggggccaaaccaggccttatgagcaattttgctaatacacagatttccagtctaatgctatcagttatcatgaggcatgtgctggtttcttggaagcagtcaaatctaattaacctcaatatctactttcatgtttaccttttacatcctttggcctctggcattgctttaatttacatttttcagtttgtaatgtcaatgttcatcagcccctttcaatccttgattaaccattttgtggtaggcatgctagttattcttttctttgttagagacaaggtcttgctctgtcacccaggctggagtgaagtggtgccattgtagctcactgtagcctcgacctcctggggtcaagcaatcctcccacctcagcctcctgaatagctgggactacaggtgcaagccaccatactcagctaatttttaaactttttgtgaaggtggggtctccctttgttgcctgggctggtcttgaactcctggcttcaagtgatcctcctgcctcagcctcccaaaggtagtttattcctaagtaagaaaaaggtttaatttgcacatggataatactagtatgcatattagtattatctatatacaaattatgaactatgttcatattagagaacatttatggtatacaaagttaaactcccagagttgggatttttatacttcggcatcattcactaattttggactctctagtctgatacaacttcaggtcatccttttgggcttcaaaggaatttttatccatctaaaaggcatctccacctcaatgtcccataaacaatcagacagctttgaaggagaattacctaaactaagtgcctgctagctgatacatccccttttaggagatgttgatgtggggcaaaagctgggtcactggttagaaatctgctgctgctgcaaatacacaatggaatcctccagaatttggggatgccatgtcagttgctcagtatctgagggcaggcaagctatgtggaacggtctttgctttggaaccccactatacatttatcattttcatttcctgtgttctctgctgaactcaaactccttttttgaaagtaggcttatgccaagaggtcaaggctgcagtaagccatgatggcaccagtgcactctagcctgggtgatggagtgagaccctattaaaaaaagaaagaaagaaagaaagaagagaaaaagagaacgtaggcttatgatggggctccattggagagtagacatcttttccattgacttaaaactttctgtgtgtgtgtgtgtgtgtgtgtgtttaaagagagtctactgatgcagaatgaagaaagctagagaccaccaggtcatggagaaacttcctaggggtggagaagagctcagaagaaccttttggggtagaagctgtgaggccagatgttatccagtttgccaagaaaccctcacctagaggcaccaaattattgcccccagctttggcttgtaatttttgcaacctccctaatgttaaggtttcaagacctgcagtaaatttttctcaggggtggaacatgacgacaaggggttcctcaaagccctccctgccaccaagcaactatcacctagctctccacttctcttccccttcattggcatcgcctatctcctactcacaagggagggagctccctgtggaaggggctctgaccccacacaccctcctgccacggcatttctagtcaccctatcccaagaagctttgcaaacttaatgcaagatggaccaaggctgggctgccctgcatgtcaagtgtgctcagcaagcatgtcccacctcatccccttgccccacccgcatggcaaaaataattaaaacaccgcttctactatttcccagataacttggcatttgtcaagggatttcatgcacgtgacctcatttatttttacctcagcagcttttgaagcagggaccatgactgccatcttaggaatgaggaagcaaaacctcccacagctttcaggacttgcctgaggcctccctgctgggaaagggcagagctaggacttaagtctggcctttcactttcaggcccatcttcccttccctagttggcctccttgggtctatgaggttgagtctcccccgtgtttcccccagttctcatttccctcctcccagttggctccacaccagcctcccaccacagagtagcttcagacacactaggagtccttccacagccgtattcctttttcgccctagtctcctacaaagtatatattttaaagcttctgtttatttgacagtctcccctgatggagggtagaggaggtgatggctttctctcttcctcagtccctcagcaaacatactataattgtgtgacttcccttccctaagattttgcaatgactccttacaaccaatctcataaaaccagagtcattaatccatcatggaagcaactcccttctaacttttttcttttcttttcttttctttttttttttttgagatgcattctcactctgtcgcccaggctggagtgcagtggtgcgatctcggctgcttgcaacctctgcctccttggttgaagtgattctcctgcctcagcctcccgagtagctgggattacaggcacatgccaccacgcccagctaattttttgtatttttagtagagacagggtttcaccatgttagccaggatggtctcgatctcctgacctcgtgatccacctgcttcggcctcccaaagtgctgggattacaggcgtgagccaccgtgcccagccccttctaacttatttctattcttacctctcttctttacgaactctgtgttctggttgtttctttggtctgtgtctcccactttccgctctgaattctcattcttcgaggcttaaaggcccttccttccacaggtgctgcccctgcccccctcccctcctcaggcccagagcacttggtttgcgccgcctatcagacatctcactctggcttgtatggttagattttacgcatgtgtatgtgtgggtgtgatccccaccactagtgagaaaagtctttgagggaaaggatcccctctcgtacgtcccctcctgctagaggaaggtaaaggcatagggaaccacatggcttggagaaggaatgcagagaagctgagaataaggcacaggtgcataaacttgcacaataattacttcattaatatcaaaaccagtgtgaaacattctcagtccagagggcggggctgggccgggctccttcctggagcctctggccagcactgcaattcctctgaggcacagggctctcttgatatatatatatatatatatatatgtgtgtatatatatatatgtatatatatatgtatatatatgtgtgtatatatatatgtgtgtgtatatatatatatatatatatttttttttttttttttttttttgagacggagtctcactctgttgcccagactggagtgcagtggtgcgatctcggctcactgcaagctcctcctcccgggttcacgccattctcctgcctcagcctcccgagtagctgggactacaggtgcccgccaccacgcccggctaagtttttgtatttttagtagagacggggtttcaccatgttagccaggatggtctcgatcttctgacctcgtgatcctcccacctcggccccccaaagtgctgggattacaggcgtgagccaccgcgcctggcctctcttgctatatttctccagtccctgtagctgtgcaggaggagccacgaccactcgggaaccctcgtctaatccgacctcccatcctcactttcctctaatggctttaggggtgctgacataacagtacctcgcattagccttcatgtctgttaccccattttatgctagccattcctaccttagacatgaaggactgacatggagaaattacatgatttgccatagctgttttgcaatacaagagagtaaagagaaaagcaggaaaatatcaagctctcagcacataagctgcccttgaagaagtccacagtaaatgtaccttattttgtgaccatttcccactgacccccctcagttcctcacccccagcctgcagaaaaatgaggtttccccctatccctagcagggcaagagcccactaacaggcttgcgctctttcttccagaccagagcaattcctttcccttagtgaagccctctgggggccttctatcacaggtacaagaactgaaacatccaggctgtctggaatgacttgctcaaagtcactgaacacattggtggcccagttaagatttatactgaaagctgctaatgacagtatctgtcctccaaccaccagtctgggccgatgggtatctgtttataacatgcttttctctggctcccttgacagcccctaaccaatgttttcttatctaattacattccatgtaatctgctcctgcagatttgccctcattgttgccagcatttacagccttttccacacatttcctagaaaatgctcatgtcctgacgttaggtaaatattgtcataggtaggagagctctctggtgtgttgatctatactcccgtaccactactaattcttcaaaaggaagcttcccagaagccacaagctgaagaagccacttcatctttagaattggttttcacttgctcagtgccatggagtgttcagtgagaccaggatgtcactgcagcctcgtggttgtgtattccaggtgcctggcctggacgggcataggagcaagagctagtgggcagttgtcggggtgggagtggaagaaggagttttcatacagggaaggtcaagggacgtaagttctattctgcagtgaacattgtatagggtattagacaaagcgtgtaccttgtctgtgttttagtttcttctttggtataatgaagaggataatgactttaaattgcttgccttgtcagtaagaacaaaatatatttttaaggttttggatgtccaggtaagtgctggcatatgattagaatggatttaagcctttgcgctctggctatgcctcttaatcctgagatcttggccaaattacctgagtccatcaatccccagttccttcaaccagaacaaggggaataaaaactagtacctacctcatagcattgttgtgaggtttaaatgagtcactgtttataaagcacttaatgtatgcctgcatttctctagtgcctcagtacagtcctcacagtcggagcaaagatgacccagcttaaatgtctagggttttgagtctagtgtattgatttcctcatggcattagacaagctgatctaaaattttatatggaagagcaatggacaaaggcagtgttggaaaagaacaaagtggagacttacctcaccaggcatcaagactttttatagtgtttgtattagggttctccagagaaacagaaccaagaagatatatcaagatatatggaaagggatttattatgaggaattggcttatggggttatgaaggctgagaagtcccataatctactgcccacaagctgggggcccaggaaagctggtggtgtagttccagtccaaatctgaaggcctgagacctgggagtgcagatgtccaagggcaggagaagatggaggtgccagctcagcagagaaaatttgtcctcctctgtgtttttggtctattcagaccctcaacagattggatgaggccccctgacattgatgaggacaatcttgtttacttggtctactgatttaaatgttaatctcttcagaaaaccttcccaggcacactccgaaataatgttttaccacctatctggccatcccttagcccagtcaaggtgattcataaagttaaccatcacagagtttcagcaatcaaggcagatggtaccaatgtaggaatagaaaaatagacaaatagacttggttatccatatggagaagaattgaaacacattatacacacacacaaaatcaaatccaggtgtatcaaaattaatacactatgtgaaaagcaaaaatatactttagaaaaaaatataggaaagcatcttggacttaagggctaggaaaagagtccttagataacacacaaaaaacaaaaaccataaaggaaaattgtgacaaatctgattgcatgaaagttatgtttaaaatttccttttaatgaaagataccataaacaaaaattaaaggtaagcccaagaccaggagaaaggataagaaatacaaatatttgataaagtcctagaacctggattttaaaaagagcaactcaataatgaaaaaaaagaagctggcaaaacataggttaatgtttaatagttgttaattgtcaataaatacatgaaaagatgctcaaggtccccagtaactaataaactacaactacaaccacaataagacaccattgctcactcatcaagttaactgagaattgaaaagtataagcaagagtctagataggtgagaattcttccacattactttgaacttagttataatcactttgagctagaggctccacctctgggcatataatctcatgaaactctgtcacatctgcagagaaggtgtatagaagaatgttgactacagcattattagcaatagaacaaaataagaggaaacgaactgaccatcaacagtagataaataagctgtgctatagccatataagtataatgaaattttgtgtaagaactgaaatgaatgaactaggattacatgtatcattaacatgggtaaatctcaaaaataatgaattttaaaaaaccaaattacagaaaaataggtacaataggacaccttttgtataaagtttgaaagcatataaaacagcctatttgttatttatggattcacacataagacacatatgtgaagagtagtataaagcatgaataggaatggtaaacatgaaatttaacatgatggttacctgtagggtggcttagaggaggagcacgtaggaggcttcaattactttatagtgttttattattttacaaaatctaaagcaaatatgtcaaaatgttaagattcaataaagttagatggtgggcagacaagtgtttaattatgttattttctctcacgctgtacgtatttacagaattttgtaatccattttaaaagattctaaattgtcctttacttccaatacaaagaaagatgaaattataactatatgctgttaaagttttgatgtatggcctgccaccctctttcaacagccctggacaactattcctagtacttagcacagtgcctggccccagaagagtagacggaaagaataaaagaatgaatggacctgtccttggaaatagaggtgtggccacatgtacgctgtgccctttctgtcattaaatcacactttcctttccaaccatctcactcagcctgagttgccatccagtgtaatgattcagggtaattgtgcttagggacgattgctagtgggatagcaaggagttgcaattcagccctggctgtgctctgaattcattagtgaattcattttccagcttcgtgtcctgctcagaagaatgatcctctctccaagcagggcattgctgtctttctcatacttagcaataacaaccaaaaacaaacccaaggaaataaaatcaccagggaggctttcctctttaattaaggagttctaatgagtcacagtctcaccatgcatgggactcaattatcctttataaataggggattgtgaatgtgggatgtgttttcttttgcagccctgctgctatttctcctttgtttccttctcctggtgctgctgcttctctctgtacacgtgtatgcacatatgtgaaattgatgacataaagaagatccaaatctcttcgcctagtcaacttgaagttgtaagattccttgagtgtcattgagaaatgtaatagggagtgggtggcttggctggtagcttaaatggtgccaatgattgtaaagtcataggtaccatcccccaaaagccagaatgatttcctctgttctgctgacacagagagcatcacaaatcttggcaaatatatcattggttacatggttgatcagacaaggcagggaggagtgaatcgtgtcaaatggaccaccaccactgaaactcaaacctgcccccacgctggtgatttttgtggattcctttaagaggaatggtgagtgtcttctaagagtaagaagggttagcagtgttccagcttacctacaaaatgtgaaactgagaaagcccactggggcgacttccatctttattgctaaagagtaagaaatagagacttggtcattctcactgtcatttttgtgatttttctgaacctgaaggtatataatgaggaaaaatgagacaaattcaagcaaagagaaatttgggcagaatctctggagggaaaaataatcatggtgaaatccattagactacgtaatagtcatccccaagggggatgacgtaagcctcatagttgcagtcatttaaatgtagactgaaccatgcatttgtgagcagaccccagggaacaatcctgcattgcacaggggatagggaaagcgataggccagatgacctaatagatcttctgtaacttaatttctagggttgtgggatcctaattaaaatgaactatattgcctgttatgaaccctccatgttaatattctgtaaggtctccaggcaagtcaagggggtcttggctttttcttatttcttttgagccagaacccacaggctgccttaagcacctagctgctgtccatcacttcttatagctgacaaagcttgacttaaaaaaaagtttttaaagaaaattacagcacatattatgaactaacattttatacaaattaattgagtgaaatgagagaagtatgcttcattctttgacctgtgataataaatattcttccggtcaataacacgacggtgagtcagccctgcgatggaggcagttgtcgccatataacacacaggactccaatctgcttcctcacatctagtgctgacttttccttttagctttaatgatgtttgaaagggaatattgacgctggaaaaatcttagagaggctccaccaatcacagacgagcgcaattctccactaatgtgggcctcttttccttgacttcctctagacatggaactccactgaggattctcaggcagggccactggcgagctggccagagctgctctgagaaccaccagtgaagggcagagggcactttagccccaaaagtagtagcagtttagggcaggtggaagagacgggtggttcaattgccccatgtggcgtttcaggtgggccacatgggtcaattgagtcttatcaacttgtgtcttatctagcaattgaatgccattgctagataagagtggtgacctccagctggtaagttattttatcagccttgtcccatcccaaggatccccaaaaaggccacagaactctgccagcaggaagtagacaccggtgtgcatcagagaatatcaaactctacctattttaaatttataaactggattctaattagcctgcagggagtttccatggaaattggagatatcactttgcaacagtataagatcacagcatcaagtagacgggaaaagtggaaaatctctattcttttaggaatcagctggagtcacctcgctatgaaattgtccctgacccaggcagattccaggtgttcccacttccattacagtatttgtagtatgtaattgtcagtgtacatatctacatcccgcagacgggggagacactgtcattgtttctgtttttctccagaatatggctcagttcctgatacagaagacacttaaaaacaacaacaacaacaacaaaacttgttcgattattacagtgatgtcttagaacattggtttcttcatctataaaatggcataataatactaattcagttggctgttctgaggattaaatgccagaacaaataagtacttacaacaatgcccagctcctaaataatgtgtagttcctatccccgcttatcttgtgtgagaggattatttttggttttgataggtatcaggcaaaaagggttttttaaaacagcaaataaatcagaatattccacacttgtagtctgcattttgtgttgccatttgattgggtttctagactaggccagcattttatattctgtaagcatggtagaggttatattatctccagccccaaatcttggacattaaaccttttcctcattgctcactcggctagatatacattattaataaatgagatttctgagatgtttagacttgattctaaacattcatgaaataaacttggagaatgagtaactatcatcagtgatgataaaaatgagcttgggaagataccctgtgtgttgattctgatgagaattttacctttattggacaccagaatatttccaggtattccctgaaaactcccctagagatgtcttaactcttctttgatggttaatattaagtgtcaacttgattggattgaaggatgcaaagtattgttcctgggtgtgtctgtgagggtgttgccaaaggagattaacgtttgagtcggtggactaggagagacagacccaccctcaatgtgggtgggcaccatctaatcagctgccagcatggctagaatgaagcagacttgctgagttttccgcccatcttctttctcccgtgctggatgcttcctgctctcaaacatcaaactcaagttcttcagcttttggactcttggacttacaccagtggtttgccagggactctcaggccttcggccacagactgaaggctgcactgtcagcttccctacctttgaggttttgggactcaaattggcttctttgctcctcagcttgcagatggcctattgtgggactttaccttgtgatcatgtaagtcaattctccttaataaactttcctttatatatacatctatcctattagttctgtccctctagagaaccctaatacactttatttttacaaaacaagaagtgcttatagaatgacttttcaaggaggtttatgcgatcaaaacacactacagtgtgatgctgggtttgcagggcgaccatggaactgttgggcagaaactcacatatagaatagcctgctaccaaccaaagccaggtttcatctttcccaccagcagaatccacctcttccaaatccacccacatcattgcatggcctgcaggtaggcttttcagcttcctctgattgtcataccaggcactgggcctataaaaagcaaagcggaggctgagaggaggcagaggcaaacactgaaggtgtttcagaggcctattccccctgtgtatggtgagcacagcacctggcaatggatcgggctctcccacccaagccccatgcccactctggccccttacccctcagccttggtgccctgggttccctagttcttctgtggcctcgactcccaactgtgtgaaacctgcattgtcttggagtcagtgagctactgccttctctatttcctgcttttaattccagttgactcttgacttacaatcatgtattcttactggaattgcctccctgaagggcagaaattccctttctcctgctcttttgccccatctgccctctgctggccatcgataggtactgcggtcaaccctgaaaagccgtttttcccagtagcatgtaccgaagctgtttgctctttcctaattcagacgctttctttttcttctttttaaaattttggttgcattgcctcagagtttttcaaagcaacacggaaacaccctttctctttccatgtccccagtgaccatgtcatggatctgccgtaaagcatctcttacagtagtggtctccaacctttttggcaccagggaccggtttcatggaaggcaatttttccatggaccagcggggtgtggggatggtttcgggatgattcaagcccattacatttatcgtgtgctttatttctgttgttatcacattgtaatatgtaatgaaataattatataactcactgtaatgtagaatcagtgggagcccctggcttgttttcctgcaactagaaggtcccatctaggggtggtaggagacagtgacagatttccaggcattagattctcataaagagcctgccattaatctacagcatcagtgttacgctgtagaatggttcagaatcttagccaccgagatccctcgcatgcgcagttcacagtgtggttcatgctcctatgagagcctaatgctgccgctgatctgacaggaggcggagctcaggtggtgatgctggctggcccacactcacctcctgctgtgcagcccggttcctaacagataccagtccgtggccctgggggttagggacccccgtcttacagcatccagcggggccaggcacttggttaagtagatccttgatgactgaaacgtgacaatgctgaaatggctgtggagtactgtttggagtttgtgggggtggggtttgtaaactggagaactttatgttagagtttcttattattgacatttgaggctaaataattctttgttgtctgagtctctcctccacggtgtagtatgtttcgcagcacctctggcctctaccctccacgtgccagtagcaccttccccaagtttgttgtcctcacagacaaccaaaaatgtcttctctactcactcccaaatgtcctgggggggcaaaatcactcactgcggagaaccatggcattagggtgatggagtagaaagcctgctctactcagaaggacttctaagtgccagaaggtgcaggtctgctctctggggccactcagtgctttgaaggacacctgatttattttggagatggacacttaactgctgaatacactggcatgggtgggtggtcccatcgagagtttttctcaaaggttttcaatgactcctcttgtgttctctggcctatcctactccagctctcaattctgctaggcttgagttccagcgtcagagcctttctgagcctctcttctcagtcttagcctcccctccttccctctctctccacccaccttctggccgtctgggaagcttcagcttcatcctgcttccccagcactgctcctccatccacctttttttcttccatagattcgttaaaaacatcttgtctgaaggcagttctcccctttctacatcaccatgggttttttttgcagaattttcttccattacaatcactgattgtaatcaattctctttcccccaggtctctgcctcctctctgtcaggaaggagagagagaagttaaccacacagaactgaccaccctctttacccagaaggagctgatcagccatctttaggcagaaggcttcctccagctgcacccagattccccttctgtctcccacagcaccctgggcttacttctccagatcatgtaacaccctgtgctaagattgtttatctcttgtctgacttcttgagtggatcataagctctttgaatgcaggcattgtgtcttctcactcgcaacatctccagtgttgaggacagaagtgcccacagtgcataggatatactcaataaaggattatcaaatgtcatggaaataaggccttaatttaaattcagtgggaagagattttcttgaactttaagaagacttggggacaaaatttgaacttcttgtatgtgtttctcctcaaagagcatagctctgccttaattcttctgaatctgacatcgagcctctggagtttactagactcttaggctgggaagctcttggtccatttttgatccactgcattctgcagtgagatgaagcccattcctctgacatcccacttggtgtgccatgctgataaacccataacactgatgctgtagattaatggcatgccttcacttatgaacactttttccccatggtgactaatggcattttgatggtgtctccttagacagctgcctaaatataaagcagtatgagctaaaagaataaattgaaaatgtcagtcgttttgtgtaatccttccataatattatctgggagcccagcctagctttatggaaatcattcagtagaatcagacaagatttttcctacagcacttttatgtttgcaaaaccatcatcattgtcagctttaattaatatttatttctgtgtatcacacctcatgttaataactctcctccaggactattaacaaaatccagaactgttatttttcaatagaggaagcggaggtatacacagaggtttgacagcttgcttaaggctacaggataaactcagagtcaagctgagaccaggaggcacagatcttcatctccctgagaagggcggctgctctagggtcagctttgggacatatgcctcacctttgtgtgcccatcagacaaagtgagccacctggtagctatgcctggacatggtaagaagcacgcttttgaaatgaagagggagccatctcattttcctggcatatgtcacatctcttactgaagggagagacccatagctgcctgtattgtccgttggggcatgtcacggtctagagacatatgaaagacaaaaaagctcacttgtcatctgcctttcagtctaggagagacagcccgagactgctgccgtggtggctgtgagacgctgtgtcacatattaattaggaggagcatatgtagcatttctaagccaggggccatttgtggcggcagcagccacgcaggaggcagggagtgcagctagtagctaaatggagggtttaggatgcaggttctcggctcagacaccgggaatgaatccgttaagagaatgttgcggccctccaggccccgctcctcctgcctcgcaggtgcagtcacttgctgccctgggttcccgcgcaaccagaagcttcctgggcccagcgaaagttctcatcccctgctctgtagcccttgagacgcgcgggagggttggaaaagccgagccgattgtgggtggcaggcctccacagagatcgatttgaaggcagaagctgaactcatcatacctctttagagaagaagtagtaacgtgcccttttcgctcaacaaaaacctgggcaaggccaagggaaaggatagcatgccccatgcggtgagcaagggcgcgtgcgcagagtagcccggcccaacactcacctggaaatgcggctgggccagggtacaaatcacagtctctcttccatccccgcccctgccacccacttccctcctccgacttggctttctgcgagtgcgcgtgaggagagacttatccaaggtcagggacagaagtcagaagatcctgatggttgcctgctccttactaactgtgtagcctttggtaagttccttaatcattttgaacctctgagtcctcgttaaaatgagaatgagaatacacatcttacctatgaggcatggtccagtgaactatgagtactgtagagagaagcatgctccacaaatatgaatgataatggtgattttcatattcaactttgtcaggtatacctttaaagtcacacactgaagtactaagatacaaaacccttagccaggcatggtggctcatgcctgtaatcccagcactttgggaggccaaggtaggaggatcatttgaggccaggagttcaagaccagcctggggaacattgtgagaccttatctccacaaaaaaatgcaaacattaaccaggcatggtagcacacgcctgtagtcccagctactcggaaggctaaggtaggaggatcacttgagcccggaggtcaagaggctgcggtgagccatgagtgcacaactgcactccagcctgggtaacagagcaagactctgtcgtaaaaaaaaaaaaaacaaaaacgaaaacagaacccattagggacccaaggcataaagagagagttatgtgatgatacataactctcataattttgaggatgtgctgcccttcttgtgttactgtgcccagtcaggtgaagggactgggatgagacagcccatcacctccacagacctttcttcttttttttttggcagagtttcactctatcgcccaggctggagtgcagtggtgcgatctcagctcaccgcaacctctgcctcccgagttcaagcgattctcctgcctcagcctcccgagtagctgggactacaggaatgcgccaccatgcctggctaatttttttgtatttttagtagagatggggtttcacaatgttggtcaggctggtctcgaactcctgacctcaaatgatctgcctgcctaggcctccaaaagggctgggattataggcatgagccaccgcacctggccagccctttcttaagtactggtagtgtttttaccactgggctagacattgtagaggatacaagaagagactgaatacaatctctgcccctagagaatgagccatctagaaacaaacaaacaaaaaaagaagacaagggaaggaaatagagcactctctagtccagttgttttcaaccttttggaaatgccatgtcctcttgggcagctgaaggtctagaaagtacagtttatattgatctgccgttctgtttctcgaacaccactctgttctcttctcagtggagatgaagcacaaccacatgcttcagatttctttttagatcaagggatctcccaccctcttgttcaaaattctctgtgtggatgctgcttctttacatcttgaagttgaatagaacaagtcctttttcttccttgggcccgtggtctgcatgctggtgacagcccattgctcttgactctcctcaccaggccccttaagtcaatgtcctgcagcacaggatgggtactttctccgttctccctcgaaggtggcctggtagttccctgtccgttaaaaacttttggcccacaaaaatgcagaaaccagttcaagatttacataacagttcatggcaacagaatattgatcacgaggcagtacatgatgagttgccaaatgaactgcatagccctgttgctataggagtggagcttcctcaggtcctctctggaagtaagcagatcatgcactgcgagccagccgaaatgaacaagctgacagaggggaaggagatccaagcagacagagggaatagagggaatctaaggaatttgtctctgaatgaccaactgtactatacaggaaatattgggccatcaaaggatgtcatcactttaataagtcaaacatagttaaatattgatcatttcaacttaaacatttgaggatttggtaaatattttttatatttacttgaaaagtttatgtggctttttctttggatttgaagataaatctagagcatagttttgacatcttatttggccattagaactgatagcatctttcctatgtaccttagactctagagaaattgtcacatttcaaactcataaacactgtgaattgggtatttttaatttttatacagaaaacagaggctcaaaaaggtgaatttgcccaaagttatgcagctggtaactgcataactcaaacctcagcaaataggtcaaacctcagcaaataggtcagattccctgtttatagttgatattcaagaaatatttattgaatcaacctaagtgcacacattcaaaggctcagtcactacattttcatgcaaaatatgtgtgattctcacttatgtatacatatcactcatgcatctcatccaccactttttcctttcgtttacccagttactggatatctctgaacctcgttttctcttccattaaacatataattggtgagcatgtactatggccccttttgatagctgtttctgcttatcatgtctttattcaattttttttttatactttaagttttagggtacatgtgcacaacgtgcaggttacatatgtatacatgtgccatgttggtgtgctgcacccattaactcatcatttaacattaggtatatctcctaatgctatccctcccccctccccccaccccacaacaggccccagtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaggacatgaactcatcattttttatggctgcatagtattccatggtgtatatgtgccacattttcttaatccagtctatcattgttggacatttgggttggttgcaagtctttgctattgtgaatagtgccacaataaacatatgtgtgcatgtgtctttatagcaccatgatttataatcctttgggtatacacccagtaatgggatgtctgggtcaaatggtatttctagttctagatccctgaggaattgccatactgacttccacaattgttgaactagtttatagtcccaccaacagtgtaaaagtgttcctgtttctccacatcctctccagcacctgttgtttcctgactttttaatgatcgttattctaactgctgtgagatggtagctcactgtggttttgatttgtatttctctgatggccagtgatgatgagcattttttcatgtgtcttttggctgcataaatgtcttctttagagaagcgtctgttcatatccttcgcccacttgttgatggggttgtttgttttttttcttgtaaatttgtttgagttctttgtagattctggatattaaccctttgtcagatgagtagattgcaaaaattttctcccattctgtacgttgcctgttcactctgatggtagtttcttttgctgtacagaagctctttagtttaattagatcccatttgtcaattttggcttttgttgccattgcttttggtgttttagacaggaagtccttgcccatgcctatgtcccgaatggtattgcctaggttttcttctagggtttttgtggttttaggtctaacatttaagtctttaatccatcttcaattaatttttgtataaggtgtaaggaagggatccaatttcagctttctacatatggctagccagttttcccagcaccatttattaaatagggaatcctttccccatttcttgtttttgtcaggtttgtcaaagttgtagatatgtggcattatttctgagggctctgttctgttccattggtctatatctctgttttggtaccagtaccatgctattttggttactgtagccttgtagtatagtttgaagtcaggtagcatgatgcctccagctttgttcttttggcttaggattgacttggcgatgtgggccttttttggttccatatgaattttaaagtagtttttttccaattctgtgaagaaagtcattggtagcttgatgggggtggcattgaatctataacttaccttgggcagtatgaccattttcacaatattgattcttcctacccatgagcatggaatgttcttccatttgtttgtgtcctcttttatttcattgagcagtggtttgtagttctccttgaagaggtccttcacgttccttttaagttggattcctaggtattttattctctttgaaacaattgtgaatggtagttcactcatgatttggctctctgtttgtctgttattggtgtataggagtgcttgtgatttttgcacattgattttgtatcctgagactttgctgaagttgcttatcagcttaaggagattttgggctgagaccatggggttttctagatatacaatcatgtcatctgcaaacagagacaatttgacttcctcttttcctaattgaataccctgtatttccttctcctgcctgattgccctgaccagaacttccaacgctatgttgaataggagtggtgagagagggcatccctgtcttgtgccagttttcgaagggaatgcttccagtttttgcccattcagtatgatattggctgtgggtttgtcatagatagctcttattattttgagatatgtcccatcaatacctaattaattgagagtttttagcatgaagggttgttgaattttgtcaaatgccttttctgcatctattgatataatcatgtggtttttgtcgttggttctgtttatatgctggattacatttattgatttgcatatgttgaaccagccttgcatcccagggatgaagcccacttgatcatggtggataagctttttgatatgctgctggattcggtttccagtattttattgaggatttttgcgtcaatgttcatccgggatattggtctaaaattctctttttttgttgtgtctctgccaggctttggtatcaggatgatgctggcctcataaagtgagttagagaggattccctctttttttttttttttttttttgagactgagtctcgctctgtcacccaggctggagtgcagtggcacagtcttggctcactgcaagctccgcctcccgggttcatgccattctcctgcctcagcctcccgattagctgggactacaggcacctgccaccacacctgcctaattttttgtatttttagtagagatggggtttcactgtgttagccaggatggtgtctatctcctgaccttgtgatctgcccaccttcgcctcccaaagtgctgggattacaggcgtgagccaccacgcccagcagattccctctttttcttttgactggaataatttcagaaggaatggtaccagctcctccttgtacctctggtagaatttggctgtgaatccgtctggtcctggagtttttttggttggtaagctattaattattgcctcaatttcagagcctgttattggtctattcagagattcaacttcttcctggtttagtcttgggaatgtgtatgtgttgaggaatttatccatttcttctagattttctagtttatttgcgtagaggtgtctatagtattctctgatggtagtttgtatttctatgggatcagtgatgatatcccctttatcattttttattgtgtctatttgattcttctctcttttcttctgtattagtcttgctagtggtctatcaattttgttgatcttttcaaaaaatcagctcctggattcatggactttttgaagggttttttatgtgtctatttccttcagttctgctctgatcttagttatttcttgccttctgctagcttttgaatgtatttgctcttgcttctctagttcttttaattgtgatgttagggtgtcaattttagatctttcctgctttctcttgttggcatttagtgctataaatttccctctacacactgctttaaatgtgtcccagagattcaggtatgttgtgtttttgttctcattggtttcaaagaacatctttatttctgccttcatttcgttattacccagtagtcattcaggagcaggttgttcagtttccatgtagttgagcggttttaagtgagtttcttaatcctgagttctagtttgattgcactgtggtctgagagacagtttgttataatttctgttcttttacatttgctgaggagtgctttacttccaactatgtggtcagttttggaataggtgtggtgtggtgctgaaaagaatgtatattctgttgatttggggtagagagttctgtagatgtcaattaggtccacttggcgcagagctgagttcaattcctgggtatccttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgcattgatccctttaccattatgtaatggccttctttgtctcttttgatctttgttggtttgaagtctgttttatgagagactaagattgcaacacctgccttttcttgtgttccatttgcttggtagatctttctccatccctttattttgagcatatgtgtgtctctgcacatgagatgggtttcctgaatacagcacactgatgagtcttgactctttatccaatttgccagtctgtgtcttttaattggagcatttagcccatttacatttaaggttaatattgttatgtgtgaatttgatgctgtcattatgatgttagctggttattttgctcattagttgatgcactttcttcctagccttgatggtctttaccatttggcatattttttgcagtggctggtactggttgttcctttccatgtttagtgcttccttcaggagctcttttagggaaggcctggtggtgacaaaatctctcagcatttgcttgtctgtaaagtattttatttctccttcacttacgaagcttagtttggctggatatgaacttctgggttgaaaattcttgcctttaagaatgttgaatattggccccccactctcttctggcttgtagagtttctgccgagagatcagctgttagtctgatgagcatccctttttgggtaacccgacctttctctctggctgcccttaacattttttccttcatttcaactttggtgaatctgacaattatgtgtctcggagttgctcttctcgaggagtatctttgtggcattctctgtatttcctgaatttgaatgttggcctgccttgctagattggggaagttctcctggataatatcctgcagagtgttttccaacttggtttcattctccccctcactttcaggtacaccaatcagatgtagatttggtcttttcacatagtcccatatttctcggaggcttcgttcatttctttttattcttttttctctaaacttctcttctcacttcatttcattcatttgatcttccatcactgataccctttcttccaattgatcgaatcggctactgaggcttgtgcattcgtcacgtagttctcgtgccttggttttcagctccatcaggtcctttaaggacttctctgcactggttattctagttagccattcatctaatcttttttcaaggtttttaacttctttgccatgggtttgaacttcctcctttagctcggagaagtttgatcaactgaagccttcttctctcaactcgtcaaagtcattctctgtccagctttgttcagttgctggtgaggagctgcattcctttggaggaggagaggcgctctgatttttagaattttcagtttttctcctctgttttttccccatctttgtggttttatctacctttggtctttggtgatggtgacgtacagatggggttttggtgtggatgtcctttctgtttgttaggtttccttctaacagtcaggaccctcagctgcaggtccgttggagtttgccagaggtccactccagaccctgtttgcctgggtatcagcagcggaggctgcagaacagtgaattttggtgaacagcaaatggtactgcctgatcgttcctctggaagttttgtctcagaggagtacccagccgtgtgaggtgtcagtctgcccctactggtggggtgcctcccagttaggctactcgggggtcggggacccacttgaggaggcagtctgtctgttctcagatctcaagctgcgtggtgggagaaccactactctcttcaaagctgtcagacagggacatttacatctgcagaggtttctgctgccttttgtttggctatgcccttcccccagaggtggagtctaccgaggcaggctggcctccttgagctgcggtgggctccacccagttagagcttcctggctgctttgtttacctactcaagcctcagcaatggcgggcacccctcccccagccttgctgccaccttgcagtttgatcccagactgctgtgctagcaatgagcgaggctccatgggcgtaataccctctgagccatgtgcaggatataatctcctggtgtgccatttgctaagaccgtcggaaaagcacagtattagggtgggagtgacctgattttccaggtgctgtctgtcacccctttccttggctaggaaagggaattccctaaccccttgcacttcccgggtgaggcaatgcctcaccctgcttcggctcatgcttgatgtgctgcacccactgtccgacaatccccagtgagatgaacccagtacctcagttggaaatgcagaaatcattcgtcttctgcattgctcacgctgggagctgtagacttgagctgttcctattcggctatcttggctagctccctattcaattttttttaaagtatgtgtatatgtttatattacacacacatactcaacacttattgtgtgcctgcctctgcaccctgaagcaatgaatgaatgatgttttccgctttctatgagctcagagctaagcagaggaaataaactgtaaacctaagcaagaccctgcccaatgttatggactgaagcaaaataatagaggaatatatgaggtatgtaaagtaagatattgggagaaagtattcaattaagagaagctcacagagagctcacagatagctcacagtgagctaagctgggcagccctataaccccaggatacaattccaggcatgtagcaggcattcaataccttttttctaaacagaatcacattgattaaactgaaaatttcagaaggataaagaagagttttcaaggtaggtaaggatcaggaaaatcttccaagccaacaaaatttaaaaaatcacagaagtatgaaacactatggtaggctgaggacctcaggaagcttagtatgatgatggcattaatttggagaggaacatgacatgagatgtggctggagagtttatacatctcaatggatttttttctctgctgggcagtggggaggcctgaaggagcctaaatagaagagcacagaatcagatttgtaggatgtgtagttggcagataagacctagcaaaagaggtggaaggagatgaatgtgctgaatgagaccactccatgccaatccagggcaaggagcaggatcagagtagggttgcaaggggcagaaatgcaggccatgcagtggactaggaaggggagatgtccttccaggaccaccagcctgacctgctgtgtgtggggactgctctttcttttttttttttttgaggcagagtcttgccctgttgcccaggctggagtgcagtggtgcgatctcggctcactgcaacctccacctcccagattcaaacaattctcctgcctcagcctcccgactagttgggattacaggcacatgccacccatgcccagctaatttttttttgtatttttagtagagatggggtttcaccatgttggccaggctggtcttgaactcctgacctcgtgatccacccacctcggcctcccaaagtgctgtgattacagatgtgagccactgcacccagcctgctctttatttctttaggactgctctttatttcttttttcagttatttaaatttatatcccactttctaaatttgagatggttttttctttttttctttttctttttttttttgaggcagagtctcactctgtcacccaggctggagtgcagtggcatgatctcggctcactgcaagctccgcctcccgggttcacgccattctcctgcctcagactccggagtagctggtactacaggcgcccacaaccacgcccagctaattttttgtatttttagtagagatggggtttcatcgtgttagccaggatgatccgcctgcctcggcctcccaaagtgctgagattacaggcgtgagccactgcgcccagcgagatggttttcaatagaagaaatatgtataatgaatttattaaaatagaaatagattattttaaaaaaatagagaaagaaatcaatagtttaaaaccatacactaagccagtatcactactattaacgagcattaagtttggtttaagcttttaagctgccaaagaaaaaaacatatagcacagagttatttagtcctcattattttttgagagagacaacttttttcctggtactaaattctgtaaggaatttccaaagttgggccctattaaaggtgctaacatcaacactctatccccatcgtttcattctgagctgtcctcgaatgtctcctctgagatttcttgcctggctgccatttctacaacagcactcattctcaagagctcaaggaaatgtgagccctgattccacacttccctgtacccactttctctggattaccttttaagatgatatgctcagttctagtcagaaacgggtataagcaatagcacatggagaatctttccacatttttggaaaaactgatgttgaagacattgtccattgtttagcaaatactgaagacccacactgagcagaatactgtttcaagaaaagatcatacagcagggatcccaatagataaagttctggcccttgtaatcctatatttttgtgggaggacaggcaatacgtaaataaatatatgaggcagtgttaggtgctgggaagaaaaataaagcagggtaaagggtcctctttcagatggcgtgctcaggacgcctcctttccatagctcaactttcatctcacacctttttatctggctacatcaccttttccttagcaacagaacagagaacaaacattacagaaccaaataccttcaccaagttgaccactaaggatggcaggaaaatgttctgctactatttgaggccagaggcttatgccaaattgttcatcacaaaaataagtctgctcagccaggtcatttcaatggtaaatctaattcgaaattaagctactgaatccaaggtctttctgaattccctttcagggttccagaataatatatttgattgtttgaggcagggtctcactctgttgcccaggagttgagggcatgatctcagctcactgcaacctccgcctcctaggttcaagcaattcttctgcctcagcctctgagtaagttctgcagtagcccagctaatttttttttaattgtatttttagtagagacagggtttcaccatgttggccaggctggtctcaaactcctgacctcaagtgatccacctgcctcagcctcccaacgtgctgggattacaggcatgagccaccacgcctggccttatccagcttttatacgggccatgccctcaacatttattagctcactgaatgagattcctagtagccacacgctacagactgaattgtgtcccttccaaattcgtatgtcgaagccctaacgcccattgtgatggcatttggaaatggggcctttgggagtaattaggtttagatgaagtcatgatggggttgaggggtatttctcatgatgagaatactgtccttataaaaggagataccagagagcttgtgcacatgccctctttgttttcaccatgtgagaatacagcaagaaggcagcagtgtgcaagccagcaagagagccctcactagaacccagtgatgctggcatcttgattttggatttctagcctccagaactgtaagaaaataaatttctgttgtttaagtcacatagtctatggtattttgttatggcagctcaagcagacttgttatggacaccacacaagaaaagaggcagtagagcatatggttacaaagctgggctctggagtctgactgcctgggtctatatcctgaccccaagaattcctctctgggtgatcttgggcaagttattttacctctctgcgagtgatctccttgtctgcaaagtgagaataataatagtaaatatcttgcaatgttttgtgaggattaaactacttagcacatgtgtgacaatgagaacatgtctgacacataatgctcagtaatgtttattattattataactccaatttacatatgaggttactgaggctttgagaggctaagtaagttgcccaaatacatacagggagtgggttgccgattcagaatttgaacctaggcttctctgactctgtactcatgctccttctgttatgactgtctctgtcaccatgaatacaaattaaaatgatgttacctagaagagatctagctccaaataacaacagaaaaacaggagtcctcacaaaaaactgggatcctccattacagtggtgtgttgcttaattagccatactgtatttatcaaatgctactgtgtccaaggtctttcactgaataaacagtggtaactcaaagcaaataggatttctctttgtctgatttttcacttcactccttcagttgtttatttgtataatatttactgaactttgggggattcacagaaatagtgaaaatgatgctgctctcagtctcaaggaggaaaggacagaaaacatacaaagggcaaatctgtagagaatatgatctgatgctcaggacagtggacccagtcacaaaagaactggactgagacgtaagatttggttgatccagggtgggactagtcacacagagttggcctaggccctgcagaaagtaactgacataaattagccaggggttctctaaagcaaagatttcaaattttagatctagaggataaagttatcctgaataacattacctctcctaagacattacaaattcagtgaaattcagtgaatattacaaaaatcagtaagtttttatgcgatggctctgtgtttgttgaatttttaaaaatccatttgtgttttcatagaaacctgaattttacatccccatgctaaagaatttcccctttggttcaacaaatgtatcagtcagggttcaggcaaaagatggaaaccacaaaaatattattttaacagagtaaatataatataaagaatagttagctagatatagttaactaagtaactaaaaatataataagaaaactctgccatttcatggaggtagcaccagcaggaagcagctctaaggagagggtgctggcccatgctggtgtctgtctggggggcacaatgatgctggttctgcaagggctggagacattgcagacctgactcagctgctgatgcaggaaggcaaagaagcattgctagagtgatgctcacaggaacgggaggtagaccagaagccaaaaagaagcatgtctcttctttctcctccagtcttgcagcctcattctagcacttcctttggcagagcctaacatggaaccaactggcaatacaaatataaatacaacacaagaatgaatgtggcatcttctctcatcttcagcataaaaggaatgacagacatgtaaaccagaaagcacaatacgtatatatcataccagaagattgtacagatgtgagggcagcactaaatgagaaatgattcttctggttgggtgcggtggctcatgcctgtaatcccagcacattgggaggccaaggtgggagaatcacctgaaactaggagtttgagaccaacctgggcaacatattgagaccctgtatctataaaaataaataaataaataaaactagccaggcttggtggcacgtgcctgtagctacttgggaggctgaggtgggaggatcagttgagcctaagagtttgaggctgcagtgaactatgctcacaccactgcactccagcttgggcaacaaaattagatgccgtctcttaaaaaaaataaaataaaagattcttcttacttacagtagcagcttggaaagacttcatagaaaactcttgagctgagtcttcaaagacaagctttgttggtcaggtagacacagtcaccaagaacattccagacagaaagagcagcctgaacaaagatatgaagaaggaagaagtgggatgtgtccagagatcatgaaaataatttggcccgattggactgtggggcatagaaaatggatgatgtggaaagaggtaaggttcgtgaggtaggctagggccagatcgtgaatactcttccatgccagctgaatggtgggaaccctatcctagaagcagtgaaagatttgttagcggggtaccatgaacagaattgtgtttttgagggataactcctggtttgtgatggagaatcattgcaggagagcaagggaggccagttgggagactgttatgctattccagttgagcaatggttagggtttgaccaggggcagcagcagtggagatggatggaagaggcagactgcggaaatgctaagggagtagacatgagacaagcagggatcagggtgggcagcagagacaggagtctgggtttggggcttaggtcgtgggatggatggtgatgccattctccaagaaggaaggttggcagaggctggtctgtaggtgaaggaagaaataaaaaggataagatcatgacttaagctttgtacactgggcttgaactttccaagggctgagaagattttaccttaaaaggagttgagttgatactgatctcatctttaataggactcgacagtccagatgacatcaactactgccttcctaaaaaggtgttgctcattaaggagatagaaaccattcagcaattccaggaaagatctctgcaatctttaacacttccagaaaatatagtcatcatttccacattatcattctttccctctgtccgcttgataatgttgaggcctgtgttggcaataggacagatgacaacaaagattgacatgtgaatggctttgtcctggggcttaatgtctaattcctcaacatgatttctgatctaaaatatcctcctaagatgtccagaaaattaaaaaaatatattttctattgtgcctgaagtgaattcaaatctcagataatgatgttactgctattcttaagttctcaggaatgactgctgccacattttagtcaactaagggctactgtcatagtcagagctactttttctttctttcctatctcttgcattgaggtagcaagtataattatagaagtcatagaaagccaacacaatagaattgttcttgttaagtatttttagaaggcctccttaacattttgtcttctttttgttcattgaacttatcttcccttacataaaatatagttgtttaaaaggaagaaatgaaggaacaatttgtgaatatgcagggagtccatagatgtcccagaatccacagggcaccatctctcctgtcttttccctctatctctctgacttccttttgcacacattctcacccacccaaccttttagcactatctctgtaaagtctagctcaaaaccatagcctttctccttccccagatacccaagcccagagcaatcctctgagctcctgcaacatcaggactataactccattagcctttaattgccaatattgagtatgaaatatcatctttctatgtgcatatctgtctccctaatagattataagtctctggagtgcagagatcctctcatttgcctctttacacactttgtgcatatagtaactggcctttgattaattacttccatgataagcttgacccttgttctccccggctaagccctagaggtcaccagatacttactttgtggctaatctctggccttcctgctgtttacaaccaggcttccttctagctctagaggatcttacacagtacagagtcactgaataagctactttctttcttaatcacctcattcatttcatttattcttccttgtatttactttgtggctaatctctggccttccggctgcttacatccaggcctccttctagctctagaggatcttaccatagtacagagtcactgaataagctacttcctttcttaatcaccctgttcatctcatttatttctccccacagatgagccactctttctaatttgtatcatatttattaactctctatcttccagtaacacaacacacacatcttgaggctacacaaagtcttgctaaatgggatacactactactctcagaaggaaatcaaccaccataaaagttaatgtgctcaccccataaagaaaaatcttcctgacacacaatggtagcttgaaaattggtgtattcattttatgacctcctttattagccagaatgatgccttgtttgatttctaaaatttgtttaggatcattagcaatgggctcctgggtgtcactgacaacttatacattagccttgcacacaagtcctagaaatgagaccaaggaaaccgcagtttttattccttctagggtataattttttctttctccaaccagtacctgaatatttctcaaataatttatattttcagattttacaaacatctcagcaagactatattagtttattgaccccattttgcaaaagggaaggcagttaccaatagtaggaggctttttggggccacgatggtttcttagatgagtcagtatcagacgtgagctctaatatgaccctatctaatttcttttctctattaggtagtttcctctgtcctaaaaaaaaaaagtaggaagagaagtatactagcttgcccctcttgtgtgcctctggctgtcagaaatagaatttgaaagagtagatgagaaaatgtgagaaaacccgtttactgataactgttcctatcttctcaggttttttatctctggccacaaagagtgattgggagaaaacatactccaaataagtttttctttcaactcctccttaactctcaaggcagtaattgccaccccctgccctccctccccggcatcaccactctgctaatacaaacgtgatattttacctttgcttctagctttggttctttttagcaataatatgtcttgagtggaatgagattttttcttccttttttttttttttttgagacggagtctcactctgtcacccaggttggagtgcagtggcaagatctcggctcactgcaagctctgcctcccacattcacgccattctcctgcctcagcctcctgagtagctgggattacaggcacccaccactatacctggctaattttttgtatttttagtagagacggggtttcaccatgttagccaggatggtcttgatctcctgacctcgtgatccacccgccttggcctcccaaactgctgggattacaggcgagagccactgcacctggccttttccctccatttttaaacttttattattattattatttgagatagagtcttgctctgtcacccaggctggagtgcagtggcgctgtcttggctcactgcaacctctgcctcctgtgttcaagcaattctcctgcttctgcctccagagtagctgggattataggcgcatgccaccaagcctggctaatttttgtatttttagtagagacaggttttccccatgttggccaggctggtcttgaactcctgaccttaggtgatccatccacctcagcctcccaaagtgctgggattataggcatatgatattttaattgagcatttcctatgtgccaaataatgtggtcagagcttattttctaataagggagtaaaatttgcattgttaactatgctagtaataccttctgggctacaacaacattgttatcagtttctagctacttaatgatgaggtcagatttgataagttcaggagttgtttgaacttcagagaaggttgatccagtggctcaatgttgtccgcaatgagcagatttttctgcctttcatcctaaggctgtcatccccatcgtgtcaatgtggctgaactgcttcaagctttacatccacaaagcaaaccatccaggagagatatttttcttgtcaaccatttcagaaaaggccacatagccatcgctaaatcaatgaccatggctaggcagtggggggtgttgatcagctgaagcaaatgagagcccatctctagaactttgggtgagaagagcttcttcccagatatataacataaggcaggagggaaaggtgaacacttgaacaataatgtaggatactacttggaagagatggggagaggggttaaaaacatctaggtaggcaaccaacagaccaaacgtctccaatacacatccctattttatcatatcccaggccccaggccaggccttatcacatcatccttgggttacctgagaattttccagctgaattcacaaatgcctcttctctatttggtctgtattcatttacctaggaatttccacacttctctctgataagttacctacttttcatctttacttcctgtattagtctgttctcatgctgttaagaaagacatacacgagactgggtaatttagaaaggaaagaggtttaatggactcacagttccacatgactggggaagcctcacaatcatggcagaaggcaaaagagaagtgaaggcatgtcttaaacttacatggcggcaggcaagagagcatgtgcaggggaactcccctttataaaatcatcagatcttgtggcatttattcactatcatgagaccagcatgggaaaggcccgcccccatgatgcaattacctcccaccaggtccctcccatgacacgtgggaattttgggagctacagttaaagatgagatttgggtggggacacagccaaaccatatcactttcttttctttgacatgtcctgggattctgtttgccttccagtcctctttgcagtagagattagaccttccctcccctactggtaggattattcctcaatctcctttttctgctttttattttttttttttttgcaagctttccccagccacctgttatttccaccttccctatggtactccccaaacacacccttccattcctactcatccatcaagagaaaatgcatgtgatgaagtcccatgttcacatcccacaacacagatagatggcaccaacagtagatgctccatattgtataggcgaatgtaaattgacttgtgtttatgcttccaaaatggatatggtatgtttctttcactttatcccctttacacttacaatttgaccagcactggctcaaaactttatttcaacaagtaagcaaatcaccaagaactccagtgcctaaatcttgaatttagcagctcaaaccagaaccaccaatctcatagtaaaacctagtcccatgagaatctaatgcaacttgggatatgaaaattatcttagtattcaaatagcctccaggagttgagatgcttatctgattctcaagattggaagtttccccccttaggatctcaggatttgatgatcagatgtaaaaatctctggtaattttggaacatattttgggcatttttttcaaaacccgttattattattattatctaggatatgctccatccagatactcctctggttttgggtcacttcagccagtgagtttttcctaagaactcttccccatcattccaaagcagctctcagaaaaatctcttttagaaacgtagttagaaatgataggagccatcataaagaacagatggttactttttgtgagaaataaatgcttttaaaacttctattcacagcattaactaaggaaacttgtccagcccctaagagttgctgagactcctttcagttggttctttgctaacattgatataagagatttgagttcattgtaaaaaaaaggtctttgtaaacccattaaaacaatattgtcaaacaggggcttagatgcatacatagctggctagatggatggatggaaatgcaaaaaagcaaataaactaaaatatgaatgttaaaatgtagatggtatgtttatgggtattcactgtctaatttttaaattttttctatgtttgaagattttcaaaataaaatgttggggagcaaaagaatcttgaagaaaaaagagatggaccagttgagggagaggtggtacactgacacacctttggaagaagcctacagacaatagggagaagtccatataagcatggcattacggggtgaagactggaagctctaattgggcaaaacaagagaagaatagacataatagttcctgtgagaaactgtcagaagtacagctagtggcatataaatgccttttatcactgttcctcccattacaatcaaaatcctattaacagtctgtcaggagggaagagaaagtctgaaccctgtgccaagcactttgcctggattatccccttcactttttgcaggaagaatgtgtatttatttatactgtgcatttatttgcttgttgcattcacagcattgcttaccccttttccagctagaatcacactagttctcctagggagactcacccaccatcactgaatatagacttgatgccctatcctacctgataaaaggtgtggacaaataacccgagtgaacgaggtcaagtaggcactctctccaggaaattctaatcgtgaacacagttggtaatgaattgaaaattgtggagttgacaacatagagacctcaaagaatgttttcattagtgcctgctatctggatcctttggaactctctgaattcctgtaattttgattgggcagtgttgcttctgttacttacaaacaaaactcttaactgaaggagggaatgtagctcccatttaagaaatcaagaaacccaagctcagaggaattaagtgtcttggctcatgtcaacatctgatgtttgtacctgagtccctctggactacaaagtccatcttttatactgactctactatgcttcctctaactctatagactgggtttaattcctgcctctggcacttactagctggataagtttgggtaagctgtgtgccagttttaaattttaaattttttgatctgtaaaatggagtaaaaatagtcatgtatctcacagagctatggagaggataaaataagctaatttatgggtggtgtttgggcatgtgtctggcacataagtgctcaataaatgtcagctgtgatgatgatgatatcagtcagggttctggcaagaaaaaaagaagtgtttgaggagagtttaatgtaaggctaattagaaaagcgaggagagggtgaaggagatgaacaagggatgggtgaaggaccccagggctagaaagagcagcaagctgtggacaagggctgcccaacaaggctggcatctctacttgtatttctaaattagtggccatggcagacacagccaacagtgattcagcaaagtgggagccaggcaaataaataccctgtttgtgccctctcagttcaccctctattttcctgccagggccttgaattggccaaacctaaccataagctaaagacaaagaagtctggttgatgcagtccatgcaagtcaatgtctaaggacaaaagcaggctgcagaaaggtagatattcaacctggagatacttcaccacagcatactcttagctaagtgaaaaacatgtgtccctgacacaggtcacctccatcccatgctctcccagcccctctgcaggatggggttctttatttgcaggaaagttttgaaacaatttgagggttcaaagttcttagtcttgtctgtgttcccctaaatgttcccatcctatgtctcaaattttggctcttttctctgctccataacaaaacagatgttgatgcagttctcagatgctgggctggtcctcactcatatctttttcaaggtggttggtaagcagctcttttaaagctgccattaaagttttctgatattatacttgtgccctgaatggacctacaaagcttttaatttttcctttcatctgtgtacattatctaggactcacagaaacaccagtcacaccacaatcttgataattaccattgtcaccgtagcaactaaggaccctagctaattgatctttcaacaccttgccctctacttgcattgcatcccaatctctgctactaggaatgatttgagtaacatagcgtggattatccatatcccattttcttctgttaagaagcctccttgttctcatcaaatatgttagcaacttgtatcagttttctattgctgctgtaacaaattactacaaatttattggatcaaaacaactcacatttattatccttcagctgtgcaggttaaaagtctggatacaggtcccactgggctaaaatcaaggtatcaaaaagactgcattctttctagagaccctaggggataatccgttttgttgactttcccatctttagaggctgcctgtattctgtggctcatggccttccatcttcaaagtcagtaatggctgttcagtctttcctacatcacgtcactctgacactgactctcctgcctgcctcttccacttttaaggacccttttgattgcattgggtaatcaaaacctggttaaccaagataatctctatatttaggtcagctgattagcaaccttaatgctatctgcaaacttaattcccctttgtcatgtgacataatctattcacaggctccagggattaggacacaggcatcttttgaaggccattattctgcctaccacacaataccatcccaatactattttaagagtctgtttcctgaggccatttctaaaggtactactctatttgtctgggttctatcaggaaacaaatggcatgctcaaaaggaattattggagaacatttgctgaagagacaattgcaaaaatgtgggcaggggaaaggaaatccatgagggataatgaagcacccgaaagacaatgacagcaggaagggtcagggattgggggaagcagttagcaggaccaggtgatggctgtgccttaggtaaaggatcccagccagtgccaagccatagcccagcagggaagtgaccaggggaacagatacctgaatctctccttctaccctttgatctccttccagtgctgtcgattggccaaacctgcacaaggcagaaggcaaaggagcagagttgatgtagccaaagaaagtcagcatcgtagggcatgaagcaggtggggaagggtgaataatagatctatggagccgacagactataaactgcatattatttaactaaataatttctactaaaaggtaaatgggactaccacccagcatggcatttgtattttaaaatagccaaactcaaattaatctataaatagaagttatggggaagtatttttgagcggcaaagcctaaagcgagtcctatctattaatagtaagttccactatagaatgtttacatcaacaactaataaaaataaagaggtagcacatctatacagaaatacgggatgtcagttattttatccttttaatgagggaagaatcacatggatttattccttcactaccatgaactaaaagggatttcattccatcacagtgatgatagcaccaactcaaaggatgtagccatgaagataccataatttttccatcatttgacaaggactttataaataaacatagtggtggtcatcacattcaggataaaatgctggtctggcagtgcatgtaggttacatgaacactttttcatctcaccagtaaggttactcagacacatgacaccatattttccaataactacagtgcacgtataggtccaaaaagtaggtctgaaagtaaaggagctgatatgcatgtttctgtcactcatgttccatgtgcataaaaaaaatgacaaaccaacccaacaaaacccaccagctcggccaagtacatgctcagggaaaggagtttccttcacagtggagaattttccagtgagggacagacacaactgtagaggaaagagcatttcagtaaacaggagagtcttccagagaaaactctgtgcagaataaattctttttccttcctcaaaccacagaggcctataaattcctacctccaaagtgtctggaaaggtaggatgttacagagagcagttgctctcttagtccaagtgaagttcagggaagaattacccttcccaagacttccacatggcatatacatttggaacaatttcaatggtaaagaaatagagtatttagacatgtaatgactgaagtctggattatggaggtcaaactaaactcctgcattgtacattttttaaaaatgttaagaagagtacatgcttattattctaaaacttctaagcagtacagaaccatataaagtgaaaaccaaaagttttctccttctcctctttctctccctccttccttctcttccttcctctcccttccctctctctggcgctctctctctctctctctcatttttattctctatatatctatctccagctacttactcatacaggaatatggttacagatactcctctaaaactttagaagatctgtttttaaggcatggtcatcaaagtggaggggaataccagatttaccatggcatggaataccatatgggaatttctatgtattttaactaatcctattttatagctacttgggagtatgttatgtgagttagacagtactataccatatgcataaaaattacttatgtacaaatattcacatattgaaggtgcatggatgaaacatttttctgaccaaagtgcctgatttaaaaatttggagaccattgctgtaagaaactgaaatgtaaacatttaaataacattaagagtatccatcagctgatgtgtcagctaataaaaggaatatttataaggtgcttacaatgttccagctgttctccttgcattatgtcttatgtactatgcacaatggccctatcagggaggtactattatttccccaacttctcaaagagagaaactgaagcacagtttagtggattgcccaaagctacacagctggaaaatggtcctcacaggaaacaaacccaggtctttcaatctaaagatacagtgctcctcacactactccagaagtgactctaccatagactaaggcagaattaaaaggcagcaacaggaagagagaagatgggaagcccctgattgacaaaagaagaaggacagagtcaagaaagacatcctatcccaggcacacctgccctaccgatggggaggtagcagttaataccagggtccatgctacaattctgctgcgactttataatgtaatttcaatctaaatataatccctctgtgtggcagattatattttccaaagacattggcacaatacatttcatcctgcatgcagttcctacaaggcattgctacttcttccataaaaatgtgtagtccatcttttttcctccttataaaaaactatgcagccataaaaaagaatgagttcatgtcctttgcagggacatagatgaagctggaaaccattattctcagcaaactaacacaggaacagaaaaccaaacactgcatgttctcactcatatgtgggagtgagaacatatggacacacggaggggaacatcacacaccagggcctgtcagtgggtgggggacaaggggagggagagcattagaacaaatacttaatgcatgcagggcttaaaacctagatgacgggttgataggtgcagcaaaccagcatggcacatgaatacctatataaaaaacttacacattttacacatgtatcccagaacttagtaaaaaaaaaaaactaaataaaaaaacttttaaaactaatcaatgagtccagtaaagttgcaggatacaaaatcaacatacaaaaatcagcttcatttctttacactaataacaacctatctgaaaaagcaatcaaggagacaatctcatagtaaaatcaaaaagaataaaatacttacgaataaatttaatgaagaagtgaaagatctgcacactgaaaactataaaacattgatgaaagaattgaagatgccacaaataaatggaaaaatctatgttcatggattggaagaattaatattgttaaaatgtgcattctacccaaagcaatatacagattcagagtgactatgggagatgatggatgtgctaacttgcttgactgcagtaatcattttgctatggatatgtgtatcaaagcatcatgttgtataccttaggtgtatataagtacacacacacacacacacacacacactcaaaggtgttcattttctcacccctcttgaatctggaaggcctgtgactatggtggaagtgatgctatgtgactgccaaatagtttataaaaagtgatacagtttccacctggaccccataaagttcatttctgttatgcaggtgccatgttgtgaggaaacccagatcacattaagaggccacgagtaagtgttccaaacgacagaccctgctaaggtctcagctgacagccagcatcaactgccagacaagtgagtgaagataactctcaccccagccatcatctgactgcaacacataagagatcttgggcaagagctgcctggctgagcacagtccatccccaaaacatgagagataataacggagtgattgttgttctgggccactaggttttggggtgatttgttgcacagcaatagataaggagaacaccgttgtgccccctgtggtcatgtaaggacaataaatcaccagaaataaaaaagccctcctagtgggtggtcctgaatataaccacacttttccttcaggttttcccttttgggttgctctttggtccttgtggattcagcttctgctgaagcctgggagaccctctatcccatagcttccttctccctttctctttcttttctatcctctgtccttcctactcagtggaacatgttcctggctccatctgggaaggtcccagtagatccacatatgtgggggttctacctggagtgcatggtggaattaagctgaggcctttggtatttttcaagtagtctctagaagacaaataaacctctcttatttaacatggattgcctctcatcccataatacagatctcccttccttcctaccagacatgaggaaaaagcccttccagtcacaaatagagtaactgttagtaaacatatataacctgtctcttgttcagggtctattcttttccccagactaactcctccagctagtctctcagattgaccttagacactgcctcctgaaggaaagcttccctgactcactccccgacccctgaggatgtggctgtggctgcggctgcagctgcagctgtggtaggtttccagcctaggttccaccaacatcctaaaaaccctccacttgaattatattgcagttgcctgttgctgtctctttccctcatgactgtaagccctttgagggcagggatgtgtttcagttattcgttattgtatcatccagtaccaggcagtccctgatactaagacttttctgataaaagaataaattttagaaatcccaatgccattccctcttcttcagatcaagtgaatatctacaccatttttaatgacctctgaaaggcatcctagtagtttgcctggtatgtacttctgatactctgatgcataattgtagaattcaaccagtcaaaagttcaccaagacaaaaatacccactgtagagtgatggacgtcttatcacttcttaaagcactgcttcccatttttttgaacatctcagtttgctagaaaggccttttacacgttcagaatgggtctgtcttcttgtcattcacactgtattggccccaattctgttggtctttaaaacaacctagatttaatcttagtctttatattctactctgtaaaacactcccttcattaaaacagaaattctctcacaaaaggataatgcattaagttggtcaatatttggctcaaaattgctgatcaaggcaggcatgttttaaagaggaattagtgtgctctgtggaagaaggattaatttggagtatagggtggatggagagggagcctcaaagctcagaaaagcaggagcctatgagcatctggaattctctaatgggataaggagtcccaggagagcgatatggtcaaataccaaacccaggatttatctatttaaccacatcactaatggactgcccgggctgtgggaggttgaccagcaggcccacctgttttgagaagcccacccctcaggctctgtgactgagcctggagcacacatacaagggtctgtgaaataaggctcctgacacagccagcctcctggtgttctggggaattccagctattttggggcaggggctgtaggcattgtgttatctggaggtatttctgataaatatccaagattagtgtctttgttcaggagcgggtaggaatagggagaagtcctagttgtcttgatcaccctggaattaccaacccctagctcaatgtttagaaagaaacccagttcctggcatcctgagcattgaatatgctccagggagccaatccaatctcgagtgcaggaaaatcttaccaggacaatttcaaaagcttataattgatatcacttgggtggctctgagaaacaacagttttgtaagagataaagtcttttttggaatatattattcaaaaactaaaccccagcatttctgtggtttgtatatttcattttgtggaggtatttctcctcttccaggccatgtgaagacttgaaaagaagagaaaatatatagaataagaatcagttctaaactactcattgatttactaaggagaaatgtgagtgatttaagtccctggggttggaaggtctccttctccttgtgctgagaaaagcaagtatcacttgttttccacctcccacctcccattggtgctggtaaatttcccagagaatgaggaacagctgcttcccaagtcagggtccttgaaaagggctcagtcatcagctatggaatcagctgtttgtttccttcctccaactaggaagacactagaaaacacagaaatttaaatatcctttgtctaaggacaagagtgggaaaatgtgattcttcttggtttctttttaagtctttttctttttttcttttcttttttttttgagatggagtttcgctcttgttgcccaggcaggcactccgtggtaattttcttcttaccttgctgtcttccctttggcttactcatttctcactgcatgtttcttaaaagtagtgttcccctggtatctagatttgactttcttttcattggaaaacctcacctcaagtagtctggtccattcctgtagcttcagttaccaaatgtatgcctatgactcccaactctttattctctccctgatggtgtcactccagctcaagacctagagacctcctggcattttcatgtgaatggtccagagattcctctaatttatatctcagactgagctctccactttctcattccttctcttaacaagctctatctcctacattcccaccaccatgcaagtatttgctcaaaacagaaacatagacccctcccccatcatccatatcaacttttaatcaatttctgtcagttgttcctacttaatcctctagaattttttcacttttccgtatctgctctgtcactgccttagttcaagtcaccgtcatcttccatctcctaatggattgctctgccctttgttttacccctcatcagttcatccattacccacactgcaagctacatggcttttctttagataaaacttggccatgttactcccaaaccttcaaagggctttaagggtaaaatccatataccttggaatggcatgcaaggcccttcaagatataagggttctgccagtttctcccgccccatctttccccattcctctgtcatgcaacaatcatgttgaactgccttccacagggctgcaactctctctggcctctggacctttgtaaatgctctttttaagattcagactacctctctacaccacaaacttgcctatttctcaaggcttgtaacggatcacaacttcttcgagtagattcttgcaggtgttgaaatctgggctaagacctattgtgtgctttaccaaatcttccataacacctttttttttctttttttgagatggagtctgactctgtcacccaggctggagtgcagtggcatggtcttagctcagtgcaacctccgccttctgggttcaggtgattctcctgcctcagcctcccaagtagctgggattacaggcgcctgccaccacacccagttaatttttgcatttttagtagagacggggtttcaccatgttggctaggctggtcatgaactcctggcctcaggtgatccacctgcctcggcctcccaaagtgctgggattacaggtgtgagccaccatgcccggcctgtttctttttaagtcttgccttctcctccaatgctggacactgaataggcgctctgcaaaaactggttttcataaaatcttgatactaatttaacagactattgtaatgaaaaaaggaaaatctataggctactcctgggcaatacagattctagttatccttatgtagtagaatcagccctaagccagtgttgacttgcctagaatttcagaagtgggctgtcattccatgaagaccacccattcagtctggcgttaaagctctttagtgctgttgagaatcaatccctgacagagaaaggccaattccctgaatgagaaaagaaagggccatatcaggctgagagtagaaaagaatatcttcccataagcccattcctaaggatagggtgaggctacccttaaggatagggtaaggctaccctttagtgcttaatcaaagagcagtgaatgccaaataaagggagattatctgttcaagaaaagccacgatgttgtagagcacacaaaatagtggcaaatcactgaatggttcacacatgggtccatcatttaggaatattagagaaatgaaaagtggagtacctccactggggtgtgtgtgtgtgtgtgtgtatgtcatgtgtgtgtatgtgtgcacgtgtgtgtataactttcagggtggcatattttctcttctctttcctgctctttctacctctttctcagaattcttgggaatatatataatacaggagcaagctctttaatgcttttgccacagagacaatgaatcctgcctgactccaaaggaaggatgggtgttgccttctttctttcctctctcttatctttttcctttgcgaccatagggtaatttcttgtccgtgccgagttttattttctctagttagattgttaaaacattcaggttcacgttcactcagtctttcaactccacccatttttgttgatgtatctctgacccacactcctattagaggaataaggcttgtcattaataattcctcatctgctaattctttaaagaaactagaaagaggaggatgtgtaattcgtatttatttctgtattatatgaaagaatcctaattctgggtacttcaggtatttaagtggtacttgttggcttattaacagggaatgctttgtgtaaaactggaaccaagagataaaaacgtgtcatcagaaacctctgtgtccacttctcaatttctcttatatccactttgttttattttatatgcagtctatactgcatatcagggtttgtggttgcaaaaatcagaagctaaatctggctaagtgaaacagaaagggttttgatgagaagaatcctgagtagtatacagaattgaggggaaaggcagagaagcagttttggaaagaaagcagccagtaaaggaggctgagaagcatagtgcacaggcaagagcagctacaggaagagactccatcaccatgagaccattgactgccaggcatttggcacacagccgctgaactcaactctgctgttgccagagtacgtgacttctcaccatccctgaacctttgcatcgctctctccagatacatgtgataaaatatattctaactccacactcaggaactaggtaaacagccataaagaatgtctgcagttactactgagatgcatctgtttgaggctcactttttactttacgcccatgaacctcactctgaccagtggatgacagtggcattctgggtcctcgggaataaatgttcacagccaggttccaaatatccctcctccccaagaagtatcatacagttgccctggtatacattcatgaatgcctttggggactgcttggagatagagtcacagcgtgcacttcagtaaagatttctaggttgcccatcattcagaatgctctgggatttgtgaactgattcaggtctgggaaatgggagagtcatccttgttcaagtaaaggctttttttctatagaactggaaggttttagttaaacaaatcaaattgagatttagttgctgtccatgtatttcagttcagggaccccgtgatcaattaaccactatggttcaaatcttcaattattcccactggacctgctgcctattatggtagccacattcactttgtttctgctggttaaatgctattatttgactttatgacatcccaggatcctgatattatggaagccaagacaattttggcattcctcaccccaccactggctattgcgaggttgcagagtgcagccactagagtgctgttcagagatgttggcaagagcaaccctcaccaatgtattgggtgggcttggtgatatctggaccctcttggggaatataattcaagggtgggtgtataggttcccagtctaaatctactccagtattcctaatcccttaaatctttgtttttttgtcctatacatgattcagaggaagctttggcatatacatattgttttgtttatgctgtcatttcctaaagcattgaccttgtctgtatagtggaggccatatcagagccatatgggcatttcaaaccagagtaaagagggaaatgccaaaatatttttttttttttttttttttttgagacagggtcttgttctgttacccaggctggagtacagtggtgggatcatgactcactgcagcctcaatgtcctgggtacaagcaatcctcccacctcagcctcccacgtagctgggactataggcacacgccaccatgcctggctaatttttgtattttttgtagaggcagaatttcatcatgttgcccagtctgttctccaactcctaggctcaagcaatctgcccacctaggcctcccaaagtgttgggcttacaggtatgagccattgcgcccagtcccacaacttttcaagttaaaattaaacaagtacaagtagatgcatgtcttacttttgctcatatcctaaactttttcacatagttattcatatatagctgcaaagagaccaggaaatgtggtttatatctgtgtggtcacatatttgggaagaaggaaaaaaaagattttgaataacaactaccagtctgccaaacaaacttaagcaagaaaacatttatagaaggatatcgagtagtttacaggattattagaatgcttcagaggtaggaatataaaacaggcaatacccaagggtttctagatagctgtgaatacaacaaagttcatgccccagaaatggtctagttaagatgctactgcagatgaatacttgtttcaagtatgtctggaagtgccataactgaacatttcctgctgtcattggatttttcactccagcatttttgtgtagttaatcactatttttgcagttttacatcacaaccttaatatctgaaatagtgggtaggagagtcacattgacaagactcagtctgattgagtcacagctttcaggagtagggagaaagaatgttttatcttagctgggcacgatggctcacacctgtaatcccagcactttgggaggctgagatgggtggatcacgagatcaggagttcaagaccagcctagccaagatggtgaaatcctgtctctactaaaaatacaaaaattagcccagcatggtggcaggtgcctgtaatcccagctactcaggaggctgaggcagagagttgcttgaacctgggaggtggagggtgcagtgagccgagatcacaccactgcgctccagctggtgacagagcgagactccgtttcaaaaaaaaaaagaaagaaagaaaaaaaatgtttgatctcttttattattagagtgagtgtcaggaccctgcctcctgctaaaggctacagagtagagatctcaaattggaagagggtttggatattgagtagcccaagaaagacaaacccctattttatagactgtgtctttttagatagcaagctgtctgtcaagagatccagctcatatcttcccagccagcgacctcaacagaaagagaatgtctctctaccattacctatgtgttaagctcagggaagatgctgatggacatggtttggatgctcctttctgtactcatcactgaggtctaagagtggagtattttgattgactccttctacgcaaacatgcccacatttgtgactaggagtgcttaggaaagcgccgaaattgaaagctattcataatccgtgaagtggggagagggaggttgtcccaaggaagatgcactggaagacaaaactacaaagttcattttagagttctcataatcatctggtttatctcttgactaccatttaaaaaaaagcttataatatcttcctttctcagttacctgaatatcaccataaaccctcagatttcattactaatgaaactttggtttcatcaggtagctctttaaatctgtggtaaggcttcacccatgagggactaactatgggattagccctctggccataaacaacactaaaactgcaaaatatatgaggcaacatttttttaggcatttgaccatagactgcacaaaactgcaataatacttgagagaaggaaaactcaagagatgagccccacaatcactgtatttgttggcctggggacaactttagactttggagatgctgaactgattgggatctttagagcaaggcagggcaccagagaggaaagagctaaacagaaaggagactcaaaaatctgggtaggggttcttcatgaatccttggctaaggtctagactgtgcatgtttagaatgagtccatactaggtttacaggagagtggctaccatggggattgagaggagaaaggggtatcagagatggagtagtgttggacgatactagagtgctggcttaactagagtgcagagcccttgttaataccctgggtacccagatgaggcaccaaaaaggacctgctttaggaggaaggaccactctaaagcaagacctacaatagacccaccccaacaaaccctaaaaatgagacttaatgagatctgtgaggcttcagagtttggaagctgactcaacccaggttagagagtctaagaaaacactttgcactttgcacatgtctgccataacaaaccataaaactaatacataggttcaaggtgctaagccagtaattaaactacctcctagaacaaaagtcaacactcttcagaggaaggtcatagaatcaaaataatctacaatatgtcaccaaaaatgtccaatatgttgtaaaaaattgccaaaaataaaaagaaatacaaaaatgtaagccataattgagaaaaaaatggcccaaaagatttaaagcagcagttatacatattttcaaagatttagaataaaatatggtcttaatgagagatcatatagggaatctcaatggagatatgaaaactctattgtttttttaaaaaaagaatgagataaaaattctgggactaaaatataaaataactgaaatgaaaattcactgataaggattcatagcagagtagattacagaataaattatcagggaacttgaagacagatttagagaaattataaaatattaagaacatgcgtaattgaaatcctaaaaaagaaaggaaagtgagaaaaatggagaaaaaaattcataaaaacaatggccccaattttctcaggtttgatgatttatattgacttacagggctaaaagcataatgaatttcaagcagagtaaacacaaagaaaatcacaagtgatgcgccatactcagactacttggtatggcatgtgaaaagccaaagctaattaatagtgttaaacagtccagtgcttccctagggtgagagtggtgggaggagattggagaaagggacagaaaagttttggaatggtagaaatattgtatgcattgatgtgagggtggttaaatgagtgtatgcatttgtcaaaactcatcacacttcacttaaaatttgtaccttttgttatatgtaaattatttctaaataatgttgacttacaaaactagaagtgatgcttagtcaatctaatacttcaaacattctaacttaattattttgccttatttttatgtctttacattttagttctttacattttagttcctataagtctggtttttattgctttctgtaaaaggatgtactagactccaaattgagagttgtattcacacaaatactgacatatcttgttttgttgcgctttgcagatattgctgttttttttttttttttttttttacaaattaaaagtttgttgcaaccctgtgtcaagcaagtctgttgatgccatttttccaacagcatgtgttcattttgtgtttttgtgtcacattttggtaattttgcataattaatattattacacttttaaacttcttcataattaatattattatttttatcaggcagcctccaaacctgaataggttcagagagattccccattatttttatatctgttatggtgatctgtgatcagtgatcttcgatgttactactgtagctgttttggggtgtcacaagctgcaccccaataagatgtcaaacttaatcaatcaatgttgtgtgtgttctgactgcttacaccaattagccattcccccacctctcttcctcacctcaggcctccctattcctcaaaaccatattgaaattaggccaattagtaaatcctacaatggcctctaagtgtttaagtgaaaggaggagttgcacgtatctcaatttaaatcaaaagctataaatgattaagcttagtgaagaaggcatgccaaaagccaagataggctgaaagctaagcctcttgtgccacacagttggccaagttgtgaatgcaaaggaaacggtcttgaaggaaatttaaagtctactccagtgagtacatgaatgataagaaagcaaaacagccctattgctgatgtggtgcaagtttgagtggtctgcatagaagatcaaaccacccacagcattctcttaagccaaagtccctaactgtcttcaattctataatggctgaaagaggtgagaaagctacagaagaacaattggaagctagcagaggttggttgatgaggtttaaggaaagaagctgcctctataacataaaagtgtaaaatgaagcagcaagtgctgatgtagaagctacagcaagttatccagaagatatagctaaaataattgatgaaggtggttacactaaacaacagattttcaatgtagacaaaataaccttatgttggaagaaaatgacatctaggactttcatagctagaaagaagtcaatgcctggcttcaaatcttcaaaaggcaggctgactctcttgttaggggctaatgccactagtaactttaaatttaagtaaatgctcatgtatcattctgaaaattccagggcccttaagatttatgctaaatatactctgcctgtgctctataaatggaacaagaaagcctgtatgacagcacatctgtttacaacacggtttactgaatattttaagctcactattgagtactgctcagaaaaaaaatatttctttcaaactatgactgctcattgacaatgcacctggttgcccaagacctctcatggagagagatatacaaggagattaatgttactttaattgctaacacaacttccattccatagcccataaatcaaggagtaaatttgactttcaatttttattatttaagaaacaaatttaataaggctatagctgccatagatagtaattcctctgatggatctgggcaaagtagattgaaaatcttccgaaaaaaatttaccgttctagatgccgtcaagggtgtttgtgattcatgggaggaagtcaaaatgtcaacattaacacaagtttggaagaagttgattccaaccctcatggatgagtttaagagttcaagacttcagtggagatcactatagatgtggcggaaaaagcaaaagaatgacaattacaagtggagcctgaagatgtgacttaattgctgcaacttcatgataaaatttgaatgcaagaggaattgcttcttatggatgagcaaagagtggtttcttgagatggaatctactcctcgtgaagatgctgtgaacattgttgaaatgacaacaaagagtttagagtattacatacacttaactgataaagcaatgacagggtttgagaggattggctgcaattttggaagaagttctaccatggataaaaaactatcaaataacatcaaatgctacagtgaaatgtttcatgaaaggaagagtcaatcgatgcagcaaacttcattgttgccttactttaagacactcctccagcctggacaacatagtgaaacctcatctctacaaaaaataaaaaattgctcaggcatggtggcacatgccaagtagtccagctgcttggaaaactgaggcaggaggattgctttagcccaggagttcgaggctgcagtgagttgtgatcatgccactgcacactagcctgagcagcagagtaagaccctgtctcaaaagaaacaaagaacaaaaaaagacatttctacagccaccccaacctttagcaaccagccactaccctgactagtcagcagccatcagtatcaaggcaaaaaccttcaccagcaaaaaagattacaactccctgaaggctcagactacagtagagtataaacatagcttttttttttgttttttgagatggagtctcactctgttgcccaggctggagtgtagtggcactatctcggctcactgcaacctccccctcccgggttcaagtgattctcttggctcagcctcccaagtagctgggattacaggcatgtgccaccatgcccaactaatttttgtatttttagtagagatggggtttcaccatgttggccaggctggtcttgaactcctgacctcctgtgatttgcccaccttggcctcccaaagggctgggattacagtcgtgagccactgcacctagccaaatttttatatgcactgggaaaccgaaaaaaaaaatgtgtggcttgctttattgcaatattcactgtattgtgatgatctggaaccaaaactgcagtatctctgagatatgcctataacatatgttgtttgctattttctccttattaaatagcagacttcagcctagtcaaattcactcacatgaaatccacccaactacacattttctgctgccactgaatctttaatcccttaatagaatgcctcagttactgcgtctattcattgggcattatatatcactgttactacactatatgttgaaatacatattatttaaaattgcaaataagattctacccttaaaatattcatataagtgactatgaaagtgctataaaaataacatgttgtgtttataatttgccattttgtttcttgcctaattatttaaaaaattaaaactttgatattttggatgtgatgtaaaatttcatctcatttataaaaagtgtgctgagaattttatccaatatagacaaatttaagataatccatgtggcatcaaaatagcttaaattacttaacagctatgattgtttggaattagttcttcctttcccaagaaatgctttcgctgtggatgaaagcagactctggctgaggttttgtgatgttataatgataggaaaatgctagaaaaagacagaggagaagaatctcagtgtataaacagtggagacgctaaacctgtgaggttaattttagtcagttctactaaaaaaaattttttttaagtatgagcctatagggataaaacaagatgatataagcagagcagaatagtagatttgataaagtatctgctaaggtaaagatattttatattgagtaatacagagcagaagaagaatggtgattaaatccaaaccataagacttagcagtagactggagggcctttctcagggcaggatttgtagccagcagacaggctttaaatccaagtttcattgcttactacctatatgaattctataaatcttggttttcatgcttgaaaaatggctataatagtccttgcctcctaggattcttgtagaaataaagtaagatgcaaattgcctaacatggtacatggcacatagacacccagtaaacatttactgatccctcgacatcagaataaaagaaaagggtagttattctaatcttggtacagggtgtggcagaggatttttgctctggcttctggaaacttgtataagtcaaagcttacagaaaggacgtctggcattgggctagttattgcttcaagtacacgaatgcccccagagggaagcttatactctagattttccaggatacaaccatttatgctgtaggaagaggccaggagcaaagtaagctgcttgtgaataacagaaaaactgtccttgtgtactacgatgataatgttaacaaaggaagttatttccctaaccaaatttattattgacccgaaagtgagataaaaacgatattttttttttccagagccacataaagcctgaagagaaggctaggaaaagcaacgagctcgagaaactgggcaatgttcagatcagtagctatggaaaactctcctcattcttatgtcacctcagatttaatgcccacaatgtcccagtgtctgtacatttttatttcgagcatgaaataataataatgacaggcaatttaaaatgatgaccgctatttttgtgtttccttgagaaatggaccaattttctcatctattctggcatatggcatagtgtgtgtgtgtgtttgagtgaaagagggagagacagagagacagatagagagaaagaaaggaggggtgcaagaagagaagaatcacacagatgattcacacaacattctgccctcactaaaggaacagagaatctaaaagtttaaagtcaactcctctaggatatagtttaaaatagtctgatgtcaagggatgggcaaaagtttattcagtgtctacgtgccatgcaccatcttaggcaattggcatggtataaaattgctatggcaaccactattgccttaaacaatataagattaaaagggtttctttttttgttttgttttgttttttgagacagtgtcttgctctgccgtccaggctggagtgcagtggcgtgatctcggctcactgcaactgccacttcccgggttcaagtgattctcctgcctcagcctcccaagtagctgggactacaggtgcatgccaccatacctggctaattttcgtacttttaatagagacgcggtttcaccatgttggacaggctggtcttgaactcttgacctcaaattatccgccagcctcagcctcccaaagtgctgggattacaaccgtgagccaccgcgcctggccttcttttgtttttaattttaatttttatcaaaacaatactcatacttggtgaaaataaaataatgtggaagaactcaggaaaactgatattttcccattcagtctgacatatggtcatttcttctgattgtttccatatttaattctttggctagttattttcataaatgtagttaatataattataactctgtatcctgatttttcatttatggtcattatcaattaactcatgagaaatgaaaatttatctcacagtaatctcttccttctcatcctcttcccagtatttcatattatttttaacttttccattagttagtttcatactattaaataatatggttaaaattatttgtttccatcaactttctctgcatctttccaagttggaaagtgtcctcactcctctacattcctcttctccctcacattgcatcttccgtcagctctatattatttcacattgtcaaatatttattaacaattagattatgtctgaaaatttcaccaaaattcttactttatccatggattgactctaaatctgaacatgaataatctttacattactatcacgatgtaaatgtagtttactgcttggtcgagtagtgtattaggattacttttgattttctattgtttcaacgccaggattcttgagtcacatttttttaaaaaagtattcctagcattaaaaccaaatatattttccttttcctcactatttcatttgcctaaataggtatgacattttcatttgcttgttaatgtaccatacttttataatagggtttttatttttctgaagttctttttgcccctctcttatttgagagaagagggtcatttcagactttttttttttttttttttttttttgagatgcagtcttgctgtgttgcccaggctggtctcaaactcctggcctcaagcaatccttctgactctgcctcccaaagtgctgggattacaggcctgagccactgcacccagcccaggcttttattatctcctcaataattaccagtttttgatcatacattttactgcattcagacttccttcctggtcccttctgcttctggctttagtctggactgaagttctctaaatctgctgcaaatgtcatcctgaagattctcatcattgttttactggtttgaattcacggattcttgaatttcaggtcttcctttttctttttgctttcaatgacactggagtaatgtcctctagtacctaagacaagttgcttgcaaatcacattttctgagtgcttgcatgctttaatctctcattatattggccagacagaattttcagtgtgaaaataattttcttaggagtctttaaagcactctactttttgttttgttttgttttgttttaatagatggggtctcactctgttgatgaagctctgtgcagtggcgtgatcatggttcaccacagcctcaacctttcaggtttgagggatcctcctacctcagcctccccagtagctgggactataggagcgcaccaccaggcccagctaatatatttttatttctggtagagacatattttgtttactagcatccgctgttactcttcagaagtctgatgacagtctgattcttattcatttgtaagtgaactgtcttgtctctttgaaagcttctttttaatgttttgtaattttatgaggctgtatccaggtacaggccctcttttattcattgcactgaacattctacctggttttcagttctagaaattttttttccttcttttcttctgaaatttttattaataggataatgatgttaatggattgctcttctaatgtctcttttttattttgtatatttcatatttctatctctttgacatcatatattctgagagatttttccactttaattgtcaatccttcaattgaatgtctaacttcagtaataacccttctgttctctaagagctctttcttcttctctgtccgattttgtagaacatctgtggcaactatggaggtgcaccctcagatctcccttcaagcagaatctgctagaaatgattcagttaactgacagcttccaagtgtggtatgcttggaatccctgctgcgttaaatccatgccctcgctccctgggaagccccagccaatgaatgagcatggtggagactccagagcctggtggtttctgtcaattgggataccccaaagtgctggctgagattttcttagagctacactacactctggagctcttcctttccagtcctctttccttcccctcttctttcacagcctattagacctgcatcacagtctgaaagtatattcctctgctcactcctgttccctctcgcctttatcttccaaagtcattgcccccagtacatctcttaaacttattgtcttagcttttgcttcctagggaactagaactggcagagcatcctatcttgctttacgaacatacttgcttcctacatctctctatttcacttatttttataacacccaatacatctaacaggggacatttaacctggtgtagtgaactagtgggctcaaattgcactgtacgaagccgaaattaactagacaaaaagatgtcatctgtacgtcacaaaggtaaagggggagactgggtgcacttttcccccaactttccagaggcggcaacatttttaataattctaaaaaatgaaaaaattggcaatattagatgaaagcatgactttcttccatctgctactgcatacaattttccgattttgtggcaagatatgccacagcctcattcaaatcatttgcaccaagaatcatgcagtgccttgcacttttagttatcccagcacttgcccaagtcttgttttgccactggattttaggacttttgaggacagggactgtgtgttatctttagtgcctcataataataacaataataagagctgagccattgtttatcatgtgctaattatatgcctagccaggtaaggtggtaaacacttcgtatctattgtttcatgtgaaaacacaaaatctccgagaggtcatgtaaatggcccaaggtcccacagttaggatgaggcacatgtctgccttcctccagaatctatgctctctatcatatccaatactgcctccccctgtacctgacacacagaggacactcaatagctgtcaatccattggttgagttacaactgctattaactatagacaaataggtaatagaaatctcatttactgtcctataatatgtgttctatagatttgtgatggggaacgaatgaatatgcagggctgtggaagcctcatacattctcaaaaattatcttgctaggagaaagcacatcgtttaccaataccaaatcctttattttacatgaagttccctgacactgtgaagctctagtagtaagtgcttttttatctttgaaatataggggtggggggaggggggagggatagcattgggagatacacctaatgctagatgatgagttagtgggtgcagcgcaccagcatggcacatgtatacatatgtaactaacctgcacaatgtgcacatgtaccctaaaacttaaagtataaaaaaaaaattaaaaaaaaaaaagaaatataccttcttgttaagaggcagaacatatgaagtctcttattttccctcttacagcatgtcatttagggactctgtgggagaggaggtagtgtgtcaatatatgagtgcttgctctcatagagaaaaccagctctatttatctaagcttctccccattcccctggagaagtaattaaaccaaatcattgaccccttctggagtagcccaggagtcggttttatttatgtgaaagtaaaggatctgggaaaaagaaaatgtcattggggcaaaatcagaataaatccgtttacatggaaaatatgcacaggagatttgacagcatattttgtgatctcttttttccaatgttcagaaacatgaacttttataactacaaaggttatcccttttgtccttagaattcctttgtgattatacatagctcaccgggggttgcttgtcatgaatggttacaatttttcactcagctgttgttttaacagaggctcagggtttgctcaggaggtgaatatgtgactctcctccctcccccaacaatagcatagttatttaaaggcaaaattcccctgtttttctcctaatcgtttctaccaccataaagccgtaacatgcacattcacctcccttacttcttctcttcagaagatactggggattagcagtcataaccccagaatataaagtggtgatcccagtctttaaaattgggctgtgacatggataagagtctggcatgcaaatcatctttggaaaccaaggctgactagtgcctaagcaccatttcagttagtagcccatctaagggactatgggaaacatataagctgatactcttgatgccagatactaatgtttaggttatctctttggaagtgttatatcacctaatccagagccaatcaaagtgtttgatttttctcaaacctgacttaatacaagcaagactttaaaagtttaaaacattttggccgggcgcggtggctcatgcctgtaatcccagcactttgggaggccaaggcgggcggatcacgaggtcaggagatcgagaccatcctggctaacacggtgaaaccccgtctctaccaaaaatacaaaaaattagccgggcgtggtggcaggtgcctgtagtcccagctactcaggaagctgaggcaggagaacgccgtgaacccgggaggcggagctttcagtgagccgagactgtgccactgcactccagcctgggcgacagagcaagactctgtcaaaaaaaaaaaaacagtttaaaacatttttctgaaaggtggaattgaattgatctggaggacaaagagacggttgcccagtgaatcagaatttctacaaatgtttatcaattacttaccacctgtaagccactgggttggatgccagggatacagtggaataagtagaataagacagacatggccactgccgtcatggggcaatggaagacaatcactatataagtaaacatgaattatgattgatgtaggtcctacaaaggcaaggtttgggagctatgagactgagtaacagagggatgcaatgccacttgggtgatataggggagtctttcctgagaaggtgataacttaggctgagataagcaggagttatccaggggaagagtgagaggcaagtagtacagcctgtgggaaagcccagaagtgagaaggaaccgggaagccagtgtgtcttcagagcagagcctgaagttcttcacttgggatccccaggaagtctttgaaaatcagataattgtctgaccacagagagtgaaacttggttatacagcatttgcaatccacttgctattaggcatgcagtaaataagcagccatttcccaatgtgccatagcacagcatggtggtgaaatgtagttctctcctccagacacacctgcagtcataccaaatgttgtgtatacatggttattcattggagcattgactattctagcaaaagactggaaacaactcagtgtctctctgtaaggaactggttaaataaatcaagatataaccacacaatggagtagtatgcagctgaaaaataatgataaattatttacagacttagatgaaaggatctccaacatataacattaagtgaaaaaataagatccagaaaaatgtataacaagtgctaccacttatataaaaaaaagtaaaagtaaagaatattcgagagcataagaagacaatccacagggtacaataatatttgcaaaagacatatgagatgaagggctattatctaaaaaatacagagtggaaagatattctatgttcatggattggaagaatcaatattattgaaatgtccatactacctaaagcaatctagagattcaatgcaatccctataaaaataccaatgacattctttacagatgtagaaaaaacaatcctaaaatttagatggaaccataaaagacccagaatagccaaagccatcctaagcaaaaaagcaaaactggaggaatcacatcatctgacttcaaattatacttcaaaactatagcaaccaaaacagcatggtactggtataaaaacagacaaatagaccaatggaacagaatagagaccccagaaacaaatccacatacctacggtaaactcgttttttacaaaggtgccaagaacatacactggggaaaagacattctcaataaatgctgggaaaactggatatacataagcagaagaatgaaaccagaccccatatctcaccatatatatgaatcaaatcaaaatggattaaaggcttaaatctaagacctgaaactatgaaactactataagaaaacattggggaaaaactccaggacatcggtctgggcaaaaatttcttgagtaatacccaataagcacaggcaacccgatcaaaaaaatggacaaatggaatcacaagttataaaccttctgcacagcaaaggaaacaatcaacaaagtgaagagacgacccacggaatggaagaaaatattggcaaactatccacctgacaaggcattaataaccagaatatataatgagctcaaacaactctgtaggaaaaaatctaataacctgatctaaaaatgggcaaaagatttgaatagacatttctcaaaagaaaatacacaaatgacaaacaggcatatttaaaggtgctcaacatcactgattattacagaaatgcaaatcaaaactacaatgagatatcatttcaccctagttaaaatggcttatatccaaaaagaggcaaaaacaaatgctggcaagaacacaaagaaaagggaacccttgtaccctattggtgggaatgtaagttagtacgacccctatggagaacacttcggaagttcctaaaaaaactaaaaacagagctatcatatgatccagcaatcccactgctgggtatatattcaaaagaaaggaaattagtatatcgaagagatatctactttcccatgtttattacagcactattcacaatagccaagatttgaaagcaactaaagtgttcatcaacagacaaataaataaagaaaatgtggtacatatacacaatggagtactattcagtcatagaaagaatgagatactctcatttgcaacaacatgaataaaactggaggtcagtgtgttaagtgacaggcacagcagacaaacttcacatgttctcacttatttgtgggcactaaaaatcaaaacaattgaactcatggagttagaacacaataatggttaccaaagccttaggagggtagtggggtgagggtgggggaaaatggggatggctaatgagtacaaaaaggtagatagaatgaataagatctagtatttgatagcacaacagagtgactacactcaataatagtttattgtacatttaaaaataactaaaagagtataattgtattgtttgtaacataaagaaaagataaatgcttgaaattatggatatcccatttaccccagttattacacatcatatgcctgcatcaaaatatctcatgtaccccataaatatatacacctactatgtacccacagaaattaaaaatcaaaattaagtatacaaagaacccttgaaacccagcaaaaagaaaatgaacaacctaattttaaaatgggcaaaagatcggaacagacatttcaccaaagaaaatatacaagtggcagatatgcatatgaaaagatgttcaatgtcatatgtcattagggaatgcaaatttaaacaataatgatataccactacacaactatgagaatggccaaatccaaaacgctgatgacactaaatgctgacgagaatgtggagcaacaggaactctcattcatttctgatgggaatgtaaagtgacacaacagtttagaagtcagtctggcagttttttagaagactaaacatgcacttaccatatgatccagcaattacattctttggtatttactcacgtgagttaaaaatttatgttcacataaaacctggcacacagatgtttacagcagctttattaataattaccaaagcttggaagcaaccaaaatgtccttttgtagattaatggataaataaactctagtacattcagagaacagaatattattcagcactaaaaagacatgagctatctagctatgtgctatgatttggatatttgccccctgccccaatgtcatattgaaatttgatccccaatgttggaggtggagcctaataggaggagtttgtgtcatgaggcagatcccccatgaatagatgaatgacctacctgggtggaggacagagtgagtgagttttactctattagttcccttgacagctggttgttataaagagcctggcgtctcctgttcccctctctctcttgctttttctcttgccacgtgatctctgcatgtctccttgccttcctccatgagtggaagcattctaaagtcctcaccagaagcagatgcttgggccatctttgtatggcctgctgaaccataagccaaataaatctcttttctttataaattatgcagcttcaggcattcatttatagcaacataaatggactaagacaccatgtaagacatggaagaaacttaagttcaaattactaagtgaaagaagcccatccgaaatggctacatgctgtataattacagctctataatactctggaaaaggcaaagctatagagacagtaactaagatcaatggtttccaggggttgggggatggagggatgagtagacagagcacagagaaattttagggctgtgaaattgttcaatatgatactataatgatggatacatgccattatacatttgtcaaaacccacagaatattcaacactgagagtaaactctagtatcacctatggactttgggagataatgatatgtcaactgtaacaaatgtatcattctggcagggatgttgatagcgggggaggctctgtgtgtggaaggggacaggagatacataggagcccctttttactttccactcaattttcctgtgaacccaaaactgctctaaaaaataaagttgattgtttaaaacaaaacaaagtagagaatatatttgcatttggttgcatttatataggaaacccttgaaagttactcagaagactaatagaagcagttacctatgatattggaggtatggggcagatggggatggtggtaggaggctaaccttttattttatacctttttttaatagtctttaggcttatgagacatatgaatgtgtcatttattctaaaattaaattatatgaagtgggcactagagttaaacacatcatcttgattcctgactccgtcatttattagctgtgtagcattgtaacattacctaactcttcagtgcctgactttcctcatgagcaaaacagggctgataatagtttatacctcaaaggaatgttttgaggattaaatgagctaaatacatgtacagccactaaatcagtgttcatcatataataactgcttaataaatcatgaaggtagtcatgatgctgctgctctctaaaggcatgtaatttttcctatgatacctgtggttttctctgatgattgaaattcctggtggaattatgagtaatttttattttctttgttatacttaaagtattttccaaatatttataaagatcatgcatgtgtgatgagaaaaatccatgtttttttcattgtagtaagaacatttaacacaaaatctaccctcttaacaaaattttaagttaaaaatacagtattgttaaccagaggcacaatgttgtatagctaatctctagaacttaatcatcttgcacaactgaaactttatatttgataaatatcaatttcccttttctatctacccccagcccctgaaaaccaccattttactctctgtttgtatgtacttgactattttagatacctcatacaggtgggatcatgcagtatttttctttctatgcctgccttgtttcacttagtataatgtcctccaggttcatccatgtggtcttgcatggcaatatttcctccttgtgtaaagctgaataatattccattttgtgtacatatcacatttttcttatccattcattcattgaccaacatttaggttgcttccatatctttgctgttgtgaataatgctgcaatgaacatggaagtgcaaatatctcttcaaaatcctgaatttaattattgtagatgaatacccagaagtgggattgctggctcatatggtggttctatttttacttttgtgaggtacttccatactgtttttagtaatgatgtaccaatttacattcccaccaacagtatacaaggattccaattccaatttctccacatccttgccaacacttactatcttttttttttttttcagtaatagccatcctaatgggtgtgagctgatacaggattgtggttttgatttgcatttccctaatgatcaatgacatttagtatcttttaatatacatgttggccatttgtatgtctttggagaaatgtttactcaagtcctttgcccatttttttgtttttgcaattgagttgtgtgagttccttagatattttggatattaactctttatcagatatatgatttgcaattattttctcccaatctataggctgccttttcattttgttgattatttcccctgtcgtacagaaccttttagtctgatatagtcccacttatctattttttattttgttacctgtgttttggtgctgcatccaagaaatcattgctcagaccagtgtcatgaatcttttcctccatgttttcttctaggagtttgatagtttcaggccttaaatttaaatctttaatccattttgagtttatttttgtgtatggcatacaataagtttattttaaaaaaataaaataaaaattgtccatctttagtcttaaactctgcccactgggtcttgcctttacctgtgccctgcctcctgcccattaaaacagcccgatgcactcacccatgtgcactctccagcttttccaaaaattgcccttctggccacaccctttttccttggttcactgttgctccgcataagtcctatgcctggctttagaattctaacttcaaccctagctctttgggactaatgtttatatttgtttacttgaaccttgattatacttaaacataggtatgaattccatctagttttgtccccaggaaaccacccctgatgacaagctcttggctgtcaccatggctttgccaacgctggctgtcccctaagtttgggaatgggtggtgcataggaagttaagataatttacattttatgcagaatatataatttttggcatgataaaagagttggcatctgggcatgagttccaaccaaagaagtattaaatttataagagactcatttgaatttctaatgtgacatgataagcatgccttcttgtaaaaacattttacagaaaaatagaatagcatgacgggctggcggtacagacaattctgtcaacaactgctggagctgttccatgcagcattcaagaattccttgatttggaaaaaacaaataagaaacaagctatacggaagtgtaaggacgacagagccatgtgctgattgcttggggttttaaggaaaggacgggagtagggtgaactccctactagcctaaggtgaacattggattcgacaatcagagagaactcatcttaatgattggtcctacccaagatctcaaccacattctctgcatttccaagaggcaaagaaaatgagctgtcactaatgtgttttatgttaactatcaataggcggaatttgtgaaccgtcgcatgcttagcatccaaaataattccctttaggctgacataggaaagagaaaagaaaagataaaacaaaaagtgaacatttttgctggtttgaaaacatttatagcctgattttctagccaccagcatagaaatatttatttctcagtatcatttttatgtttatagtactttccaaattttctacagaaagcttaactttaaattgggaatggggctgagcacggtggctcacacctgtaaacccagtaatttgggaggccgagacggatgaattgcttgagcccaggagttggagactagcctgggaaacatggcgaaaccctgtctctacaaaaaaatacaaaaaattagccaggaatggtggtgcccgcctgtagtcccagctattcaggaggttgaggtgggaggatcacctgagcccaggagatcaaggctgcagtgacctgtgattgcactactgcattccagtctgagcaatggagtgagaccctgtccaaaaatacatatatacatacacacataaataaattgggaataggattttctttttctatgtattttcccctaatataaatgcaaacccaaacattataaaagcaaatatgtatgtttttatttgtgtgttttctcttcctcctctttctgctcctcctccttattctttttttagtgagttgtagtaaaagtagcagaaagtgtgcttagagaatcataatctgtagaattggaagtcacaaaaattctatgttgacacttggctaataataatagcaataataatcaatcaacagctttaaagtgctctgtcgatgtccctacatgacacttacacgtggactgagcaattggttttgctttatagctatgtcctaaggggcctccataaaaaagaagcaaaaagaaagacacaaaagagaagaagaaaggaaatgtcatttaccatgtatttagtgtatacaaaccctgtgccagatatgttatatacctgaattcatctgttctcctcaaggccctatgaatgggtgctagtgtcccagtgatggtgaggaaggagatgatggtggtgctggtggtaatgattaccagttttgaggctgtctgtaagctaggcactatactctcttcattcaacctgtattcattcaacaaatgtttgttcagtgcccatactgtgtgctaggccctattctaggcacttgagatatatcaatgtacaaaacacacaaaaattcttgctcctatgaagctacatttgggggtgaaagggacactagacattcccagataatacacatataagtagggaactgagagaatatgttagaaagggatacgtgctgtggaaaaataatagatcagaccacagcaggtcaggattgtggcatggggttcaggatgcaatttttaatcaagtggtggtagtagccctgactgagaaggtgatacctgaagcagctaaagagtttggctggccggcgggtggctcatgcctgtaatcccagcactttgggaggccaaggtgggcagatcacaaggtcaggagttcgagacaagcctggccaacatagtaaaaccccgtctctactaaaaatacaaaaattagccgagcatggtggtgcacgtctgtagtcccaggtactcaggaggctgaggcaggagaatcgtttgaacccgggaggcggaggttgcggtgagccaagatcacgccactgggcaacagagtgagactccatctcaaaaaaaaaaaaaaaaaaaaaaagagtttggccacatgagtgtcttggaggaaagggctccaggcaatgggagcagccagcacaaaggccctgcaacaggaagatggctggagtattcgctgaacagcaaggaggccagcatggctggacaggggagagaggtaactggggccagatcctgcagggcctttcagggcaatgaaaggagtctgtcttctattctgagtgaaatgctaagtcattggaaagatatgagcaggcaagtgacatggtctgatgtacattttaaaaacatcactatatggtatatatacaccatagaatactatgcagccataaaaagaatgaaatcatgtcctttgcaacaacatgagtgcagctggaggccattaacataaacgaattaatgcaggaacagaaaaccaagtaccacatgttctcacttttaagtgggggctaaataagcattgcatacacatagacataaagatggggccaatagacactgaggactactggaggggggcgtgggctgaaaaaccacctattgggtactatgcccactgcctgggtgatgggattattcagcccccaaacctcagtatcacacaatatacccaatgtaacaaacctgcacatgtaccccctgaatctaaaatgaaagttgaaattatttttaaaaaataaaaatatcactatggctgttgtattgaaataatattctcccttacatgtataatttagtgtgatcattttctgaaattcctataattctcattttacaagcaagaagtcgaagggtagaaaaatcaagtaatctttgagtaagtggtagagccaggaatcaaacccaaaccaagaattgtctgaattctaagcctgaactcattttatgactgccttgaaagaacaacttctaggttcccattagttcatgacaactgaaacatatgtttcagacataggaagaagcagcatgttctatctggcttaatagatggagggcaacaaaaataataaattaatggactaacttagcaaatgagtaatgagttcctcctatgtttgtagacaccgtgttaagtattggaggggcaaactcaccccttagatagcttatagtttaagaagtgaaagatagatattgacaaatatgtgtgataaagtattattgaaacaattttaaaagaatctataagctccagtgggggccaaaatcaaagtgatcaattctaagatggaggggatggactgtggtatgtgactctttgcagttgggaaaactttttctctcatctgatgtcttgtattgcctagtttacagtctcatagtttagttcaagtggcttaagaagatcttgtttttctcttgaggtgctttccaggaaaaaaatgtaagactttctcacttgaagcatcctctctgggtcttaccactttgccatcttgctgcattggagagtcctttggtgcagtccttccaaaagcccctgccaatcatcagggagggagcgttgggaaatgaagacatggtctgtgggcaccgagcctatcctgggtcagaattcctgattctacaatttactaaactgtgtaacacttggaaatccttgtaccctcctcatctgtaactcaggcataaaaataccacttcatagcattgtgttaaataaaacagccaaggcaagatgagcctgattcataacaattgcctgatgagtgtgagctctttgtgggattattttagcgacattatcttcccacaccagaatttgtggcagtgctgaactggtcattgctttggtcaacatttatagctatccctcccttggaggaggaactccagaaggctggctgctggctttatttattattcctgctggaagggaggaggacagaaggctggggaatcacaagccccttgctgggatttcacctcagctggttccatcagtagcctcaccccagggattacataaatattttgtgttcccagaacctcactctgggcactgtcccaagagagctcagtgtttagaatgctgtgtcctcagcagtctggcttcagactttattagttaagagaaactgcagcagacagaagccctcttttgagtgtttctagggagataatgagcccatcaccatcacaatcatcaataagcattggcttaacatgtcctgtctccaggacagtttgctagatgcaaaaatgattccatccttggggtcggcctagtgtcacttacttccgctccactctggtcacactacttaatatttgatgaccctttgacatgagacagtgaggacaggcatcagccctcaatgttggagatgactgctccctgatatagtcaaccaccaaattcatgggcttgaggatgaggcagaacccagactgctcagcagaactcataagctcccctacaaagagtgtttttgtgatttcctgggacacacctggaaaagcagagtcatggcccacacaggtgggaggacctacagaggggggtcttctgtaaacataaacatacatagactatccctatggggcctggagctcctgatctaaagcctggaatagggaaaaggagagcaagagagacaggtaagtcagtaaatacaaggcaatgggatatttgcagtaacagaaaataatgtacaaaacactcagagagcacaagtggcagtttatcctgatcccaaaggggcctaaaattcctatttataggaatgtagcttggtgagacctagaaaataagtagacccctgatgctttaaaaaaaaaattgctgaattgcaaaaccctgcaagggcaatgattaagcctatttgacttgctttatatcataactatcatggagttgaaagcatgtgaatattgaatatggtggaactcctgcaatagtaaagaaagggacatttgcaggcagttttgggtgacgactgggacagggtatgaagtgtggactaattggttgagtgctgactaggataaagtcatctctccattctccagaataatcttcacccatcttgattaggtgatttggggtaaatcaattaaatgttgggcttcggcctgtccacaaagttggaatttggcagcctatcctcccttacagaagcatcaaggagctgatagtcttagaaaggtgctttgtgtttccagaaagaaagttgtttgaacatctgaggtcttatcatttgcatggtgtgactcaataaaggcatcattatacttggggaagaaaaccagagttgagacacgtgagatgggagaatgtgttcaagcatgtcagaaatagacgagagggtcattgtcagaaaataaacccctggagcaagcgtggcattggaacgcatacctagaatggaggaatactcaggtaatcttctctttagatccctctgggctaattccaggagctacaactgagaagggcagtcaaatttggacaggcttcagaggaaagttgttgagttgattgaagggctggaaaatcatacctatgagagaaggttaaaggagatgggtctagcaccaatgaacagtgtgactttagacaagtcacttaggctttgaggagctctgttcactcatctgtaaaatgaggacagtgacctggcaaagcactcaggtccttccaggtctcacaatatttttacagtccaggaggagaggaagccaggcagtaatttgtcattcatttcaattatatgcctgttacaaatctctgtcttccttacaggagatataataagagtaaaaaggctgggactgtaggtacagctactttgctgaagacaaaacaatgccatggaaggctttccccaattaaacagagcagaattcgaaaaataaatgtagctaaccttcaaagtttttgttaaaattatattttggttctcatgtcttcagaaattagaggccaaccctcccacctggagccccttccccttgtcctatccatgctggcataagaccttcttgtttcctcctcttgggttgggtgggatgggaataatttatctgctctcaaaagagatgccagtaatttgtatgtgcatgcatggattacaggtcatcccaggacgctaaatccatttaaaagcagaagagaaacacctacaaaaaagtcccaccctttcaatcctgttaggccattcagcagaggctgcctgccagctgcagtcggtttgtatccaagaagcccaataaggtgatctgcctctcatggtccttgacctaatccctccatgctccacttctatttggaagagccaaagattgggagcaagaatagacaaaaagcagaacaatctgaggcaatagttggaaaacagaaccctagggcctacggctcccattcctcactgccaggttcaaaggcacagggtcatgttgcatggagtatgaaagcctaggatcatggccgtgctgatttcacctgcagggctaacacccaacatccaaatgtccaccttctagtagtgctcttactctgaactgatgtattcaaccttggctgcacattgcaatcacctgaggagcatttttaaaatgccaatgccccagccccatctgtggggaattaaatctcttgagcaagtgggttccagaaggaattgccttacatattgactgtgccatgaaccactatattcttccagtggcaaattaacttaaaacacacaaaacatcaggagaatcacaaaggaagaaaaaaacctagcttataataccatgtccctaacatacaatacactcccgtaaggaaaatggatgtgctgcagtcaagaataggccaaggcagacatctggtccagcatgactcagaaagtttggagtgcaggtgcacaactccacacgttatgtaaccacgtcatgtgaggctcattatgtaaccactccacttgaggcacattaggtgatcacccacgtgagcttgagcttggctcagagccactattgacgtaaaaggtctaactaccctgctgacattgtacatacggcttgtgtccacagcttgtttgggcccacggctcgatcatgcccagagagagagtaaaaaccatgtcaaaactctatgattccttgactgtttttccagctacctgccactggtccacccactctcctcagacctcagcttgggctgaaagctgacacttgccatgacaatcagtgtcatgaacaggatcccagagtgagtgagctttttgtccccgcagcttccacgtcagccatgtggccacaacatgggttgtggtacactgtgacagctatgatgtgaggatgggctccagtggagacctgagcggtggtagatgggtaccccctgggcatggagaaggcactgaagcagctggaagcacagaacaccaagaagtagcgagcctttgctggcagagttggatgggtgtttttgactatgctacacaaccagtacctgagggatgcagcacaggtaagggccctccaggcacaggtggggtgcctggaggcccaactacacagctcagaaaaagaattagatgctgctgtgaatggggcaggcagggcgcctgaaggcctggctacagagcttggaaatggaattagaggctgctgtgaatgcaggacagggtccgttgtctcagccggagacccccacttggtctgagtctgcaccataaagaaggggacgctgcctcacccacaggggcccccccaacatgggagaaaaggaggccccagtgagtgacatgttcacagatgtggagagatatttgattttggcctgggttgactgagagaaaattgataagcagcccaatgaagtactcttaactttgtggagacagagcagcaattccagaaaatgcccaaggggaaggacattgctgtgtgaccctgtcccacccgggtgcttcagctcaaagactacttgctgcagccaggtagaaatgtagagcttttcctgtttgattagggaactggccgaggtgcctggcttggggggacactggaagaccagaggccacatgtggaattaccaatctactggtcccctaccagtgtacagcaagtgctgggctgttagacaccagtgcagatacattctggggggatattttacatggcttggcagctgtgccatctatcaccaacctgatggaccacttgacagaactgggacagtatcactatgtcgtggacttggctaatgcattcttttccagaaagccaggaagtttgccttcatgggaaggtgacaatggactttcacagtgttgctgcagggctatgtgcatagccctaccgtatgtcatggtcttgttgatgatattatgctaacctctgattctcttgcagatttagaagcagtaatgcttcccttgtctaaaattaagatgatgacactgagacagcctttctagcagctaggtgggctattcaacagtcacaagccctatgggtaattaaccaggggcgcccatttaaactcgatgtgcatgtgaccacagatagttttggctggggcctatagcagcacttggagcgcttgagaacaccagtaggcttttggtcccaaataaggaaaggaactgaactccagtattcattgatagaaaagcagttagtaattgcatatgttgcccttcaggctcacaagagcgtggcaggacagactacagtcatcaacttacctgatagtgggacggatgcattcatggataataactccctggacagggaaagcagttagcaactgtatatgctgcccttcagtctcatgagactgtggcaggacaagctatagtcatcatgcagatgacctacctgatagtggatgggtgcattcatggataacagttaatgaccccctggactgggatggcacagacatccactttagcaaagtggagtgcctacttggagcagcagagcacactgagtacaagtccccttgcagcagagttgcaagaggtcttgggacctgtggtcctaatgcaagataaggccacggggcctgaggcacccctagaccctgagccttcaccatctaaggaaaggtgtccccccattcccaatggtgcgtggtacacagatgggtctagccgaggtgctgctgctgcctggaccagaccactgttgcagtccaacctagtactgccaccctatgttttgaaactgggtgtgggcaaagtagccaatgggctgaacttagagcaatatgaatgaagatcaccaaggaagtgacacctatgacaatccacaccgatagctgggcagtttattgaggcttaaccttgtggttaaccttgagattaacatttgagttagtgggctggggaaggcagacccacccttaatctggcaggtaccatctaatcagctgccagcgaatgtaaagtaggcagaaaaatgtgaaaagtctacactggcctagccttccagcctacctctttctcccatgctggatgcttcttgctgttgaacactggactccaatttcttcagttttgagactcagtctggctctccttgatcctcaagcttacagacagcctattgtgggatcttgtgatcatgtaagttaatacttaataaactcccatatatatcctattaattctgtccctctagagaactctgactcatacagtagggaaataaaaacctggcttagtgtataaagcaacattggggtaacatcaccatggggtggttgcctgctataacctggagttgttgctccctgtattactgctgtggcctctggttacacaattccaccctgtgggtgtgtctccccactagaatactcccttagcctagggggtgggatgtaaggcctatgtgttgaacctgtgtgtctggggcctgtgtgcccagatcctatgtataaggcctatgtgtcagaccagtgtccaaggcctatgtctccttcggcctaggggatggagtgtaagaaaaatggatgtgctgcagtcaagaataggccaaggtagatatccagtacagcatgactcagcaagtttggagcacaggcgcacaactccacaagttatgtaactatgccatgtgagcacattaggtgatcacccacatgagctggtgcttggctcggagccactattgtctctaaaaggtataactaccctgatgacgttgtacatatggcttgcacccatggcttgtttgcacccacagctcgcttgcacccaaagagaggaaaagccatgttgaaactgtctacaattccttcagtgttcttccagctacctgccacttgtccactgactcccaatggacctcagttagaacctaagaactccttaagaaattctcttcttgtggagatgctgtttcttcactcctatgttaagcattcttttgtgcagtatccattgattacctgatccatatgaagaatacctaccctcaatgagttgtctgtaaaaaaaaaaatagtggcagattaatgttgatatccacctattgttgctgtttctcccaaccattgtgattctgtcatagtgcttggcacttagtagaagctcagtatgtttttgataactgacggacaatctttgaccttgcccctgaaaatttcagcccaccagaggcttagatggtattaaggaaatttattcagaatttagaatggtggtagcagtaaatcaatgtttcacattcataggggctactggcggtagaatgggtttacagaatttcatttccatctacagttttcctgccctatttcacctgtcagacaaagggctcacatttgtattctctctgcaggatgttttcaccttgtctgcatatgcatcattaaatagttcaagatcaattgcagagtagataaatagtgaaacagtgaaaatctctttcagagtttatggcaaatttcagagctgggttctttgattccagttatacctggattattgttgctgtttagcatacctttgcagttcccctgtaggtgctgggtgatggatggggcaggaacgcaatttatcaaagcattatgctggcaaacagatcgcaagacacataatgccactcatcagtacccacttacaaacctgtttctcactcctattcatcttgttcaagcttctgcctctacctgaaaggcttcactcacaaccaccctcttcattcacttctggcaattttaggttacctccttcagaaagtcttccttgggacctcggagtcctgatggtatccactgtttctccctgtgaccacacctaccattgaatttgaacttattgaagaagagagcctcactatagggaaacggaggagtgaaagaaagacccagggttctagcctggtgacttctgtagcaaggaagatagacttttctgttcactaggggagagagagaaaacattttttctcagaacatgtttggatggtggctagacaattatatattgagtttatatattgatcaaaaatgtattaagtgtctataaactgttaagtgctgtgaattcggaaatgagtaagcttacagtgactccctcttcctttggaatgccttgtggtcatcctcaactctccaggccttccctgacatcctagggcttcacctcctcacctcccccttgcaacacagtgctggcctctcacttccctcccctgtttttagtctcttttctccaaccaattttgcaatcagtgttcacactaatcttcataaagggaaaggcttgctctcgccttgcgcttgctcaagaatctataatggctccctgttagtttttttttttttttccttaaaggcctttttgttttgttttgtgttctgtgtttgtttttcttaaaatgcctttcctaaaatgcctcattggctgactgcatccaaactatttaacttatatctacctactactttccttctcgccccatctacccaacacagattgttcactccagtttagctggctatttcccttcctgtcccattagcctgcccacatccctcccactttcctcattgcgcatgccagcatgtggctttgtacagctcctcactcagcagacaatgccctcctctctatgctatgccagactttctgcctgtcctcaaggcatatcccaaccccacctcttccaggacctctaccccaccactgcaactcccacttgtctcttctttcctcggttttcttctgcactataagctggtaccatgactccttatggttccctaaaaattgcatactcctgagacaacatatactatttcttttgcattcttcactttgcctatcacattgtatccagcaaacgtgttgatgctcatcatctgttaagaaagaaaaccactttgggaggccgaggcaggtggatcacaaggtcaggagatcgagaccatcctggctaacatagcgaaaccccgtctctactaaaaaatacaaaaaattagccgggcatggtggcgggtgcctgtagtcccagctacttgggaggctgaggtgggagaatggcatgaacctgggaggtggagcttgcagtgagcagagatcgtgccattgcactccagcctgggtgacagagcaagactccgtcttgaaaaaaaaaaagaaagaaagaaagaaagaaaacataccttattcaccttaatagatagggttgttataaaaggccagtttgaaagggtataaaacactgagaaacaagctctgaattcatgtagggaaaataaaattaggccatgtaaaggaagaatcatgtatatgataactttgatatacttaagatcttaagatacttgttagagcaattattttgataatgctataaataataagaacagtaaactatagccattatttcaatatgattcaacacacttaagagcatttaatgagaatgtaccatgtggcagccttgggacttggtagaggacctcaaaagggaataaactataagcagaaaataactgtatcaggtagttatattcaggtagttatatatgggtaatattataatagtgatagcatttttaaaaatttactttggcttatagtatatggaatgactcatgaaatccggaccttgatagaggatgcaggatttttgaaagggagaggtaggaccttgtagggtactggggggtgagaggaaggatagaatagagtgatagtgctcagtggaacaaattgcatagaatttgaaagtatggattatttcagacaatagtcagttatatgatatttagttggaacatgaggtattgggaaaagggaaagagtatcagaaaatatggagggttagaaaggttcattggtgccagattgtataggcctgaaggtttgaacattttacataagaaaaaaagaaactattgaaagttcttgagaaagtcttgattgcaaattcttcaaaattttgcaggataattctctttaggaagtcagtgaagtaaaaacttggcctaaggcaatgaatttcctttttgtttgaaatgctagacttgaaagaaatatgtcaaataaaactgaatagtgttgaacatctcagatatccaggagtttgttctctaatgtgtggaactttgttgaaatgtataatatttgtatgttctcaccattgtcatacaagcaaatggcatgcttttgagaatgtagatctcctcagatgtttcctggctagtacaggatgtactttcatttggaaggttggctgtctggagccctaacttgggttcacttgcaccttgcagggttgaaatgattttaggtgaaaggtggccaccgtctctaacaggaacagttctttccacttttagcaagagtgcccactaatgtaaaagtaaatcagggagactaaaatcaaaaggaattaattgtcaccaacaattccatttgcatttatttattcataattagtatttactggaagtggcagcttatgctcattttctctggatcattaaaatgtactcatctgagccataaacaaagccagcaatgcccaggaatcaactggaacaattcagttagtgataattgcatcacagctcccctgtagcatctcgcaaaggttcatttgattacagttactaatggcaatcctggcacatggagggtatttattagactagtggttcttgggtttctagccttagatttgagggggaaaggacactgctctgcaactgctctccctcaaaagcatttcaacaccttgcctaaactggtgagaatacagtaatataatagtggtaaaatgattagaaattgattttgccttacggttcacggaattgactcatggcatcagggccttgatagaagatgccggattttgacaaggagagagaagacattgcagggtattgaggaatgagggaaaaggtagagtaataatggtaagagaagcaaattgcctgggatttgaaagcatgggatgaaataagcagttatttatatgtctagaaaatatattattactgtccaattttaagcacgaatgctttaaactttaaggaactggtcttacctgagtcccataaattatattttgagagccatttatcagataatcgataaatgaaaacaaaatcaaacaactcaaatgaggcaagaaagagagctgaaggaatgggtaagacacagtcaagagcatgttttggagagtgccagcccccaaaggctgggcttgtggttcttcttagagatgaacaatcttgaatcttctatttcagattcttggctggaaacaccttatcttagagtccctcaggttcagacctgacctaagacacatgttatttctttacaaccactgagtctgttagtgttgtacacatattaaatgcttaatggtttgctgaacaaatcttcatagatacttcaactcacctatttaaataaagctgaacctgaatgaagagatctccatgtctggataaggtccatggtttgtttccaaaaggggcaaaagttggatgcagccagagattctttgttgatttgttcatagttatctattttttgaaggttggtttgtttgttgtactatgttttttatacagctgaattgattgcaaaggtaaaataagaatttcctttcccagggctatattcattcttcccaactgaggtggaaaattccagtattagttttagcagtacttgaaccatcttctccctaatatagtgcttctagggaacatggggaaattcttaagcctgggtagccaatatgaaagatccagaaagaatcaaatataatgagaatgtctgaaagaatttgttctctcaagcaaactggtctatcagaaggactaatagcttgggcctattttgctcaccattttagaggggctacttaatctcctagtgcctgagtttccttgtctgtaagataggaataataggccaggcatggtggctcacgcctgtaatcccagcactttgagaggccgagggggtggatcacttgaggccaggaattccagactagcctggccaacatggtgaaaccctgtctctactaaaaatacaataattaggcaggcagggtggcacatgcctgtaatcccagctactcaggagggagactgaggcagaatagcttgaacctgggaggcggaggttgcagtgagctgagatcacaccactgcactccagcctgggtgacacagcgagacaaaaaaaataaaaaattaataataataataataataaagagtgttgtgaggattcaatgagttacacatgtaaatacttggaagcgtgcctggaacatagtaaatttttgattaatgctagttttcattatttttcttaatctaattttttctgaacttgtaaaatacatttacacaatagcagtcacctctcctgggggatttagaaatagtacccactatttattgagcatttattatgttccagtcctctggcacatgtctactttgatcctcacactaatcctatgagaaagttattatcatcagtttcggtaaagaaactgaggatcagagaaataacttggccatacctaataagcaatggagcggggatttgaactcccaccctactgggctagttctctaagatcctaaagaaactgctttgtatcccaacatgaaactgaactcagttaaaaataagcacacgggctaaagacctcttttccctgacttatctctcatagcatagattgcttggtgcctctcagagaatttccgtttaacaccctgagattagttggccttgtggctctgatcagtggaggtctgtttaactcaagtcacatgtgggtattttcactccaatcataacgtcagttctaaatctgttggtatgtcacaaaggcacaagttaaaacccaggaaaaaacttgagctgttactgttcccaagtagaaacatccttagcagcttatctgaacagaaggccaatctaaaaccttggaggtttgcccagccccggtttcctgtctaactgaaagcagagagcccagacacagagccaagaagttcacgcttgtgggatcagcaacctaaatttgagaattcggatcagtaagaccaactgcagcctgcagctagagcggtgctggagtcatgggcccgatggtcccaagggtgcaaggaaaaacttatgagatgactaaggtaattgttaggaatgaaatcaaaatacaactaggcaaaccaacttcccaactggcagaggagagagaaatctccctgggattatttttatagattagtctgctatctttagcttccagaaatgattttttgctgtgtgtgataatgctggtactgacgtgtaccgagcacttaccacatttgtgatactgcgctaaacactttacacactttacttcaatcatgagtgattacaactcaggtatatggacatgattgaaaagactggtacacagcttcagagtttccatagagggtgtcgttttagcagaatctttactaaaatgagccacccctgtccttaagagctgtatcacctcacctggctaccctgttttctagcacaaggtcaccttgagtcaagatgttcagttttgttgtcactgtgccatggccatgactgtgggaataaccccatctgcttaccttgggagatggaaactttgacgaactcaaggtccttccccagatacttccagctacttcccagtgatgcctcctgctctggctaccctaaacctacagtcaaactatgtctctctgcagctgaaaaccccccttaattgcagtaaacaggataacatctgtgggaagaaaggcaactatctcttcacatgttgttttcttagaggggaagctttcctggataaccaagagacttcatgtctcattggccagcatttgatcatgtacccatttctaaatccatcaatcacaggaatgtgactgccgtgtttatcttggactaattgggatctgcccctcagccggggatagggtcaacttcccctgaatcaagtgaatagaggtagatccccgaataaatcagagttaagaaggaagggctggtgagactagacacagtagagcagccatcagtgtcctacgcaggcctccgtatttcacggaggtagtttccctccctcccacctcatgccccagatgaagtcttattttcccttaagtattgctactctaggtctgggtcttgctgttcccccaaaagaaatatccctcttcatattcccaaccactcttatatctacctttattacaacatttacatattttttcacgcctatcttcttttacacatatctctcctagttagactatgagatcatagagaccatgtgttactcatttttaaaatttccagtacctagcataattcctgggataaagtaggtgcccaataaatgttggattgatatgatttgtgaatttagtttatgaaagtctatttcagcattacttagaattggatagaacaagtttggttttaaaagtgggagaaaaaggaagatgataatattgtttcataatcaatttttaacctgcctaattcaaaaaaaaaaaaaaggatgtaagggagcaggggtgctgtgtgtaatgtgctgtgcttaatgttgcttttcttttatttcccacagcacacaggacacggtggggatgcagcatcttggacctcatccgcctgtgctctaattcaaagacaaatatgtttcccaacttgcccaaggctctggcagggaaaactcagatccccaaactcaggtcgttctagtgcagcaataaccagctgggttttcagcaacttggatggagccatctgtgttcccagcccacataaaaatatgcacaagaagggtgcaaatcagcaagtccacagcttccagaggccccagctgggatgtgccctccctttggggactaatgaaaggtaaatccagtgtcaaaagacagagggccagcagcaagactatggagctaagtgagtccagactctggtcccttttctgactttgcctgaaatagagcccatctggctccctggccactgtgcttgtgtgaagggcactgcagtgcatgctgaatgcctggaaaattaccagaggtctcctgcctctctctctgggggcaccaggaactggccacataggaactctcttctctgatgctctgcattcctctgactgcctggtcaacccttaagctttcacataatgagcctggtgagcccaggtggtcaggaatagaggggctttttgtgtcttggtcttaaagaagggagcccctcagattttcccacatactcccccttcctttcctaccactccacatcacagaagggaatttagagtcgtcttggctctccggctaagacagaggacagtagattccacatgaaaagccaaattaaatgggggtgctgttactcagccacccaggtgcagatggcttttggcagcccagtactgggcggtgattgagaagagtctgtctcgaagtcattacagttaattgtcacagagttacagactcatctgcaggcaaagagccagctcaaaatccccagggaattttcagatggattaataaacaaaatggcatatgtgtaaagcagctgattctctacaaagaaatgatagtattatttctttactcttcattcctggacccaggactattttacagtctctttcacatcttggaaggcatttgtccaacagggctctgagtcaggggaaagtattttcttccttgtttttatctagtagcacagacactttcactatggggttagtgcatttttcatggctcctggttcatctcagaaaaatgcacatcaacccagccatcctgttgactaagtggcattcactaagccaatattccacatagaaacactgatgcggtcttaacaatggtagagtaaatggcatcaccacctgtctacatacgtaaaacaggtgcacagttgggagctggagccatagcctcattgatatcatagacagaaacaggatctgttcaatagcactggtactgaggagaaaagcagcacagtactggatcctgcacatcacttccttttccagtttctttgatttttctgctaaagtttatatgattactcctgagaagcaggaattgcctcagaaagttatcctgctctttggcataaccgccctgctggctcaccctgccccacaaactctgccagcccagtgtagaggaagagagctgagcatctgctaaagtccctccatcaccagtgatctgtgcctgaatttgtcgttccttgctgcttgtaaatttcatttcctctaagccttctctatattacatagcccagagaagtactggttaatgaaaaaatgaaaagcttgactttacaaatgaagaggaaaatgcactctttaaaaaaaaagttgcagctaagtgaacttatatgtgtgcaagaaaagaaaattgtttcgagctgtttaagagtaataattacattacattaccgtgttactgtctgaagatattcatattttgcttttttatttttttggtggagtgttgttcagttgcccaggctggagtgcagtggcatgatcttggcctcccgggttcaagcaattctcctgcctcagcctcccaagtagctgggtttacaggcatgcaccaccatgcccagctgatttttgtatttttagtagaggggtttcaccttgttggcccagctggtcttgaactcctgacctcaggtgatccacctgcctcggcctcccagagttctgggattacagatgtgagccgctgcacccggccttattttgctctttagtgctatttcctgtttaaatttctcagtgtgactcaagagtctatcatactgagttcatgctcccagtatttaaaactgcatgaaaataatgcagaaaataatttgctagcgttgacttgctcccagaacttaaactgatcaagcaggacatctgaggaataatactttttagcagggattggcaaactttttctgtaaaaggccagagtgtaaatattgtaggttttgtgagccatacagcctctgttgctgatattcaattcagtccttgtaacacaaaagcagtcatagacaacgcatgaagaaatggtgtgtctgtgttccagcaaaactgtatttataaaaacaagttgcagattagatttgactcacaatttgttgatctctgctttgtagtaaagccctgataaattttcttcttgggttaagtagtgagtgggaacttgccacatcagagtcattttggggagatggcacatccccacatgagagccagcatggaaaaatttggtttatttctcctactttttaacagtaagtgacaattttgcagctattttcagcttacaaggaacatattaaccacttgaacttccaattccatgagataatgtcagcataatgcagattattccttatactagacttccagtttctgggaatagcaggtacattatcctactgaaatgctgaatataatacaaaaagcatctaccttaaagcatccaggagctaacaagatagaaaggaattacctgacctaaatgggaggaaaatattaaggaatcacataaacaacttttgccctgatatatttgctgatcctgcaaaactgaacttccttttgatgttttcatgggatgctcagtatttaaagccaaaggctacataagtctgaaagtctactaagaaattgtcgatacaataaacttgaacctcaaaggaccaatcccaggagtgaaaaagaatcagaagtgacacagccttcctgcatataagcaggtggctttcacattctctggtgggtcaaggactctcaagccttgaatttggcttaagtggtagttcctccagatatctttcagaagcaaatataaattctttctgaaggaaggcaacttcagttcatcctgggccttaagtacccctataaatgattttgtaaacacaaggaacaataatatattaatagatttttttaataaaagaggtacataagtaaacaaaacaccatgatgtcacctaaatttgaagatataatggctgccattttttcaaaactgatgaaagatatcagagaagtactacaaaccccaaatgggataaatacaaaggaaatcacaattagactcaaacaaatttccaaatacttcagctactacaattatcatatacaagttatagagcaagaatgtttatgattcttaaggaaaaaaataaagatcagcttagtagcagaaaaccataacataatcacaggtagatttttctttgaagaactaatagaacatctacaaagggaaaatagaaaaatcaaaaaattttaaatttaataaatatttttagtagcagattagacataccaaaagagagaattagatatcagtagcccaatttttggagaagaggtgttcaatatttcacaattagcaagtacctaataaatgataagttaacttccttggacctaaaattccacagacttctcaattcatggccaactttgtggttaatatgtgtttatattgctaaggataagaggaaaatatatcttgttttttctattttcaatccagttttggtgctacattctgcctcttaactaaaagctcttcaagtaaccaggacattgatacctttgtcctgtttaggattttggtcttatggtcaaattcacttgatctgccgtggctgaattcaagtttttaccttcagtttcagtttgttctaacctctttttaactaatttcactttggctgagttctgcccagatgccttcacaagaaccccgagggttggcttgacaaattcaataggattttcgttgtttcctataatagacaatatgacactaattccaattacacttcccctcttaatttggtgttatgattttcatgaatctaaattatctctatattttaagccccataaggcagtaactatgcattagatttaccatttgctttctctattgctcttcattccctcttggattgctaggataactttccttctgtccaaagaattcctttaagcatttactttattgtgggtcccctggtgatgaattctgttttggcttatcgctaaagatacatatttcattttcacatcagtgatgttttccctgaataaacaactctaggttggaatttttgtttttcatgttttcttttgccactttaaagatgtcattgcattgccttctggcttctatttctctttggaaaaagtagctgtcagtcttattgatgttcctttaaggataatgtgtctttttccttagatgcttttaagattatagtttgcagaaattttataatcatgaacctaattgtgatttcccttgtatttgtcgcacttggggtttgtggtacttctctgatatcttccatcagttttgaaaaaatcgcagccattgtatcttcaaatattgcttctgcattattatctctctccttatctctgtacctccaattatatgtatgttagactttttctctgtgttctgtatagccctcatgatgctatttttgcattttttggtctttttgctcaatgaagttcaattttaatattttaactgaagtattttctagttcacaaatccccttttttgttatgtctaataagcggtttggtcctaatttcagttgtctcattctttggttctagaagtttcatttgatacttttattttattattattatttattatttttgtacctacatagtaggtgtatatatttacagggtacatgagatgttttgaaacaggcatgcaatgtgaaataagcacaccaaagagaatggggtagccatccccttaagcatttatcctttgatttacaaagaatccaattacactctttaagttattttaaattatacagttaggttattattgactataggcaccctatcatgctatcaaatagtaggtcttattcattctttctaactatattttttgtacccattaaccatccacatctcttccctcccctcccaccatccttcccagcttctagtaaccattcttctgctttctatgtccataacttcaattgttttcatttttagatcccacaaattagtgagaacatgtgatgtctctctttctgtacctggcttatttcacttaacataatgatcttaatgatctttagttccatccatgttgttgcaaatgacaggatctcattctttttatggctgaatggtactccattgtgtatatgtaccacattttctttatccattgatctgttgatggacacttaggttgctcccaaatcttagctattgtatatagtgctgcaacaaacataggagtgtagacatcttttcaatatactgatttcctttcttttgagtatatacccagcagtgggattgctggattccactggtagctcaattttcagttttttaaggaaactctaaactgttctccatggttgttgtactaatttacatttccactaacgtgtttgggggttctcttttctccacatcctcgccagcctttgttattgcctgtcttttgaaatataagccattttaactggggtgagataaatcttattgtagtttttcatttgcatttctctgataatcagtgatgttgagcacgttttgatatgcctgttgtcatttgtgtgtcttcttttgagaaatgtcttttcaaatcttttgcccatttttgattggattattagatttttttatagagttgcttgagctctttttatattctggttattaatcccttgtcagagagtttgcaaatattttctcccattctgtgcattgtctcttcactttgttgattacttgctttgctgtgcagaaggtttttaacttgatgtgatcctattcatccatgtttgctttggtcacctgtgcctgtgggtattatttaagaaaactttgcccagtccaacatcctagagagtttccctcgtgttttcttttagttgtcgcatcattttaggtcttagatttaggtctttaatccattttggttttatttttgtgtatggttagagataggggtctagtttcattcatttgtatatggagatccagttttcccaacaccatttattgaagagactgtctttttcccagtgtatgttcttgacacctatgtcaaaaatgagtttactgtaggtatgtgaatttatttctgggtattctattgtgttccattggtctttgtgactgttcttatgccagtaccatgctgttgtggttactaaggctctgtgatatgattcgaagttatgtgattcctccagatttgttctttttacttagaatagctttggctattctgggtcttttgtggtttcatataaatattaggatatttttttctatttttgtgaagaatgtcattggtattttgataggaatttcattgaatctgtgggattgctttggatggtatggacattttaacagtattgattcttccagtacatgaacatgggatctctctcctttttgtgtgtgtcatcttcaatttctttcatcaatgttttagtttttgttatagaaatctttcacttttttggtgaatttaatttctaggatttaattttattagcatctgttataagtgggattactttcttgatttcttttcagaatatgtgctatattttcagaatatatgcatattttctatatgctatatcagtagcatatagaaatgctactgatctttgcgtattgattttgtgccctgcaacattactgaatttgtttattggttctaataggttttttttttttttttggtggagtctttggatttttccagatataagatcatattatttgcagacaaggataatttgacttcttcctttccaattcagatgcctttcatttttttctcttgtctgattgctttaaataggacttccagtactatggtgaataacagtggtgaaagtgggcatccttgttgtgtttcagatcttagaggaaagaatttcggttttctccattcagtatgatactagctgtgggtctgttttatattgcttttattatgttgaggtattttacctcaatacccagtttgtttagtgtttttatcatgaagggatgttgaattttatcaaatgttttttcagcatcaattgaaatgaccatatggtttttgtcctttattctgttgatatgatgtatcacattgattgatttgcatatgttgaatcatccttgcatcccaagaataaatcccactcagtcgtgatgaatgatctttttaatatattactgcatttgatttgctagtattttgctgaggatttttgcatcaatgttcaccggggatattagcgtttagttttcttctttgatgtgtctttatctgcttttggtatcaggataatactggcatcatagaatggtttggaagtattccttcttcctttattttttgaaatagtttgagtaggattggtattagttcttctttaaatgtgtggtagaattcagcagtgaagccatcagatcccatgtttttatttactggtaggctttatattagagcttctatcttgttacttttattggcctatttaggttttgaatttcttcctggttcaatcttggtaggttgcatgtatctaagaatttgttcatttcttttcaattttccaatttattgacatatagttgctcatagtagccactaatgatcctttgaatttctgcagtatcagttgtagtgtctctgttttcatttctggttttatttatttgaattttctctctttttttcttagttagtctggctaaaggtttgtcaatcttgtttaacttttcaaaaaaacaactttttgtttcattgatcttttgtattttttaatttcaatttcatttatttttgctctgattttattatttattttcttctactagttttcggtttggttttctcttgcttttctagtttttaaagatgcatcattagattattcatttgaagtttttcctcttttttgatgtaggaatttatagctataaacttccatcttagtactgcttttgctgtatcccataggttttggtatattatgtttccatgattatttgtttcaagaaatttttcaatttccttcttaatttctttattgacctactggtcattcaggagaatattttttaatttttatgtatttgtgcagtttccaaaattcctcttgttattaatttctagtttcattccattgtggtcagagaagatgcttgatattattttgatttgttttaatgttttaagacttgttttgtatttaatatatggtctatccttgagaatgatccatatgctgtggaaacaaatgtgtattctgcagctcttagctgaaatgttgtgtaaatatctattagatccatttggtctatagtacagattaagcatgatgtttctttgttaattttctgtctggaagatctatccaatgctgaaagtgtggtgctgacatctccagctattattgtattggtgcctatctttctcattagcactaataacattttctttatatatttgagtgctccaatgctgggtgcatatatatttataattgttatatcatcttgctgaagtgacccctttatcattatacagtgaccttctttgtctcttcttacagggattttgtcttaaaatctattttatctgatgtaagtatagcaactcttgctctttttttgtttttatttgcatggaatgtcttttttcatccttttattttcagtctatgtgtgtatttataggtgaagtgtgtttcttgtaggcaacagctcaatggatattgtttttccatccattcagccagtctctgtctttcgattggagagtttagtccatttacattcaatgttattattgataattaaggatttactcctactattttagtatttgttttctggtggttttatggtcttctctttcatctttccttcctgtcttcctctagtgaaggtaattttctctggggatatgatttaattgcttactttttattttttgtgtatccattgtatgttttttggtttgagataatcatgagatttgcaaatactatcttataagccattattttaacctgataacaactggacactatttgcataaacaaacaaacaagcaaaaagaaaactaataaaaactgtatgccttaatttcatccaactgcttttaactttttgttgtttctatttatatctttttgtacggagtatgtcttgaaaagttgttgtagttatcatatttgattagttcattgtttagtctttctacttaggataagagtagtttacacaccacagttaaagtgttacaatattctgtgtttttctgtgtacttactattaccagtgagttttgtttcttctggtgattattgcttcttaatgtcctttcttttctgattgaagtactctcattaatatttcttgtagaacaggtctagtattgataaaatcatctctcaactttttttgtccaagaaagcctttatttctccttcacattggaaggatattttcatcagatatactattctagggtagaagtttttttttcttcagcactttaaaaatgtcatgccactcgttcatggactgtaaggtttccactgaaaagtctgctgccagacatattggagctccattgtatgttgtttgttttttcttgctgattttaggatccttttttatctttgacttttgggagtttgaatattaaatgccttcaggaagtcttctttgggttaattctgcttggtgttctataaccttcttgtacttggatattgatatcttactctaggtctgggacattctctgttatcatctccttgaataaaccttttacccttatctctttctctgcctcctctttaaggccaataattcttaggtttgcccttttgaggctattttctagatcctataggcatgttttcattgttttttattcttttttcttttcttttttttctttttttttttattgagacagagtcttgctctgttgcccaggctggagtgcggtgacatgttctcagttcactgcaacctgcgcctcccgggttcaagtgattctcctgccttagcctccctcctgagtagctgggattacagacacttgccaccatgtccagataacttttttttatttttagtagagatggggtttcatcatgttggtcaggctggtctcaaactcttgagctcaggtgatccacctgcctccgcctcccaaagtgctgggattataggcatgagccaacacacccagcattttattattttttcttttgtctcctctgactgtgtattttccaatagcttgtctccaagctcactaaatctttttctttttttctttcctttttgttttttgagatggaacttcaccctctttgcccaggctggagtgcaatggtgcgatctcagctaactgcaatctctgcctcctgggttcaagtgatactcctgtctcagcctcttgagtagctgggattacaggcacccaccaccatgcccggctaacttttgtatttttagtagagacagggtttcaccatgttggtcaggctggtctcaaactcctgacctcgggtgatccacccgcctcagcctcccaaagtgctgagattacaggtgtgagccaccacacctggcccaagctcactaaatctttcttcggcttgatcaattctgctattaagaaactctgatggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaaactctgatgcattcttcagtatgctaattacattttttagctccaattatatttttctgcttggttctttttatatcaatctctttgttaaatttatctgatagaattctaaattccttctctgtgttatcttgaatttctttgagtttcctcaacacagctatttcgaattctgtgtctgaaaggtcacatatctctgtttctccaggattggtccttggtgctttatttacttcatttggtggggtcatgttttcctggatggtgttgatgctaatagatgttcttcagtgtctgggtattgaagagttaattatttattgtagtctccactgtctgggcttatttgtggctatccttcttgggaaggctttctagatatttgaaagaacttgcatgttgttaactaagctgtatctactttagggggcaccccaagcccagtaacgctatggttcttgcagactcacagaggtacaccttgatggccttggacaagatctgggagaattctctggattcccaggcagagactcttgttctcttcccttactttctccaaaacaaacagagtctctgtctctctgctctgagccacctaaagctgggagtggagtgacacaagcacccctgtggccaccaccactatgactgcactaggtctgacctgaagacagtacagcactaagttttgcccaaacactgttgtaatcactccctggttactgctaatgtttgcttaaggctctgggactctaatcagcagatggcaaagccagctaggcctgtgtttttcctttcaggatggtgaggtcccccaggccctggatgggttcagaagtactgtctaggaatcagggataagagtcaaaagccttagaagtcttcctttgtgttctattgcattgtggctgagctggcattcaaaccaccagatgcagtcctttccactcttccctccccttaccaaaagcagaggagcctcaccccatatctacccaccctagaccaccaggagtgttgccagactaccagatagtgttcctttaaggcccaagggctcttaagtcagcttgtggtgaatgctgcctggcctgggactcaccaatcagggcagaggcctaccctctggcccatggcaggtccagaaatcctatctgagagttaagtcctagaattggggaccccaagagcacgcctgatgctctgctttgctgtggccatgctggtagatgaagccagaaagtctcagaggctcaccaagtccctcagtgtagtacctgggtatcgctgctggtttttcagggcccaagggctcttcagttagcaggtgatgaatgcttctaggactggatccttctcttcaaggcagcaggttcccttctgacccagggtgtgtctagaaatgtcatctgggatctggggcctggaacgaggaggagagtcatgactctgtccaatgccctatttggccagctatggctgagcgagtatccaagatggaagacaaaatcctccccactctttcctctcctctcctctcctcaagtggaaggaaggggtctcttttggagccacgagttgtgcagcctggggttaggggagggatgatgccagcactcccttggctgtcccagcttttgtctcagtatgttgcatgcccccacagtccactgtctctgggcctagttcagcactaggactcacctaagagttgcagtccttattgcctagactgcctttcaagtttactgaagacacagagcactgtagccctccatggtgaggtttgcaggcactcaagttctgacagctgggactgattcccctctgcctagggctggtttaaatgtgccctctgtggatgggtgtcagctgagtttggtctggttttcctttctgctgtaacaagacagcactgagttcaatgtctcacagctgctgtgttctctctcccccagtgctctctgcaccactctgttgctgctgcgggttggggaggactggtgtaagcgattcaggactgtttttctctgtctcttcagtgcctctttcagcaatatgaagttaaaaccaggtactttgagtgctcacctgattttttggttcttatgaaggtgttttttctgtgtacatagtttttaacttggcatccttgtaggggtgggaagaagatctgtggagccttccattccaccctcttgctccatctctcatttgatgctgttatagactttagttctctggtgaaattttccctcttgatgtctgtttttctttcttaaaaaaaatttgacacgtgattgtacgtatttatgaggtacagtttgatggtttgagacatgtatgttgtataatgatcaaatcagggtatttagtgtatccttcacctcatgcatttatcatttctttgtgataagaacatgcaaaaggctctcttctagctattttgtaatatacaatgccttgctgttaaccattgtcatcctgctatgcaatagaacaccagaacttatttcttctatctaattgtaactttgtaccccttgaccaacctctccccattgtctgctcccctgtttcctccctagtctttggtaactactgttctactctctgcaactatgaaatcaattcttttcttttctttaagattctacacatgagtgaaatcatacagtatttgtctttctgtacctggcttatttcacttaacatgaggtccttcactaccatcaatatagtcacaagtgacaaaattttattttatttttttatagctgaacagtgtcccattgtgtatgtatactacatttactacattttctttatccatttatcggttattgaacacttgggttgattccgtgtcttagtgattgtaaaatgtgctgcaataaacaggtaacacagatatctctttgtcatacaaatttgattcccttcgaatatacactcagtaatgggattgctagattacgtggaagttctatttttaacttttaaaggaatcttgataccatgtccctagtggctgtactaatttacaatcccactaatagtgtgtaagtgtccccttttcttcacacccttgccgacacttgttttcttatgtctttttaataaaatccgttctaactggagtgaaatggtatctcactgtggttttgatttgtgttttcctgatgattagtgttgttgagcattttttcatgtacatgttggccaactgtctgtcttcttttgagaaatgtccattgaggtcttttgttcatttttaagttgggtttttttgttttgttgttgttgttgttgccgttcttcatatattctggatataaccccctgtcaaatgtgtggtttgcaagtattttcttctattctgtaggttctctcttcactctgtttcctctgctgtgcaaaagcttttcagtttgatatagttctatttgcctatttttatttttgttgtgacatctatctttcttgagcatattaatcggttttctaaaagtccatatctcataattctaatatctgagttaactatgaatatgtttctcttgtcttgtttttaaattctgtttcttgatatgtatagtaatagtttattgaatgtacagaatttttaatgagaaactgtagacaattagaattatgttgtctttacccagagaaatttatcctatcctttacagacagctataggaaaggagatcacattgataaaagcaaggagtgagctgacacaagtctgttgtaacctttgtaaggctttgtatatctctggcacaccaactgagagcctagggctctgactaaagctcttcctccttggcagatcctgcagagctccatgttctatctcctaaggagatatccccatgagactgccccaaattcttttttgtttttcacctgctttctgctttaccttttaaccgcttatctatgcatcttacaaatttaacaacctaggtgaaagcgaatttaacacttctaggtgaaacaacagatttagcacctctaggtgagagccagagtatcctcatgctctcttctctcagagatcttgggtcctcaggtcctgtctcccttggcagtcctaaactctaattttttttctctctatgagactgctgaaagcttcactggctctgcctcttaacatccaccttctgctcaattctcaaccttttttcttgcccaaaattagtaaaatccctgaatgtgacacagaggatatcagggtcctctcaattagtttctctcttctctgggatattggctactcacatcctggatgtcctggctgctctttgatgccatgtaagacatatgtattttgtattttatatggattttccaggtgttttcagtaacagacttgttctgctacaagatactctatcatgaccaaattagaatgtttcctataatagaaatatataatttatctctttctgcttccatctttccaaaattggcttttggttctttctcagatacatgagaattatcttccaatactacttaaatgtttaatgactttgacacgttaaggctgagcctccctagttcatacttctgattatatccagagtttcaaataagagaatgtggctgtcacatatttcctgagttatgaacttctgatctaatgtctgggaagacatatttccttaatctgagttttcaagcttcaggttaacctctgctaacttccaagttttgcagatgtagtgaagttcttcctgttgctcagaagtagagtttccttatttattctgcaaacatttatttgaccccaacaatttcttggttatttcctttttgagcctacatgtttgctataaaattcctcaaaatgaggaaaatatgagacaattctatataaatctgttcatataccattactattttccctgtcttttgtgattcctttaaaaagtatcttttaactatatttggaattcatccaatgatgcccatttattacaactgcattaggcattattaagtcaattaaaatatataattcagtaggcagtgcattgagcctaatttaaaaggcatatattggagccataatggattgctgtgttgtcagatatggcagttcttcaactgttgctgataaagatgaaactcttttttgaaaagtaaaagacatctgcagctgctttgaaagtcaactgacattttgttaattagcatttatttacaatagttgaataacaatatcaaactacagtaaggaatgagcagttaacatttaaaaaaatgctggtgacattaagtttcatcatttggcatctagttaaaaacacagattctttcaggggtatagaagagaaatcactgatgtctgtttaaatgtaaaataaactggcaaaggaagctagagctgccagagagggcttaagatgtggccctgggtcttagaatggaatagacgtgcaaaccattagttgagtgtccagttaggcaagaggggaggataagaagaaatagaagaaattttttccttattattggctttttaaacacataccaaattatcactggaattttgtcagtcagcagattccagatgactaagatgatcaaattaagatgtcacgttcaactcatgtcctgcagtgtttcaccatcaacctctgggtttgaaacaagcagggagtaagaggaaagagaagagcctaattttatcaggaacatgttggtctataaaaattaatatcaggctgatccaagggtagtgagttatctcagttgattgttcacggtcacagatcgaagtccttgttctacgctttctcccttcccactactgtacttgactagtctttaagagaaagaaagagagagagagagagagagagagagaggaaaatgcccacagtattaattttttgtttttttcccctccctaagactcctagaaaatttaaatgtcaaaactaaaagtaagatactgttattaaaaataaccagtggtatgttaccaaatttccagttgatcttaaatgctgttattaataagtaagtacataattttaccataattcatagagaacttcatttgccacatcagtcttcatcccctgtaattggtactaatgctaaacatttgttaacgaaagagaaaaaataaattcttccactagtttgcctttttcctttccaagactgaaaaatattccattacatgtataaagcccgttttgtttatccatttatctggacagaccattttgattttatgagtgtttgggcaaaaatgtgaccaggatcatcttccttcagaaaggactttggtagctcatgttaggagctagggaggtgggggagcagaagagcaccccaggaaaacttagcactgggtggacaaagccttctcagccatttcgcctccttgtacctcttggtgatccagcactttttgcgtattgctctttcttcttctgtatcaagcatatcattttgatagcaatgccctaacccccaccccaaccctaagctctcattctgacatctcagtgtgatgggaaggtaaataatatctactgtaccctaagcaaagcttagattttgatggttcaggatttttgcacccttgagatcagaaaataatccatttttattcatctatttcctctttctctcttttctgctccttctctccctctttcttcccctcttttatttcccatactcatgatacttattttgctgtgatatatgtgagtctatattctttccatgaaatcagtggctaatgcaaagaaacataccatttacctaaataatttttctactgtaaaaatgtttctgagaaattctgctttttttttttcttcatttggctttgtatcttcagggctccaaatcctaggggaaaaaataatagtgagacaccaaataccacagcacaatattgtatagttcaataggaatttgaaataataaaaaatctggagacagatacaaccacttacatcaaacttctcggtaggttctcaagacatgtatctttctgaagaatcatttcaactcaaaatttgctgtaggtaaaaagagcacatgacatgtccatccttctctttagaaaatgaagaaacataaatcaacttgagtttcttgcctccagaacagtgtgaaagattacattggaaatgtatgttctccccaacctaggcagctttctaattctctcttaagaaaaggaaattagtgattttgatcagaaacagtctcaagcccacatcccaaagcaaaattttttataaccaaactgtccctagaaatacatctaccatgaactagatagtctggttccataacaaagaattgtaaaattttagagatggaagtatcttggtccaaacctctaactggatgtttctcctctagttaacaaaacagaagttatatcacaaaaagagtagggactgtgtcttacgtgacacatgatcattgtagaatactggtagtagtatcgccgtgtttcagtggtttggaagtgagaggaaagacagagagaaagggagaaaggagaggggagggaagtagggaagaaaaaacaagaaggtgagtattggtattgtttaatatatatatttttgccaatagccttcactatttagagtagctaattaagttatctcagccaaccacttataaagatactaatattccatacttagggttgaggaaattgaagttcaaagaatataagctcatatatttttagcacactggaggaaagaggcattgataggagagatagaatttgtttttaacaggacatgggacaagagaaagcctgtgagtgacagatgcacacttagtaaatgcttcctacctttgactacaggactgtaatgaagagatcatagttaggccagtgagttacatagaccctgttcatggctctggattagtgttgactgaagttaatttctttcctatctgtcagaagtggcaaaggaaaaagtgatagcaggaaatagagtgttttccctctgtaagttctaattattacactaatgtctccttgaaccttctcaccaattgtgggatgtaacagattatagaattataatagaaaatggcctaatattgttgatgctaaaaagcaggaaaacatcaccttgattggggcagtgtcatacaccaagatgtaagtttttattgttctgattttagcttctagaacaatcagtgctatgactgattgggctaataactgattttaggaaaagacaaaatctcctaagtgcattttgtctgcagtttgtaagcaggactttgctgacacatcctttaaataatttagaaaaagtgaaaggctctcaaattcaccagcatctcttgcctcaagacacacaattctcttctcagggtctctaagacaatgttctgaggcttcatgaagacttttctgaagaatgttagacaaatcatttaacttctttttgcctcagttattttccattataaaatgagaaagatggactggtctccaaggcacatgccagctccagccctttgtggttcactgaaaggtcagtgtatggagtgctggatttgttcttgattcttctgcaccagtgcaaagaattatacataaattttcatcatcatgatcatcatcatgatcatcatcatcccaacaaccacatctgttatatggtaataactgtgtgtgtagtatttctaattctcgctataatccttgaagtaagcattattttctccaatcgactgatgaagaaattgcactagtttaagagtcatttaatattgaagatcaatttgaatatgaggcctatatgacattttcaaagctgattcaccaaaaaagtttttaatacatatatattttttgcttaattcttttctttattgagggatatttcctgaggctaaattcactagagaataattgtattttcaaagataggaggatgaattcttttccaaggcagcacaattctcactccatctatcatgcagttcctgaatgtatcttcccacgaacagaatgagccactcctttctaatatcttttttggaccctgcctgaatttctggcacagcacctgttacactttatggaatgtaatcattatctgcctatccccctcttattggattctacctgtgaatccttaagaagattactgttttctatactgggggagatttttaaaaatatttatagttccattagttcaatactacttgatatatagtaggtatttaaaaaaaacaaccttaaatgaatgaatgaaatgttgataaatttactttcacagtattgtataaatttaaactacaagcaaaaataatgagtgtgttttatgttttctacattcccatcagcatggtaggctggcagggaaaatgcccttaagacttcattcctttcctagtcccacactctatgagatatttgcaagcactgtcccttttagtttgggaaatcctctcagttctatttaacttcaaaccagcaaccatgatatgatttctagcatttctgcttcatctctattctatgttctccttcttcccttattccttcactattgacagccagttggatggtgaaacattgctctacagtttctactgacaagatcataaacattggagatggaaatggtcaccatcgtctctcaggttataccattatttcttgattgatctgcattagacattagttattggatctctgctgaagttgggctgtgattcatctcttggccctcctcctccctgtacacttattatttatattttctctgttggatccacctaacttattttcccatcagtatgctttcttaatttataccctcaatttgttgaggagcacatactcaagtaacttcctacgaagggtgcatgaaagataggtttttaacatactggtatatctgaatatattttattattgggttaatcacttggcagagcattatattttagattgaaggcattttcaacctcatgatttaaagacgttgatcaattttcttttagcattcacagttactgttgaaaaatttgctgctaagctggatctcatccatttgtatgtgacctttcccccacccctccagtcctgctcccactgctgcaaactatgatctcacaccctatacttcactgagatatgcttagatgtgtataactcttcactaacccttcctggtgcccggtagtttcctttagtaggaatgttgtgactgtctagtgtctttgcgcaggtgtcaccatctgagtaaggcctttcctgaccaccctattaaatttgcacacctgccccagcattcagtgtctcttcctttcctgcctaatatttgcccatagcacatatcaatctcttaatttctgaataacttacttatgtttttttccctcttccttcacttcagcaggaattttggtctattttgttcactgttgaatgccaagaactctgttcagcacctcgtaggtatttaataaatatttgtttaaaaatgtttctgcggggagggaacttagaggacgggtcaataggtgcagcaagccaccatggcacatgtatacctatgtgacaaacctgtacattctacacatgtatcctggttttccttttttttagaagaagaaattttaaaaaggaacactaggagaaacactgagataatactctaatttttgaaataaaatcaaattatgtagtacaaaaagtgtttttgcttcttatttaagaaagaggcaataaaagcttcatctgcatgtgtaaggctcattagctctcaggttgagtgtacaggcagctgtccatgaggagagctggctatcaccctgtgggacccccaaatgagagattggagaattatttacactagggtgcagacatccaagtttctgcatgctcagagatagttcattgtgaaaaacaattaagatacaaaattttatttagggttatgagtaaatatctttaaaaataatatatgtctgtcatcccagcactttgggaggctgaggcgggcagatcacgaggtcgggagatcgagaccatcctggctaacacggtgaaaccctgtctctactaaaaatacaaaaaattagccgggcatcgtggcacatgcctatagtcccagctactcgggaggctgaggcaggagaatggggtgaacccaggaggaggagcttgcagtgagtcgagatctcgccactgcactccagcctgggcgacagagcgagactccatctcaaaataaataaataaataaataaataaataactaaataaaataaaaataatatatgtgtatagtaggggggtgtgtggagagagagagagagatgggggatgaagggtagagaatgagagaaagaatagaaatcggaagtgactccactgaaatagacagtagtattattggtggttatttttaatccccatattttcctgtatatttcaaatttttatattattgtaaaaatttacaataatataaaaattaacaaaatatgttttcaagatgctgcagtgaggattatgtatgtgtgctgggtaatgtgaactgctcatgtgaatatctattcagcacttcctcttcattccaagtttctgattctcctcgtcagctttctacttttttttttcactttttaaccatttggaaataccactttaatgtagatctgggtttatttagaaatcttatatttgatagaggtgttagcatttctgctacctaggcaacaaaatatggttctgctgctaacatcttttcatttttagcaaaatgaaatcttaaaaatcttttaataaacttgtaaaaataaaagccagacttaaatatactccttgccttaaagaaaagaaacatgggggtaataagtacaatgggcagcatataggaccatgtttcttggagaatgtagaacaagtttggagagagaaagaggggcgcacatttcaaaataaaaccaaaacaattcagaaataccaattaaatccactactaattttcaaagtttgactaattgcttgaagagcacactgatcaactacaaatgttgcatcttaaatatatttagactcacatatactattttttagattatggaaatattgcaccttattatagaaaacatgaaagtattgaaaatgcatataaagactccagctaaaatactctatcctaaatatcagagataatctctctaggatgcagttttgaattctacacttttacttaaaaattatattgtaaacatttatcatacaattattaatttcgtcaaaatcagaattcttcagaaccatcaacatactatggtctaactgctccaatacaatttctcatttcatttctttccagtttttgatataataaaatgtaaagaacattctggtgcaaaaagggttgtctgcatctctttgtcattcctaatgacagaattctagaagaggctcctgaagcctgatgcaaaacactctccagcaagacagcagcactgcatgcccccgccgccacctccccccatccccaggttacatgacagcgtccccctgaccctctctagccctgagttgacaattcaataggtcaaatgtgatgtttagacttgtgagatttgggaggaaattgcacttttccccatctttgttgaccatctgtaattccgctataaatcgcccgtgccctttaacccatttttttctatggaagtgttagtatttttcttacaggtttgtttaaaaaaaaaaaccaaaaaaaaaaaaactctgaaaacaaatgatattaactccttgactataatcagtgggaaacagtttttcaaacttgtcatttttatatgtcagtgatactttctttttagtttaaaaaaggatagtattgatatacacactttgaaacttcctgtcatcgtatctattgatcttttccttgcccaaaggatccttctcctaagagtcatccttattttctctgtatatttgtgttgtttcattttctacatatgttgtattatttagacatcgctggaattgatgattgtgtgtgacctatgggataaggtaagaatccagcttgatattttccatattccatttactgagtaatctgtcccttcctttgttttgtgatgttgcctttttagcattcaagccattatatataatagagcatttccttattcagggctattctcttttacccatccatactgtggcaatgctaccctttactgtagctttgcaatatatcttccgtatggtgaaacaagttcaccccctcttattagcttgcatttccaaattttcttttgctgttctaatgtattcattcttccagcaaaactcccaagaaaaaaaatctcattgagatttaccagattgcattaaacctaaaaattaatgtgagtaaaattgaaatctttataatagtctgcacagacacattgtatgtcttttttaagccttattttatgtttcttgatatagccttgtagtatttttcacaaggtctgacacatttcttactgagcttgtatttctaggtgttttatatttctatttgtattgtgaaagagatttttcctcatcagattttccaatcattgctagtatgtttgaggcccatttgtacttagattccttcatcttgctgaattctattttaatgatcttctagctgattgtctagagtttttctaggtatatatattatcatgttgtctgcaaataataactttgttccttcttttccagtggtcacacattctatttctatttttttctgtgatcaaaacttgtaaaaataatattaaacaatagaaaggataacagaaatcctgttttgttcttaatattaatagaaatgtctctagtggcattttcccaataaataatagtatgtgctatcagtgtaaaatattctttaatgtgttaaggaattattcttctattcatggctagtaaaaagacttttccctttaggaatgattgtaatatttttatcaatgcctttcaaaatttaatgatcatatggtttttcttatttgatctattgatacaaccaaagtgatattttctacttggttgtggtagattattcttttcaaatatttttaattcaattgactgataaattatttagagtgtttaaatatattcattttttcttttattctatctttattaagttttattattattaataataataatggcagttgggataatttcacaatctcataccatgttctgctgcacttaaattcttacacaaattttctcatgtaattcttataataactttacaattagatgtaccattatctacattttgcacataaggaaccaagctccagaggggatcttaactccattaagatcatatagcttgtgagggggggggcctgtctgtacagcctttgctacatagtattggggaattaaaaatgagttgggtagctttcctgctgtgcaatggaatagtacatagaataggaaaaatctgcttcttgaaggtatgaaaggacagatttctacatgcacaggaggcaaaatgatgctgtgaaagaacattggctttgaaaccagacaaatgctggttcaaaatctagctctgtctgttacttcgtagcactcaatagaaactaatcattataaaaacatcttatccaagcgccatctttgacaacattttccatctgtgcctggatcattttctaattttttttcccataacatcctgttgccccaggaagtaatatatttcatctagataatgaaaagtattatttcatattcatgtgtattattctctgatagtcttaaaatctctgtggctgctgtcctgtccccttggtctttggtatttaattgtgtgttctctttttatcctaactagattttccaaagatttttctattttttcttaaaccattttttttaaattttagaataatgtagttggctgaatattggctctccaaaaatgttcatgtcttaattttcagaacctgtgaatgttgtcttataaggcaaagatactttgcagatgtgattagattaagaatcatgtgatggggagattatccagattttccaagtgggccccgtgtgatcacaggatccttatacgatgaacacaggaagttcagacagaggagaaagcaatatgacaatagacacaaaaattggagtgatgtagctacaagtcaggaaatgctgtcaccctctagaagctggaaaggacaaggaatggaatcttcctggagcctcccaaagaaaccagccctgccatcactttcattttagtccccgagactcattttggacttctgacctgtagaactgtaggaaaataaatttgtattttaaaccactaaatgtgtgctaacttgttactgccacactaggaaactaaaaccaatagttttagattaacagaaaaattacaaagatggtacagagtttccatatcccccatacccagtttcccctattgtcaacatggtgcatttgtcccaaggcatgaaacaatattgatccaatatcactaactaaagtccgtattttatttagatttctttcgtttttacctgatgtcctttttctgttccaggagtgcatctaggaaactatctgtgtttagttgtcatgtgtccttgggttctttttagctgtaacactttctcagactttcgtcgtttttgatgagcttgatagtttgaggaatgctggtcaggcattatttaaaatgtccctcaactgggatttgtctgatgtttttctcatgattaggctgaagtatggatttgggggaatgatgatcacagagacaaagtgtgttgtcctcacattatagcaagggtacatactgtcaacgtggcttattgttgacgttgaccttgatcacctgactcaagtagtgtttgtcagcttctccactgtaaagttactctttcccttcctttgtctattgttttacagcaaaaaaggcgctttttaaaacttgtcagttccactctttttctgctatatgattaattaatttcttactttatgttgattaattctttctgtcatcgttgtggttccttttttgttctttttccaacttcctgagttaaatcctaggtttacttattgttattttttaatacataaagcatttaaggacatgtgatctccatttagcaaggagttattagtttgtttatttgtttgttttgttttgacttttgtttgtagagacagggtctcactatgtcactcaggctggagtgcaatggcacaatcttggctcactgcaacctccacctcccggcctcaagccatcctcccatctcggtctcctgaatagctgggactataggcgcacaccaccacacccagctaatttttttgtacttttagtagagacggggttttgtcatattgcccaagctagtctcaaagtcctgggctcaagtgctctgcctacttcagcctcccaaagtgctgggattatagccgtgaatcatcccgactagcttagtttgtttaaacacttgttattagtttccatgtttataacatagcagtaaaagtgtgtaccttatataacttctgctatttggaactttgtcaggtttttctttttcttttgacatacaattactttctgtaaatatcccgtgagtactttgaaagaagttatgttttctgtttgcaggatataaactagacattaaattctgcagtggatgagaatgtaactgtttgacttaccattaaatatctagcccctagtactggacctgatacctagtaggattgcattaaataactattgagtaaatggctgcaaaatttcaacagtcccagttgcaacaaccaaaaatgtctctagacatggtcagctgtccccttgcagacaaaatcattcccgattgtgaaccactgctctaaaatgatatgattattcacagaaaatccaaaagaatctcctcaaaaagtattagaattaatatttgaattcagcaaagttagttgaagggtataaaattaatatacaaagatagcattcatatatagcagtagtaaacatttagaaaatgtagttttaaaataaataatatcaacaatagcaattaaaattataaagaataaatctaacaaagtatgggcaagacttatgaagaaatttattaaaatgtaacgagaaacattaaagaagacctaagaacagagaaaccatgattatctaagagaagattcattatcattgaagtgttgtttcttccccaattggcctataattacaattcgattccaacaaaaacctaacagagtttttgtgggacttaactgattctaaaacttatattgagaagacagcataaatatagttaagccacttttgtagaagaataatttggaagccttgctatatcagattttaaattttattctaaagccatagtaatcaagaatgtagacagagatagacaagtagaatcaggaaataggataaatatttaatatttaatatatagttctacacatacatgaaaacttgatataggacggaggaggcatttaaaacagtgggcaaaagatataatgtgctgagataactgactttatgttttaaaacattctttttatttactctctttgtcccactggaaggtaagctccatgagagcagagatttggtgtgttttcttcacagctgcatctccaatgtctagaataactcaggcatacagtagttattcagtagatatttttgaactactaaatgaaaaatccattttattagttttcattgcttttcctattattatataacaaaatatttacagtttctatgaaggtttggaaaaaatgtttctctctctctctctctccccctccctccctctctctcttcctccctctctgtctccctccctctctctctctctccctccctccctccctctctctctctgtgtgtgtgtctgtgtgtgtgtgtgtgtgtgtgtgtgtatttctttcccaagagcccaaggaagtcactgaaagctagatatagcaaaatggtagctcaacaccagatgcaattatttaataataaactctaaatttgtttgcccccttaataaaactctatattccaatattcaaaattattaaacaaagtaaggaaattgttgtttatttcaaagatttttgtatgctgcagatatcacaggttccctttaaatatttatattaaaatatggttcaacccataaagccataggaatatgtctgttttgccaagtaaggtagctcatctgtatctcttatgagaattttaataaaacaagtattaaggcttctttcagacagttccaacagcatgattctaatttttggtgtcctttaaaatatcaaattactcctggctatgcttccttacagaccaccaaagacaatggaacttagccagctgacaaggatatttataatcaatcatggcaccctccaacagttccctctctcacacctattggtctaagagagtttgtctgagagaatcaggtgacattggatagttcagagcaaatccaagaacccacctgggaaattgagccaatccacaggtctctcaaaaagcattcatttatgcttcattaagcattcattatgaccaagaatttgtgggttcctatcacttgtcaggcactaccacatcattaatattgcggagtccaagagttatatttgctattatcatacaaagtctgaacatctcaaccagctgaggtattaagttcaaactctgaagcagtaaatagcggcacagtgatttggcaagtcttaaaatggctctgtgaacctttcagttgagtgcaaacacctggtatcaaggttctccttcatcttgagacccaacaaccctcctccccatactgtaccccaggcccctttcactccaccactgcaaactctcactctctggcaaacagcccagcctcactcctggctctggaggctggcttttgttctgacttctgcctcaatctagaagaccctccacttcctctgtgtccatccaaatcctacttttcttcagggctccgccactctgactgtgttccccccatcaaatgtagggcactccaacagccctgatcccaagtgtgaagctgtggcctcagctggacatcctgtctggtcttggttagcggaaaggcaacagaatgaatgtccactccaggtaagaaacctcttcattttatagaccaagaaactaagatatagaatgattgagtgactctttctaagaaacaaagtggttagcgtgctagaaataggaagttggtgggcatagtgaaaaacatttgtttctctaaagggagaaacatctgaatgtaaatcccgcattgacaacttactagccgaggaaattcagggaagttactcaccttcctcaatcactgctcccatactataaattgacaaggataatatcttctttgcaatattgttgtgaagataagatataaagagataaaatatctgactcatactaagtgtaactgtgggaacccacttctttcttaattttactaccctgcttctctacaagactgtaatctgcttgaaaacaggatctatgttgatcctacattctatagtcccctacgttctccataacagccaacacacagtgcacagcataaagtgggagcttcagaaatactgttttttcctttttctttttttgagacagggtcttgctctgtcacccaggctggagtgcagtggcacgatcacagtccattgcagcctcaccctcctctggggctaaagcaatcctcccacttcaccctcctgagtcgctgggactacaggcacatgccactacacccagctgatttttgtattttttgtagagatggggttttgccatgttgcccaggctggtctcaaattcctgggctcaagcaatcctcctgcctcggcctcccaaaatgctctgattacaggtgtaagcctccatgctcagcccaaaaaacacttttttaaatgaaaaagcttgttttccggaaggacaacattcacttaaatgaatgttctctcaaagaacaactatgacttaaataaacaatgaatttaagtctattatcttgttttttccatttttattgctctatcatacacttatcttttatatacattctcttatatgacaaattattgtgtaaacaaataaaatgttagtaatgaatgagacttctaccctataagagggtagtattcttggataaaatgtaggagcttatatagttttaatccatgacaaataattaagtgcttcccaatgctaatttttattttagtactaaaactccaaatatcagagccgaaaagatttccagaatcatgccaaagggtagctcctaagtttactctggcgcaatgccacttacagggtgagaaaaagttcatgatttcccattgtgtgaatcacgtgtacaaagtccttttgtccaagtggccttgtcatgtgagaccgctaagtatctttcacttggccttccaatcacgtccaaagtgtcatacccccagaagcaatttgatgtatgaataatggaagcctgaactgaagctcaacagtttgtaagaattgtactgtgcctagtgaaccaaatgcagacctctccaaagctcgctcagaacatttacaagatgaggaaaattcaaattaagagtcaaaggcatttcagggctgagaggtaaaaatagaatactggtcaggttattggaggacaaagaacaaaaagtttattttgtttgagaacagaattggaattagaatggagttcatctcattttaggacttgctcattttaccaaaaagaagtaaaagcaaacaaaaatttattagagagtagaaggtaaaagaattgggatttgatttctcacatggcatgggaataaaaatgtgcaagatttttcctgttttgaaaaattatcaaagggttatttagtgggaatctatgttttaaatttctgctttaaactacatcactttaaccttctaagcctacccgattcccctgtagctgtggaatcacatgaacccacaaaggcctgtgtctacttgttttactctgcagattctcaatcagccttcatgaatgcttgttttgacactttccttttagcaattctgtgtgcacttccctagctcctttcgtccactaacaaatcttcattagacttcgttagacctaagcttttcagccacttaaatgcggaaaactacatattttagaatattatctaggtcatctacctgccagaattacatggtaaatttctcaataaaagatacaattcgacatacctcaagcatgtatatgtgttaaagtgatattcttctaaggaaaatattagcaggcatctatacggttgttgggggaggggaagagttctatttttctttaagaatttcttgagaaggagccatattccgagtccttattacactctccaacagaaataggtgagataaaaagaaattgtgagcagatgagatatccctccaatgatgttaattatggaagttatttctggggcctcttatgaaatcttttcacttgatttcctggctaacagagtggctagatctaaggctactttatgagctgagtgaaagaaacacagcacaggtcttccagaaatctctagaagggccccaaacattcctaatcatctagtcctgtcccattacccaggaggtttcagggaacccagatcctctttagaggtgcccttgggaatattggtcttattgatttaaaaatgatggcgctgtggccgggcacagtggctcacacctgtaatcccagcgctttgggagggcgaggtgggcagatcacttgaggtcaggagttcaagaccaccctggccaacatggtgaaacctgtctctacatctctaccaaaaaatacaaaaatcagcccggtgtagtggcaaacacctgtaatcttagctacttgggaagctgaagcaggagaatcacttgaaccctgaaggcagaggctgcagtgagccgagatcaggccactacactccagcctgggtgacagagtgagacttcatctcaaaaacaagaaaaaaaaaaagatggtactggaatttctaaagagagcagtgatgtggatggagaaagtgatgctttttgaggctgcatatattgtcaaagaagattgaggaagcatcactggaccatctcaaagaatgatgtttgagaagcttatgcatattatggggaggggacacagagaccctggtatctcccactggcttcattcttctttacctatttctccttgataataaacttcccacctctctgacagtcagactgaaaaacgtacttcaccacagtttgaagaacagatcatgctgtattatcaaaaggtaaattccaggaatcatatgtgttttcagagttctgttttgttgcacttcttagaaaatgcctttattcctcctttggttcactacatggagctaagaccactgctattcttttaatatttgatatttgaatctgatcatatgagttttcattcctcattatagtttacaatgtgctttcttttatttaacaatatttctcaaacagagataatcaaagatgtgatgggggtatgcaacatgaaagaacagagcatcaatgtattgttcctgccggcgagacacttgaaacgttatttatgtagtaaaacaaacacacatctattattaactacaatgtataattcacatgaatttctcagataaaacataagacttcaaagaaagtcatgcctgaaatttgcagctacgagctttacctacagtcttctaaaagcactaaaggtgcttggtagaaatttgagttagcataggtaaacatttttttcgtattttacttccacccaaaaaaatacataatagataacatgtttactgttattacctcccctttatggaacagaaaactaaggcttagggggtttgacttcactaggtaactttgccactttctaattgacagagccctttctgcccacctctccatgagtgagttcttcatgagtaaaatttccctgggctggtaggctgaataatagccttccaaagacatccatatctgaatcccaggacatacgaatatgttactttacacagcaaaaatattttgcagatgtgatgaaggtaaggattttgagatggggagattattctgaataatctagataagcccacgtaactacggggtcttggtaaggggaagatcagagtcagaaagttgttacatctaaggatagaaacagcagtcagagaggagagaagagatgctatgctgttggctttgaatacagaggaaggggccacaagccaagacaggttggcaacctctagaagccagaaaaggcaaaggagtggattctctctcaagcctctagaaaggaacacagccttgattttagcccagtgtgacccattttggacatttaaccactggaactataaaagaatacatttccgtaggtttaacccactaaatttgtggtgatttgttacagcagcaataggaaataatatacctggtaaggctatgccagtccccacattctgttttctttcatccttatgcccactattagtattgccttatggttttattttagtgattttaatttatcatagtactatatacagagtttttagttccattaaaagtcccatacatttttagtttcattaaaagacaaatggaccagtggctgagaatgtggagaaattggaacccatgtccattgctggtgggaaggtaaaatggcataactgctgtggaagagtttggtgggtccacattagattcaatatagaattactgtatgatccaggaattccacgtctggttatatacccaaaagaagtaaagcaggtgttcaaacaacaacttgtgcacaagtattcacagcagcactacactcaatagccaaaaggtggaaacaacccaaatgtccatcaactggtaaatgaataaacaaaatgtggtgtatccatgcaatggaatattactcagccttaaaaaggaatgaagtactgatacattctacagggtagataaactttgaaaatattatgctaagtgaaagaagccagttacaaaaggccatatattgtgtgattttatttataggaaacatccagagtcagcaaatccttagacagaaagcagattagtgattgccagtggccaggaggagtggggaatggcaagtgactgcttaatggtacaagatttcctttggggttaatgaaaatgttctagagcaagacagtagcaatgtttacacaacattgtgaatgtcactaataacacattttatgttatgtatatcttaccacaaagaaaatttaagacaaatagagctaaatgtttgtaaagtcaataaagcatcacactcctgcctcctctattccccctcccccaccaccaatttctaactaactcccagttttacagtccaaggacttccatttaaaagtgaatttttgataactaatgattttgctatttgctgcgtatttccaaataacatactaaattgcatgtctcaaagacagcaattaactttcccaagaccacacagctggtaagttttgaagccacgatttgagtgcaagtccttaactctaaatctcaggaccttataataataaaaataataccaagaaaagctaaccctaatatagcagttactatgtatggtaggtgaatagttgctttcagagatatctatgtcctagtccctaaaatcactgaatatattagattggttggctaagaagaattaaggttgcagagggaattaagtttgctaaacaactgaccttaaaacagagaggttatcatggattttctggctggcccaatacaatcacccagtgaaagaagggaaaaaagtagaggagggaagaagaaggaagaagagaatcagagggagacatgacaacagaaaaaaaggcacagagagatgcagtattgttggctttgaagatggaggaaggggaccatgagccaagaaataatgagtacccttaaggagctgggaaaaaaaggaaatggattcctccctagagcctccaaaaacaagcagtcctgcctgctgttcagttttaacccagtgagacctgtgaggaacatctgacctagagaattgtaaaatagtaaatttatgttgtttatgcctctaagtttcacataatttgctacagcaacaatagaaaactaatacactgtatgtcaggaattgttctaggtgcttatatatattaacttatttgatgcttataaaaactctgtgaggtatgtatgttattatcccatttttctgatgagaaaactgaggcacagaaaatatttgagcagacactttacagaagacagtgtcaataggcatatgaaaagatgctcaatattaatggtcaccagggaaatgctacttcaaataatgagatactctacatatgcattagagattttgaaattaaaaagacagtatcaagtattggcaaggctgttgaagaaatggtgctctcacatattattggtgtgggggtaatataaaaatcactatgaaaacattttcacaaatttttaaaaaggtaaacatatactcattgtaatacccagcatgcacctgtagtcccagctactaaggaagttgaagcaggaggatcacctgagcccagaagttctgggccgaagcgtgctatgccgattgagtatccatactaagttcagcattaatatggtgacctcctgggagtgggtggaccattagattgcctaaggaggggtgaacctacccaggtcagaaacggagcaggtcaaaagtcttgtgctgatcagtagtgggattgcacctatgaatagccaaggcactctagcctgggcaacatagtgagactttgtctttaaaaaagaaaaaagaaaaacatccagcattcttactcctgggtattttccaaagagaaataaaaacatatgttcacacaaagacctgtatacaaaagttctgagcagctttattcacaataatccaaaaagtccatcaacatgtcaacatacaaattttggtatattcattaaattaaatgcttcttaacaatgaaaaaggaatactgaaataggaaaaaaaaagtggatgaatctcaaaaacgtggattcagtgaagctgggcatggtggctcacacctgtaatcccagcactttgggaggccaaggtgggagaatcacttgagcccaggagttcaagaccagcctgggcaacatagagagaccctgtctctaaaagaatacaaaaattagctaggcatggtagcatgcacctgccatcccagttacttcagaggctgaggctgaggattgcttgagcccggagatcgaggctgcagtgagccaagattgtgccactgctgcactccagcctaggtgacagagtaagaccctgtctccaaaaaaaaaaaaagaaaaaaaagctaagtgaaagaagtcagacacaagagtattatatgctgtttaattccatttatgtaattatggtattacataattaggtagaagagactaacctaatcaatagcaatagcagataaatgtttgcctggtttgagggaaattaactgcaaaggggtacaaggaagcatttagtgtgatagaaatgttacaaaggtataaaaatttgtcaaaagtcacagaaatgaactctaaaaatgagtacttcttactacacataagttatctctcaataaaatttattttcaaaaaatgtaccaagtcacacagctagagttatagggctgggatttgaaaccaggcagtccaactctagtgtctgtgctctcaccagtagatagctttctatccatgctatttgggcactgtaacaacccaaataattgtccctaattgtaagggtcaaaattctttggcactccttccatcgagatgttcgggtctaatggccgggcacggtggctcacgcctgtaatcccagcactttgggaggccgaggcaggtggatcacgaggtcaggagatcgagaccatcctggctaacacggtgaaaccccgtctctaccaaaaaaaaaaaaaaattagccaggcgtggtggtgggtgcctgtagtctcagctacttgggagtctgaggcaggagaatggtgtgaacctgggaggcagagctttcagtgagccgagatcgcgccactgcactccagcctgggcaacagagcaagactctgtctcaaaaaaaaaaaaaaaaaaaatatgttcgggtctagttctccttcctgtgaatcttgctggtctgtgaccacttttttttttttttattatactttaagttttaaggtacatgtgcacaacgtgcagattagttacatatgtatacatgtgccatgttggtgtgttgcacccattaactcgtcatttaacattaggtatatctcctaatgctatccgttcccccttcccaccccacaacaggcctgggtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaatgacatgaactcattttttatggctgcatagtattccatggtgtatatgtgccacattttcttaatccagtctaccattgttggacatttgggttggttccaagtctttgctattgtgaatagtgccgcaataaacatacgtgtgcatgtgtctttatagcagcatgatttataatcctttgggtatatacccagtaatgggattgctgggtcaaatggtatttctagttctagatcccagaggaatcaccacactgacttccacaatggttgaactagtttacagtcccaccaacagtgtaaaagtgttcctatttctccacatcctctccagcacctgttgtttcctgactttttaataatcgccattctaactggtgggggatggtatctcattgtggttttgatttgcatttctctgatggccagtgatgatgagcattttttcatgtgtcttttggctgcataaatgttttcttttgagaagtgtctgttcatatccttcacccacttgttgatggggttgtttgtttttttcttgcaaatttgttggagttcattatagattctggatattaaccctttgttagatgagtagattgcaaaaattttctcccattctgtaggttgcctgttcactctgatggtagtttcttttgctgtgcagaagctctttagtttaattagatcccatttgtcaattttggcttttgttgccattgcttttagtgttttagacatgaagtccttgcccatgcctatgtcccgaatggtattgcctaggttttcttctagggtttttatggttttaggtctaacatttaagtctttaatccatcttgaattaatttttgtataaggtgtaaggaaaagatacagtttcagctttctacatatggctagccagttttcccagcaccatttattaaatagggaatcctttccccatttcttgtttttgtcaggtttgtcaaaaatcagatggttgtagatatgcagcattatttctgaggtctctgttctgttccatttgtctatgtctctgttttggtaccagtaccgtgctgttttggttactgtagccttgtagtatagtttgaagtcaggtagtgtgatgcctccagctttgttcttttggcttaggattgacttggcaatgtgtgctctcttttggttccatatgaactttaaagtagttttttccaattctgtgaagaaagtcattggcagcttgatggggatggcattgaatctataaattaccttggccagtatggccattttcacgatattgattcttcctacccatgagcatggaatgttcttccatttgtttgtgtcctcttttatttccttgagcagtggtttgtagttctccttgaagaggtccttcacgttccttgtaagttggattcctaggtattttattctctttgaaacaattgtgaatgggagttcactcatgatttggctctctgtttgtctgttattggtgtataagaatgcttgtgatttttgcacattgattttgtatcctgagactttgctgaagttgcctatcagcttaaggagattttgggctgagatgatggggttttctagatatacaatcatgtcatctgcaaacagggacaatttgactttctcttttcccaattgaataccctttatttccttctcctgcctgattgccctggccagaacctccaacactatgttgaataggagtggtgagagagggcatccctgtcttgtgccagttttcaaagggaatgcttccagtttttgcccattcagtatgatattggttgtgggtttgtcatagagagctcttattattttgcgatacgtcccatcaatacctaatttattgagagtttttagcaagaagagttgttaaattttgtcaaaggccttttctgcatctattgagataatcatatggtttttgtctttggttctgtgtatatgctggattacgtttattgatttgcatatgttgaaccagccttgcatcccagggatgaagcccacttgatcatggtggataagctttttgatgtgctgctgcatttggtttgccagtattttattgaggatttttgcatcgatgttcatcagggatattggcctaaattctcttttttggttgtgtctctgccaggctttggtatcaggatgattccggcctcataaaatgagttagggaggattccctctttttctattgattggaatagtttcagaagggatggtaccagctcctccttgtacctctggtagaattcggctgtgaatccttctggtcctggagtttttttgattggtgagctattaattattgcctcaatttcagagcctgtttttggtctattcagagattcaaattcttcctggtttagtcttgggagggtgtatgtgtcgaggaatttatccatttcttctagattttctagtttgtttgcatagaggtgtttatagtattctctgatggtagtttgtatttctgtgggatcggtgatgatatcccctttatgattttttattgtgtctatttcattcttctctcttttcttctttattagtcttgctagtggtctatcaattttgttgatcttttcaaaaatccagctcctggattcatggattttttgaagggttttttgtgtccctatttccttcagttctgctctgatcttcgttatttcttgccttctgctagcttttgaatgtgtttgctcttgcttctctagttgttttaattgtgatgttagggtgtcaattttagatctttcctgctttctcttgcgggcatttagtgctataaatttccctctacatactgctttgaatgtgtcccagagattctggtatgttgtgtctttgttctcattggtttcaaagaacatgtttatttctgccttcatttcgttatgtacccagtagtcattcaggagcaggttgttcagtttccatatagttgagcagttttgagtgagtttcttaatcctgagttctagtttgattgcactgtggtctgagagacagtttgttataatttctcttcttttacatttgctgaggagtgctttacttccaactatgtggtcaattttggaataagtgcggtgtggtgctgagaagaatgtatattctgttgatttggggtggagagttctgtagatgtctattaggtccactttgtgcagagctgtgaccactttgaccactagaatgaagtggaaatggaactattccatttccaggcctcgcctttaagagactagcagcttgacactggtctctcaaagccctgggatgccttataagaacgcccattacctagcttgaacaccacatggagaggctctgaaacttcatagagtaggagagggggccaactgagcccagcttcctggcaccctccaaaagacaacagatatgtgagtagaaatgtcttagatcctacagaccagacaactcactgaattagtattactgaatcaatccagacaagaccacagggggcagtagaattagccagctgagccctaactcaaatcctgacccacagaatcatgagatataataagaagatactgttttaaaacatttcattctcaggatactttgtcaggaagcaatagttaactagaaaactgatcaaagggcattcccatttctgttgccactgagatatttcaattcttcatgataaactttctttctagtattccagatgtgataccataattttcccacttaggggcttaataaaggatgaacagctgaaagaattatggagcccattctcactagttacatcaagtctgtaaataaacagtaatgtcaattcagaaccaccagcatcctctgctcaggctactgtatctggactactgttatttattcaccacatttaaggtaaggtataggcaattctcagcacacctagtccaaaaattaaacaacctcaagtttttgtgtagcagtcagatacttatataattcttcttctatgaaagtcagtcttttctgatataccaaatcacctactggatacaggtaagaaattggatgcatcagaaagaagatattttttgaaacgttgggcaatgtctgactttagcatctgtgttaatgcacttcagtaagtataaagtactgatgcttcactttatggggttggaactctgcttagctacaaaatgccagctgtccctatggctccagttgcttactactcaagaatggagtcaatgtacaaaatagaactatgcacaaactggcagagaagcccttgatagtactgtagattcaagaattgttgagactatactattgcctttcagataaaaatgcttccatttgctataatttacaaagtgtattctcatagaatcagagtttttaaaaatgtatttctttgtttattggttgtttatgacaacccacttatctatagtctgataaaacagtgtcaaatgttaatacttaaatgatctgctaatactattagtaatgccagattatgccactccctgcataaaacccactaatggccacttattgcaagctatttaccacggcctcgaaattctggcatgatctcctgactgtcaacctccttcatctgatattgtcttccccttcactattctccagccacagaagcctttattaggcacttattttgtgccaggccctgcgccaagttctttagatgcattatccgatttaatattcataacagccctgggaaagagataatatcattgccattttgtaaataaataaagacccagaaatcatgtaacttggccaaggtgacataaatactgaatattggagtcagttatttaacctctatatactgattcaacttccaaatgtgtatcttccctgaattcagaccatatatccagctgtccctctgatatctccacttgaatgtctagcagacatatcaaacataacctgctaagtaaatccaaattagaagttttggtttcccctttcatcctcatctttccaatctcggtcattggcaccacccgcttgccaaagacaaaagcttcagtgtcatctttcattgctctcctgcccacatttaatttctcagcagcttttatcatgtttctcttgaaaatataaccagtatctgcccactgccctccatctctgttgttgctaccctaaactgggccgtcttcatctcccacatgagcttctgcaagtctcctaataggcctcactacttcctctcccgcctcatcacacgtagcctggtggtctttagaaagagttgtcacttaccccttaaaaccctccagtgatttttttcccacaacgtgaagaatgacagccaaactcctgaccacagcctttgtaatcatacttgatctggcatccctgccagttttcagcctctcattgtttgttattattgctgctgttgtatgggaaggggaacccagaggcagaatcgtgtcagtcatattccttagtttgtggagcatcagcatctttgatccacataagatccctctcttgtatgttggttggttatcttgtttatttccttttatccaaattccccacctgcatttcctcacctactgtaagcagcctaccattttgtttgtaggtgttactataaattttatattgatgttttctatatttttagtttatataaatgatattgtgtaataaatcacattttgcttcttgctttctacacatggtgtcatgaagatccatctaagtagcatttttcatctagtccatgtcttctcactgccgcatagtactgtctggtgcatccactgccttttgacaattcctcctttgggatggacaccaggttagattggctcccactcacaaacagtaggcatcccattattgtagtcatgtgtgagaattattttgcaacatatatcagtgggattgctgggtaatcttgtgtatttaatctgaaaatgtactgtcaaatagctctccagaaggcctacagcctatgttcttaccagtagtgcataagggagccaatatctgcacccctcaatacaaatatccaagcaatttgatccaagtgaacattaggcattttccaactttctgagttttgtcacttaaagaggtgggatgtttttgatagctaatgaatttgagcaccttttatgtgccataacttaggtttcctcttctctaaattgcctgttcatggcttttgcctgttttttcaactagtattactttttcttgctgattttacaagaacttcttgtaaatgctaggtataggtcttttattgtataggtcttttattgacattagacagtgaaaatattttctgccaaactatcatctgtctgttaagtttttccgtgttattccatactgaatagcaatcttttgataaaattggattcacccgtttatttttattttattttttcttgtgatttgtgctcctgaatttttttaggaagtcctttctcactaccaagatgcaaatgatgagggttttgtatttttccctttctatagttgacctctttttttcccttttcatattgcttgggaaactgccaatgttattttaacagtagcagtgacagtgggtatcttttttttattcccaatcttaaagggactgcacattgagtttttccataagtacagtatagaactctactatgttaaagagtcccttcagttccttctatattgataggcttatcctaaataggtattgacttatttatgttttatcaaatgttttttccacatcaactgagatcatttatttttacattagactagttatgtgatgaattatgtggctagaaacgttttgttaaaccatcctttcattccagggatgtaaaggataactaatcttttattaaggattttttttctctatgaccataagtaaaatatacctattattttcttttgtgtatgttttttgtgttctttctatctacttatatgtcaaaattacacttgcctcacagaacgatctgggcaattcatttcctgtgttctatgcttacttctataagatagaaattgattgtttcttgaaatactggtaatactaatgtgtaaaaccatctgtgcctgggatttcatgtgatggcttgtctttcagataccatttcagttagtaattattggtattttctggcctatttaaattttccatttcttcttatgccaattttgacagcttcctttttctaggcatttgtctattatatataagttttcaaatattataattctcttttattatttttaaaaatctttgttgaggctgatgttatttctgctttttaattttgtgtttaattttcattatctctcttgtatcttttattaaataaacattttattgaagtataatatacatacagaaaaacatatataataggtatatagctctatgaatttttgtgtatctctgtgacatacatatctataaataaaaattatggatcaagcctacatatgtgcacaaaaatgcatgtataaaaattatcacagtaacaatttacaactgagaaaagtgaaaataatatcaacatttatcaacgatcaataacaggatggataaagaaatgttagcatatttatattatggaatattatacaacaataaaaaataataaattactaccacacacaaatatatggataaaacacacaaacacaatgttaagccaaagaaaccaaactcaaaggagaatgtactatatgatttcattcatataacctttaacagaggcaaaactaacttatggttatagaagttagaataatggttaacttgtgaggagggggacaggggctgggaagcgcatgaggaagggttctatggttctatggtttgatctgggtagtggttacaaagatgtgtttactttgtaaaaattcagtgaactatttgtacacttatgaattgtgcccttttctatgtatataatatgctgcaatcaaacgtttataagagacaatgactgtcacaacaaaataactaaaagccttaggagtatcccacacatggtaagaacattccaaacaaagtgacttcaagaggttgaaaataaaggcattagcaaagagatacaggacaaacactaaacaacaaacaaaaaaaggagtggtcatattaaaattaagcaaggtggaaagtaaggttaaaagtactcaaaggacacaagggagcataatatgataataaaaaagcacaacattgtgaagaagttctaacagtcataaacttacttaaaccaaacagcacgggagctaaatatacacaaagcaaaccaattaggaagctattttaaattcaactaaagtgtgagatgtctctatatttctttcagaatcaaagaatactgtactcaaataaaaacaaggagaaaaacagattaactaatatatcaaaaataaaaagtaataaaatatttagaataactttggtacttttagtactttccaactttgcctaattttaatattatcactcccttttccctttttgtttgtttggtatttgccttgtgtaaaatatacaattttcatatgaccataaaatatttatcaaaatcaatcatatatatgtatatatatgcatgcacatacacacatatatgtgtatatacatatagtagactttataaattgaggctataaaataacccaattatattaagaataaataataaaatgttgaccaaaaataaaaagcattaactatttagaaattaagaaagacatttccaaatagccattagatcaagaaaatttcaaagctaaaattatacatgctatagaagcaaataaaaggaacacttcatagatgaacttatgagagacagccaaagatatactcagagatctgaaaaaatagtcataatgccattaagatttcaaatgtaaaagactggaccccgtggtgaaacccagtctctacaaaaacacaaaaattagccgggcatggtggcctatgcctgtaatcccagctactcaggaggctgaggtgggaggatcacttgaggccaggaggttgtggctgcagtgagctgtgattgcaccactgcactccagcctgggagacaaaacgggaccctgccaccctccccccacccaaaaaaaaacccaaagaacaaaacaaaacaaacaaaaacctcattaatttaatttaatttaaataaataaataaataaataaaagatgaagaaacttggtacctgtccagtaaattaatgaaaaatggaaagccgctttaggaagagagaattcatagaaacaaaacttgaatttaaccaaatgagcaacaaaaattagcagatgataaattaatccaaatgctggtatttcaaaggacccaataaaatacataacctatcacaaacttattttaggagataaaagaaaaaataaaaacgtagaggatcgggagtgagaaaagagacaaactacaatacaggagaattttttttaattacaagacggaattatatgcaactccatggcaacaaatttgtgaatctagaagaaatgaataatttcttagtaaaatgtgaatgaccaaaattgacccaagaaaaagacatgaaaaactttgaataggccaattaccacagaagacactagaaaggttaaaaagacctttcactaaaaatgttacctactggcttcatagctgaaatctaacctttaaagaacagctagttcctatgttattcaaatgattctaagtcagaaaaaaatacagaagctcttgactcattttacaaaaccagtacaactttaatacaaaaaaaagttgtattaaactttttaaagaaagtacagaaacagataactgtaatttcatttatgtgtttggatgcaacaattgtttttaaaaattagcaaat

SEQ ID NO: 231 - DNA, 2301 bp, Homo sapiens
cccttgagattttacctagagataccgaaagaaaagataacatctgaatacaagaatcgcgttgcatatttgctgcctccatagggttgttgtggtagcgactgattttccacccctcccagtttggtggtgtttgtttgtttgtttgtttgtttgttttaagtaaaatgtcagaaatgcaaaaatgctgcatttatttcccttaagacattgaaaatagtggaagtttgcagatttttaattcttcgtaggtctgagctggcactagactgctaccaaaggggtctgttccacacgctaatttcaggcttgcggaccatcagcaaactgcaatgaaacctgtgggcatgaatcttccagagtggtagaatctcattcccatatgcccgccaagtttccaggtgtagctgggaaaacccaaatgttccctggatcccgagatggctaataagcactcaggcctgctacaccaccgaacagagccccacagccagagaggcacacggcctgcttcacacagccgacaaccccgctggaaacaaccagtgctgggagccaaggccaaactgatgcaaaggcgctactgagccagagcccttctgcaccgagactaccccaggcatgcaccgccctcccaaaggtccaaaacgatgcaaaggcgctactgagccagagtcgtgcactgagactaccccaggcatgcaccgccctcccgaaggtccaaaccaatgcaaaggcgctactgagccagagtcctgcattgagactaccccagacatgtactgccctcccgaaggtccaaaccaatgcaaaggtgctattgagccagagtcctgcactgagactaccccaggcgtgtaccaccctccggaaggtccaaaccgatgcaaagccactattgagccagagtccttctgcaccgccctcccgaaggtccaaactgatgcaaaggtgctactgagccagagtccttctgcaccgagactaccccaggcatgcactgccttcccgaaggtcccaaccaatgcaaaggcactattgagccagagtcctgcactgagactaccccagacgtgtaccgccctcccgaaggtccaaaccaatgcaaaggcgctattgagccagagtcctgcactgtgactaccccaggtgtgcgccgccctcctgaaggtgcgtgtgggtcgacaagggtgcacaagcggcagggggctgcatagcaaggtctccttcagctttgttttaattatttttatagagacagggtctcactctattgcccaggctggtcttgaactcctggattccagcgatccttccaccttggcttcccaaactgcaatgattacaggcatgagccactgcacccggccaatctttgtatattgattttgtgaaggctctttatgtattaaagacattcattcacaggccgggcacggtggctcacacctgtaatcccagcactttcagaggccgaggcaagcggatcacctgaggtcaggggtttgagaccagcctggccaacatagtgaaacctcgtctttactaaaaatacaaaaattagccggacatggtggcaggcacctgtaatcctagctacttgggaagctgaggcagaaaaatcgcttgaaccccagaggcagaggttgcaatgagccgagattgtgccactgcactccagcctgggcgacagagcgagactcttgtctcaaaaattaataaaaataaaataaaatgaagacattcacagttctatatactatgaataaattttcctagtttgtcatttaacttcttaattcatggtgttttgttttttcagtttttttttttttttttgagatggagtttcgctcttattgcccaggctggagtgcaatggtgcaatctcggctcaccgcaacctccacctcccgggttcatgcgattctcctgcctcagcctcccaagtagctgggattacaggcacccgccaccacacccggctaatttttgtatttttagtagagacagggtttcaccatgttggccaggctggtctcgaactcctgacctcaggtgatccacccgcctcagcctcccaaagtgctgggattacaggcgtgagccactgcgcccggccgagggttttaaagatcataaatagggtaggtattaacaatagttactattatgatatgtgttatgacttcataacagggaaaatcttctggtcaagctgctcctgggcatagccaacgagggaagtgtcctctggcaggaaccacagctctgggaggaagaaaaggaagccgactacag

SEQ ID NO: 232 - DNA, 14942 bp, Homo sapiens
actctttcatcattgtgtctgtggatctcacggttccagttctcagcatggtttcccctgggtggttgacccttggtactgcgtcggttatagccagccctgtaacccatctctgggtgtcctggggagactgtatttcactgtttccatcttccgctctgctcttctcccagcctcttagtctattttagcttcttttctgtggtatttctgtctctctctctttttaaacttcgtcccccaaatatttattgagcagctattccatgccaggcacgattctaggcactgggggtagagtggggaccaaggcagagcatgcgccagccttcaaagaatgtttttttctttcttttctttttttttttttgagacggagtctcgctctgttgcccaggctggagcgcagtggtataatctccgctcactgcaagctccgcctcccgggttcacgccattctcctgcctcagcctcccgagtagctgggagtacaggcacccgtcaccacgcccggctacttttttgtatttttagtagagacggggtttcaccgtgttagccaggattgtcttgatctcctgagctcgtgatctgcccgcctcggccttccaaagtgctgggattacaggcgtgagccaccgcacctggacattttttgtagttttagtagagacagggtttcaccatgttagccaggatggtctcgatctcctgacctcgtgatctgcccgcctcggcctcccaaagtgctggaaatgctcgccaccacgcctggctactttttgtatttttagaagagacagggtttcaccatgttggtcaggctagtctcgaactcctgacttcaggtgatccgagggggcttcctttataagcagaattcaccagcagccttggtcttcccacccaaaaggcctgttgctctgccctcccacactccttcaaatggcaatgcagatcaaccagcaaatgcagcctggcaggggtgggggtcaggaacgcatcccagtcaagggacagggaacctgggcaccagacaagaggcgagaaatgtgtgatctagggagaaagagacacaggagccaaggaggaagccgctcgcagtcattctcagcatacatttattgagtgctcactgtgtgccaggaagtaagccaggtgctagaaacggcaaaggagcagggaagaggcgggtcagccgctgggttgaccctggttaatacagggtacggattaacccttcaggctcccttccgagggcctgggcggggtcttggggccgctcctgcccaggtgttctttccagcaatggaaagggattcagcgaggtaagacgcttcccctctcctccattcagagagcggcacacaagaaatctacacagtcttcccaacatgtacacaccctgacatgcccggatgcatctcacacttagataaacacacacgcacacagtcagaggcacggtcccgcagctgtatgaggatgcggtgtacaggtgctgcctacgtgaccgtgccttgagtcgccccactcagcagaaacctcactcagcagaaacttgtccaccagtgattgattatctcgagcagctatttggccaagtcttaccaaaacgtgaaagccacaaaagaaaagtgaacgagagaagagtttcttaaggctttgctcggagagggcttcggagaagggtggggtcagcagatacagaccttactttttttttttttttttttttttttgagacggagtcttgctctgtcgcccaggctggagtgcagtggcacaatctcggctcactgcaagcttcacctcccgggttcatgccattctcctgcctcagcctcccaagtagctgggactacaggtacccaccaccacgcccagctaatttttttttttcgtatttttagtagagatggggtttcactgtgttagccacgttggtctcgatctcctgaccttgtgatccgcccgcctcagcctcccaaagtgctgggattacaggcgtgagccactgcgcccggccctaatttttgtatttttagtagagttgaggtttcaccatgttggtcaggctggtctcaaacccctgacctcaagtgatccaccccgcccccgcttcggcctcccaaagcactgggattacagggatgagccacctcgctgggaccagaccttactttcttgacttggccacaagtctgtcctgctcagagctgctgaaagtggctctcctgttgtatgggcttgggtgtggtgtggtggccctttccctgtcccagctgccttcttcctgggcactgaaaacgatgctaccattgtttttttttttttttttgagacggagtctcgctctgtcgcccaggctggagtgcagtggcgggatctcggctcactgcaagctccgcctcccgggttcacaccattctcctgcctcagcctcccaagtagctgggactacaggcgcccgccactacgcccggctaattttttgtatttttagtagagacggggtttcaccgttttagccgggatggtcttgatctcctgacctcgtgatccgcccgcctcggcctcccaaagtgctgggattacaggcgtgagccaccgcgcccggccaaatgctaccattgttaagtgccaggcgtcccaccatgcgggtcttcactgcgtatccacgtagctgcaccacgcaggcattctttcctcccttttgcagatgatggcaccaaagttcaagactcgcccagggccaccaagacagtcctctagactttggtcttccctccttgcctcctcggcctggggtggtggcgcctcggtctgagaagggtcgaggtctgggtgctgctagtggccctggctcagtctcagagctgcccggagggggtgaggatggctaacttaaggagcacaggcagaggcttcctgctggcaggaagagggctgagctgcggaaggccacccaggtggagtgtgctgcacctccttcagtggccttcaggagctctgtcctcacccagggattggggtgagtcagggcatggggaaacaggctcacagagcccacctgctcaccctgaccaccccaccccaggggaccccaggctcctaactctcagaatcccacagtctgtattggcggaagacgggctggcacccttgagttaggcccccagtcgttggcacagataaggggagctgctgctgaaggagcccgacggctgattctgtggaggcttctcagagctcctggcaggagcccctcaccgcaggaggcccacaacccctcccagctgcatatcggctcacattcacgcggctgccacacaagtgcgtcggaaactccacttggctgaacgtgattgtgctgctgtctgggacagtcttatgcacgtgagcccaatactggatgtcccgccattttcagccctggggcctatggcaaagtgacgcccccctcggagtgcacggcaggcaaggaaggtttaaacggaagttctgaccaggacgatgctgggtgcaagaggggacggggatggagcaaaacagaaaggatccaccagggcctgcaaccacgtctttggccccggtgaggggtgggaccttgtgtataggtccaggcagcagcagctgcagacagaggcctagagggtttggagaaggccgaccacaaagacacgcctagaccccagagtctagtgaggagagggactgggggcagtgtttcggcagcagacccagacccagactcagacccaagcccccctcctcactgatcaaaaccccaagggcagggagcccttcctgctccttcccgccagagcctggaggatgaggggcagacgggaggcccggccactggtgcctgctcctttgatcagctgtagtcccttccccttcacagggcacttgtcttgctggttggggtcaccagggattgctcccccaagtacccatcagcctccagggcccaaatgattccatgcagtagctctctccccctcttctgagaaggctcttggctcccagaaacggaaaccatgcctgggcctgctccccttccttgggctgtgacccccctgccacagaggccccccccccgccacagaggtcccccctgccacagaggtccccctgccacagaggcctggtggcccctgagctgctgctccgagtggaatgtcctggtctagaggcccttggctgctccagtgtcttaagacccatatatgagtgctggctctgaccttgaacaagctcctccatcgctccaggcctcgtttttcaggtgtatatgatgatagtatctctaggcctcgtttttcagttgtaaagcagggatgatcatatgtgtttaactcccagattgttatcaagtcaaggacaacaataggaaaacatgtcacctgtcagctccacacaaggcaaagtaggatgggtgacccctgactagggggtgggagtgcagggggcacccgacccatctggccagccacagcctctgtaccctgctcgcattttcaggcctcaatccccaagcactgttggccctggactgtttccccccctcaattctgtttctcaatgcctgcttcttcccagtaagtgccacaccctgagggtgggtgggagagtgaggcagcactgcccactttggctgggactgggcactgctggggacagcacgggccacgtcttccccatctcaagactggctttttggctaggcattgtgactcacgcctgtaatctcagcactttgggaggctgaggtgggagaattgcttcagcccaggagttccagaccagcctgggcaaaatagcaagaattcatctttatgaaaaagaaaaaaaaaattagccaggcatggtggcacacacttatagtcccagatacttaggaggccgaggtgggaggatcccttgagcccatgagttggaggccgtggtgagctatcagttgcaccactgcactccagcctggatggcagagcaagaccccaactcaaaaaaaaaaaaaaaaaaaaaaaggcggccttttcccagctggcagcaccctggctagttagggtttctccgaatctgcaactcctgtgtgatggcgggtctcaaatgctggcagcagagtcaccggtcagcggcaagacctggagtctccatttggaaccagcacccgggagcctctgctgggggtgatcatggagccgcacgtggaggctggtggctctgatggttcgagccgttcctcggcagcacagcacacccgctcctgaggagccacggagctcatgagcgttggcaaagtgctgtcagtgctggctgtaaggaaacaggcttgacttttaactcagcctttcccaaacttgactataatactttcttgaaaatcagaataaccactaacatcacaaaacgagtgttctcaggagtgggcatgtttatctcgttctctttttttttttctttttgagacggagcctcgctctgttgcccaggctggagtgcaatggtgcgatctcgactcacggcaatctccgtctccccggttcaagcgattctcctgcctcaggctcccgagtagttgggattacaggcgcacgccaccacgcccgattaatgtttatttttagtacagacggggtttctccatgttggtcaggatggtctcgaactcctgacctcaggtgagcctcctgccttggcctcccaaagtgctgggattataggcgtgagccaccacgcccagtctttttttaaatatttgagtgaaataaagcctaggagatatgtgttccaggcgcccaagctgttaatgtggagcttgaatgtggcctggacctgccctttcctcttctcctttcatccccctccctgccgcccacatcctgaactgctctgagcctgcagaagaacccagcgggaatcttcagggttgtggaagggtgtagggatggaaagggaccaggattcgcctgtttggctgggaaaatcggtagaggagggtggctcacacttctaagatgtctgcacaagcccagtttgtttgggggttggggaggaaggtcttttcctggcccactgtccctcccgagtcagcagtcccccagagagacgaagagcagctgggcacggctggagctggtcggtggcagagaatcttgtcctgccttttcttctcaagctcaaaataggcacatgcagctattaactgatatgccagaaggggcatcccttacccggaggaaaatggatttattgctttataaaaaagaagtctaataaaactgaagagaaaataactaaaaatccaaacacaactcacccctctaagcacgcccaggaggtctcaagacacacttctgggggcagtcaaggtgggcgggttggtgggccaggcggacgggcctcccccgtcatcagctccagggccccacggagcccgccggcagggggtgctgtgggcctgtggccttggacaagctcctggccccacgccaggatggctcctgggcactggcccagctgcaggcctggcggctcccgcctggtcagtggggataagggctaactcctagagcccaccccgaccccacacacacctcggacccacccacgtccccaccccggcctggacctccacgtctgccggccacagcctttcgtccacctccacaaaagcagctgtgtgtatgtacggggtgccctggcggcggtcctcaaattcccttcaggtggcagacagaacgagggtgacagtgaaaacgtgtccgcggcattggccctcggggaggaggcgaggggtccacccagcccgctaaaccctctccagggcataagccaggtggggcttctccaccggcctccaacgggtgggcaggccctggacaggcgacagggggctggaattacaaaggaattagcaccgacaacaggaagcgggtccttccttcctcaggcagcctcaggctggccggggagggggtgggggccaggcgcgggcgagacagtgcaagcctttgtcctcaggcaggtacggctgtgggcatgcagccgaggggcaggtggcaggcaggggatggcagccccctctgctttggcaagaggcagaatccagacactggcgggagagcgcctgcctgccgggcgttcctggctcctgctgcaggcaccacagagaccccaggccccgggtccccggggggcggcagagcaaagtcagggcagcccctgcgttcggcaggagaaaacgcgcgtgtccggggccctctcccgtccttccaccacagagctccgaggcagggccccgggagggagcgtgaacgctggcacggagacggcgaaggtcctgggggtgcgtggggtactctggaggggcaggacaggggtcagtcactgaagcacaggcaggagaccgcagttccgaggcggcagccactacacgaaggcctcctggttggacgagccgttgattttgaggaagagtttgtcatcctcctgcctctgctgcagctgccgctccagctggcgccggtagcagatcaggtagagcgggaggcagaagcccagcaggctgagaaggagcagccccacgttcacctggggaggcagggaggccgcgcatcacagggcgtggtggtgcgccgaggctgcagacccgccctccactcgggtttgggaaaggggagaaggtcacggggtggaagggggaacgaaacaggaaggcccacgaggtcccatatgccagcgtcccggttcccaactcttcacaggccatgtggccaccctcagggcctgggcccccaggaaacacgggctgatctgaacctctgggcttggaacaagttcctggtacctggtgaggaaatctggccctcggaggtggggcggggacaggaactgtgttctttttttttttttttttttttttttgagacgaagtctcgcgctgtcgtcattcaggctggagtgcagtggcgcaatctcagctcactgcaatctccgcctcccgggttcaagtgattctcctgtctcagcctcccgagtatctgggattacaggcacctgccaccacacctggctaatttttgtatttttagtagagacctggtttcaccatgttggccaggctggtcttgaactcctgacctcaagtgatgctcccgcctcggcctctcaaagtgctgggattacaggtgtgagccaccgcgcccggcccaggaactctgttctatttctccccaaatcaggtccagagaggacatgttccttttcctgcctagccaccattcacaaagggactcttaaccaatcctaaccaacgctcccacatgtcctcggggccctgaagcccccgagggggaccttgcagctcgcagttagcagaagggggcaggcgcccatgacccaccatcccccgacccctcttacccacagagggtctccctggagaggacccatcatggccagaaacagcggctgctgcagaagggcgaagagcgcgctgatcagagactgcagtcccgtgaggctgccgaactgggtggaggggtacctgcagggcaagcgacagctcacagccatcctgcctcctgggctttgcttggccccaggtgtctggtgaccccgggctgcaccgttggtgccagagaagggtggggtgccagccctcggattccttcctgctgggcagttctgtttttttttttttttttttaagatggagtcttgcactgtcgcctgggctggagtgcaatgacacgatctcggctcactgcaacctccgcctccccagtccaaacaattctcctgcctcagcctccctagtagctgggattacaggcgcccgccaccacatctggctaattttttgtatttttagtagagacggggtttcactacgttggccaggctggtctcaaactcctgaccttgtgatctgcctgcctcggcctcccaaagttctgggattacaggcgtgagccaccgcgcccggccctgctgggtggttctgcaaagtgtttctctttggaccagctccaggccccagactctggggagggcccaccccactcagctgtgcccagggcctgtgggtgtctggctgagccgagtggaaagcgtggtgccagcggggacctgcggtttgggaaacaggcccagagaggagtgtggaggctgggcttggctctgcagtgccctcgtccagagaagcattgagtaatcgcggaaactcagcaccacagatcccgcccccctccctcagaccctgccaggacagccacagcttcctccaggcctggggaggggcaggcggagggcaagcggagctgggattaccccaggggctgttgcgggaattgggagagagttccgggctaaatcttagcacatgtcaggctctgctggcccagaggtgggaaaggaatcccagcaacacatgagctggtcccacatcagagactgtggatgatgatgtttgagtttcagtttttgggtcaaggcctgagccagagaagaaggaaccactgtggttccttttatgtttctggggcttcttggaaaaagatacaggtttcattttagccagggctggagaaagctatggccagagctgggcgcactgaggctctggatgggcccgtctggtgtattctggactcagtcacccatgttgctgcccgtgatgagggcaactggaacttccgcatttagcttcaggcagccagaacctacccatccttcccagtgagcagccagggccagccccaggactcggctgtagtggcccctgaggccataatgagctgcacaggtgcctgaccctggctgggggaactgacttcgtgttgaatgccaaggcttgtgagcacccaactgtctgcccactgacctgcttcccacgaggtatggcctttccctgaaacacccagcagaaaccctggtacctgtcccctgaagcaggaagatgagcccttctgggacaggctgaccctgcctcagagtctcagtcccaccagcaacctccccccggccattcccacaccctcgcccaccaggccacctgcggcttccaggacttacacggcagcgtacaggcccccgacagcggagtggatgaatcctcgcacgattgtgtgcaggatgaaggagaggatctgggggaggaaaaggcgactgtgggcataaggccttaagggaccgtcccctcagcccccgccctccaattcctgggggccctcaccccaggggcagtgtcagcctggagttggatcaaccccatcctccggagccaattgtgaattttcagaaattttgcaagccagtcgttaacacagtcattttttgtttgtttgtttgttttgttttttgttttgtttgagaagaagtcttgctttgtcgcccaggctggagtgcagtggcgtgatcttggctcactgcaagcttcgcctcctggattcaagcaattctcctgcctcagccttcggagtagctaggattacaggcccacgccaccatgcccggctaatttttgtattttttaagcagagatggggtttcaccatgttggcccggctggtctcaaactcatgacgttgtgatccacccgcctcagcctcccaaaatgatgggattacaggcatgagccactgcgcccagcctaaccgagtcattattaaaaattaaattataggctgggcaaggtggctcacgcccgtaatcccagtgctttgggaggccgaggaggtggatcacctgaggtcaggagttcgaaaccagcctggccaacatggcgaaaccctgtctttactaaaaatacaaaaaattagctgggcgtggtggtgggcacctgtaatctcagctgcttgggaagttgaggcaggagaatcgcttgaaccaagaggtggaggttgcagtgagctgagatcacggcattgcactccagcctggtgacaaagtgagactctgtctcaaaaaaaaaaaataataataataataataattaaattataagccgagaatggtggctcacacctgtagtcccagcactttgggaggctgaggtgggtggatcatatgaggtcaggagtttgagatcagcctggccaacacagtgaaaccccatctttactaaaaatacaaaaattagccgggtgtggtggcgggcgcctgtattcccagctactcaggagggtgaggcaggagaatcgcttgaaccggggaggcggaggttgcggtgagccgagatagcaccactgcactccagcctgggtgacagagctagactctgtctcaaaaaaaaaaaaattacataaatttatgactaaataaataaattatattaaagtaaaggtaatgaatactcaaaactctgaaaactcatcacttcctggcctggtgcagtggctcacacctgtaatccccacactctgggaggcctgggaggatcacttgagcccaggagttccagaccagcctgggcaacatgtcaagaccccatctctgcaaaaaaatataaaaattaactgggcttggtggtacgtgcccgtagtcccagctactcaggaggctgaggtgggaggatcacctgagctcgggaagtcaaggctgcagtgagccaagatcccaccactgcactcgagcctggctgatgggagtgagaccctgtctcaaaaaaaaacaaaatgaacgaacaaaaccatggaaaacctcatcccttcctaattattttacttggttcactagagcctgtgcacgcatcaggctttcctttttttttttttggagacagagtcttgctgtgtagcccaggctggaatgcagtggcacggctcactgcaagctccgcctcctggattcaagcaattctcctgcctcagcctccctagtagctgggattacaggtgcatgccaccaagcccggctaatttttgtattttttgtagagacggggtttcactaggctggtctcgaactcctgacctcaggtgatccacccgcgttggcctcccaaagtgctgggattacaggcgtgagccaccgtgcccggccaggcttttcacatctactgtagaaataccacgtgtcactgtgactctccagttccacagtcagtggcaacacatgggcagctggaaatcagccacggtgagtgcatgtgcaccgtggaagtcggcaaacactagaaccagggccctgctgacagacgtgtatgggcacagcactgagcaagaggttgctgaccacggcctcgagctgcctttgcccacctcggactgtgctccagggtctcccaagcctggtcacccggccctcccagcaggtggctgccctctcacctccctcgtgaagtgtttcttcgctttttgttttgttttctttttgtggtttgttctgttttgtttggttttgttttgggacggtctcgctctacaccccaggctggagtgcagtggtgtggtctcggctcactgcaacctctgtctcctgggttcaagcgattgttctccctcagcctcctgagtagctgggattacaggcatgtgccaccaggcccggctaatttttttttttttttttttgagacaaggtctcactccggttgcccaggctggagtgcactggtgcaatctcagttcactgcagcctcaacttcccggggtgcagtgagccgagattctcccacctcagcctcctgagtagctgggactacaggtgcactccacaacacctggctaatttttatttttagtagagacagggtgtcgccatattgcccaggctggtcctagtaaagttctgtcgctgtctgtgggaggccccctgcccaggaaggctgctgctggcggactccgccaactccgagaggcactttttaagagccatcctcttggccaccaggtccctgtggtcgccttgtcttctgtacacagccctgccatcccgctcagcagccaggacctgttcccaggaatgtgggtggtgggggggcaggggctgctcttggcagtgttgaaagagggctgtgcccagtgcccacacacacacacacacacgcacgctgtgcaggcctccccacctcaaatgccttgttgcctttttacaacttttctttcagtgagacctacataaaacaaaaagatgactgtccccactgagcactgcccctcgactggacaaggcggttagggcaaaggtctgccagtcttgcagagaaagcagcccaggaggccagggagggccggagggatgcagcaccccctggggccggcacaaatgttccacggcccgctgcgctctgcacgcccagtgttggcacgtacacacaacagttcccacggtggggcacacctgggtgttcaacgtacctcaaggcctcctgtaaaaagggagggactcttacttccctcctggacttgacccaagatgccatctggactcaggctacacctctctggaaggaaaagccacacttgcgtccctccaccatttgtaaatttagggattgggccaaaacctactgctagaccactttcacagaccagtgggtggagccaggcaggtgacaagggccaccttactcaaaatctctgtcaaaaatcaggttccagaagcctcaaaagtttggcaaagaaattcagtttttttttttttttttgagacacagcctcactctgtcgcccaggctggagtgcagtggcgcaatctcggctcactgcaacctctgccacccggattcaagcaattctcctgcctcagccctcctgagtagctgggattacaggcatgtgccaccacgcccagctaatttttgtaattttagtagagacggggtttcaccattttggataggctagtctcaaactcctgacctcgtgatccacctgcctcagcctcccaaagtgttttggttttttttggtttttttttctgagacagagtctcactctgtcatccaggctggagtgcagtggcgcgatctcagttcactgcaacctccgcctcccaggttcaaatgattctcctgcctcagcctcccgagtagctgggattacaggagtgtgccaccatgcccagctaacttttatattttctgtagagacagggtttcaccaagtcgcccaggctggtctcaaactcctgagctcaagcaatccacctgcctccacctaccaaagtgttgagattacaggcatgagccaccggcctggaatgaagcttttgaatccagatatgaagccaccatcaaggtcttcctccactctgttcagtgtagaaaccccgtgagactctggtgacaggggagcagatgctcccaccaacaccacagattggccagatctctttggacgtcagattccagctgcttgagccgatacaaaacaaggaactctacagcgaccccacacacttccgggaaatggcatgatggtggtatccacggttatgcaagacgcccccaaaaccaagacatgccttccggggaggagtccctttgcagaagacaatccaggtgtccagctcacctgcagcagcaagcacagagcctggcagggaacaggccctccgcaaataacaaagggctggtgggctgctcggttgagtggaatgaatgaaagtcatcatctgagctgggcacggtgcctcacacctgtaaaatcccagcactttgggaggccaaggcgggtggatcgcctgaggtcaggagttcgagactagcctggccaacatggcaaaaccccatctctactgaaaatacaaaaattagctgggcgtgatggtgcgcacctgtaatcccagctactcgggaggctgaggcaggagaatcgcttgaacccaggaggctgaggttgcagtgagccgagatcacaccactgcactccagcctgagcaacagagtttgactctgtctcaaaaaaataaagaaagtcatccgctt

SEQ ID NO: 233 - DNA, 1775 bp, Homo sapiens
aatgcagggatgggtaagagttaggataccaggtaaagtgtcagaaaagatttagtaattaatattgtttcccaagagttttataaatttaaatacatttaattatgtatatataatcatacatatttatatctaaatatatatgacatgtatccatatataacataagatgcacaatatgtaaatacacatatatgtgcatgtatgtgtacatatgcacatacacacgtttatgtatgtacctgcatgccttgatatatttacagtatgcatatcgtatatacagtatacatatatacatatatgacgtatatatgtacacacaccatatttacttaaagtttgaaacagacaaaatacagttaactttagttagatatgcttgtgtgcggtgggaaaactataaagaaagaagaggtgaaatggtaaacacaaaattcaagcagttgcccttaggcagggagaagggcaggactggtgattcagagggagcacgagaagtggaaaggagcttttaagctggcagatttctttttgaatgtttactttatatgttttaaactagacatgtcttttatactattcttttatgttattctttatattattcactattcacaattaaacaagattaaccttaaaaataattcttatgattttagctgttaaagaaatatacttggttagtttagtgtttcttaaatacatgtagaatagtgttgtgggaagtcagggaccccgaacggagggactgactggagctgcagcagaggaacataaattgtgaagatttcatggacatttatcacttccctaagaatactcttataatttcttatgcctgtcttactttaatctcttaatcctcttatcttcgtaaactgaggatgtacgtcacctcaggaccactataattgtgttaactgtacaaattgattgtaaaacgtgtgtttgaacaatatgaaatcagtgcaccttgaaaaagaacagagtaacagcgatttttaagacagcgataaagtctgactgcctgtggggtcgggcaaaaagagccatatttttcttcttgcagagagcctataaatggacgtgcaagtaggagaggtatcactaaattcttttcctagcaaggaacattaatattaagaccctaggaaaagaattgcattcctcgggggaggtctataagcggccgctctgggagtgtctgtcctatgcggttgagataaggactgagatacgccctggtctcctccagtaccccaccctggtgaatttgaggtcagactggttctctgctctcgaaccctgttttctgttgtttaagatgtttatcaagacagtaggtgcacagctgaacatagacccttaccagtagttctgttttgccttttctcctgtttccccagaagcatgtgatctttgttctcctttttgccctttgaagtatgtgatcttgtgagttactccctgttcttggaccccctccccttttgaaattcttaataaaatttgctggttttgtggctcaggtgggcatcatggtcctaccgatatgtgatgtcacccccggtggcccaactgtaaaattcctctctttgtactctctctcttatttctcagactggttgacatttatggaaaatagaaagaacctacgttgaaatattggggatgggttcccccgatagaatagaagcagcagtttgtaggaagtttcacttgtctttcttttctattggagttaagtcttttttaacttaattctctataat

SEQ ID NO: 234 - DNA, 1754 bp, Homo sapiens
tgaattttgtatagcaagttatactcattgtgtcagaacaccttataacctggaccccatctgatcttgggttgcctagaatccccagggaccctcattttctgagcccttcacaggacgaaggttctcaccaggtgaagtagaagctgaagacgggctgagtaagctggctctgctgcagcatcccctgcattactgtaggggaattcccctctgccatgtttgggtaggccattcccaggatcccgtcaaagtctgaatagtaaaaggggtcgctgggctcattctcactcaggccaaactcctggttattgacaacgatgttatgaacctatggcaagcagacagtatggcttgacaattcaggtgcacaaattgcatggcttcccagactaatgtgcacagggtatggaatccagaaaccctcctggggagagaacatcagcttctttcatgcagaacccaaccacaagggtgggagtggagggtgaaagagcaacctttctcatcaggtgtgtctcggaaaaaagagtgtggatgttggagaagtggaagaagtttttttctggagttatagtttccacttccatggacagtgaaagaattgaatggtttcatactgaacaatctatgtgcaagaatgattagaggaattgtaggtgtttgaactaaagaaataagaaaatagtaaaaaggcttgtcttcaaatatgcgaagtgcaactgggtggaagaggcaatagacttatctgtgtgtttccagagggcagagttaggaccacacagcaaagctgcaagaagacacaacaactttagcacaacataaaggcttcctgcagtcaggactgctgtggaagcgatttacgtcctgggatgaaggctgaattagtctttgtgttccttccaacactcagcttctgggaagcttggacctaattagtaagcatgggtttctctaatagtgtaagactctagaaaatgggagccaaaccacagaccctcagaggctatgaaaacattacttacagtcacagtgtcatagcccaggaacacactcaggctgccactcccataggatagtccataggtttgtccatcgtttctgaaggtggaggacaggctgggattgaacctgttgtgattggctatagaaagacagaatggaatattcatttcatttgcagttttccaaaacacgtgaaggctacttatccttgatggattgggctcatcagaccaaggctgggatagggcatcaccctagatcttttcttgtagacaaactgtgctagtcctagaaaagtctatgacacactttgcccaaattccttccagctgaccattccctgagagaaagattgcctcagacttaccagaaacactgggccacagaagggcgctcaggggaaggaaaggaagccttagtctgtttctgctgtctgtctccaaaaaagtcagcacttctgaaaagtggtgctgaagtgacagactgagagcaatttctcaatgttccaaacagaaggaggatacgtgatggacaaagaactctggacttagaatgattcacctgcactcaaatcccagctccactcctctatctgctcccctcatggtgtggagggtggtagtgacatactcacagcagacttggctctggcagtagatggagggcagctacagattggaggaacccgtatcaaagaggactaggaaattttggggtggtgtcccagtgctgatctccccaaagtagaa

SEQ ID NO: 235 - DNA, 5751 bp, Homo sapiens
gactgatcactcattttatttcaccttttagtgagtattcattccaaatgacggtcaagaagatactatttttttttttttactttttatttgggaataattttaaacttataggaaggttgcaagaataagaatagcacaaagctcatatatcccctttacccagatctttttttttttttttttttttttttttgagacagagtctcgctctgttgcccaggctggagtgcagtggtgcaatctcggctcactgcaagctctgcctcccgggttcatgccattctcctgcctcagcctcctgagtagctggtactacaggtgcccgccaccatgcccggctaattttttatatttttagtagagacggggtttcaccatgttagccaggatggtctcgatctcctgaccttgtgatccacccacctcggcctcccagagtgctgggattacaggcatgagccaccgcgcccagtctcctttacccagatctaactcttaatttgttgctccatttggtttctatttccgtttcttcctccccttcccctccgccatcccccccgcacaaatagacaatttttttctgaaccacttgaaggtaagatatatatcataaccttttatgtctaagtaattcactgagtatttccgaggaataagggtaatgtctttcataaccacagtacagctaccaattgcaataaatttttcactgatgtgatgcctttatctaatcagctcttcagattccaggtgacaaaatgtcctttacggcattacttttcccctccagtataggatcttgtctagtgtcgggtgttgcatctgagtgaaaaaattaatgtctataagggtatttcctaaacatgtgattaataatcatactaaagtgtattatgcattacagctttcaaagtgttttcttgtttctttattattaaatatatttatttttcctcatagcaaatacttagaatagtgcttaggttagcatagtaactaatacttagattggttcgtgcatcagaatttctagcaggtctcatctgacccatctgccctttaggattcctcacatggagaagaggcttccatgtcctgagcacttccctagagaagagggggtgaaggagatagggatggaccagtctacctgttgagaaagagacagagaagtgggtctcagtatccgaggttcctgggttgacctgcagacatcacagggccaggtcctttccttcctagcagtgctatttgtcaagacccctgtctgtctcccctgacagaaacattgcggtggtgggggttgtgggggtgcatccagcatgaattctccttatcgttttgactcttcctgttcccgcctggctctcattgaacccacttaatcttcttcctgatgagttggcccaggcaggcccagctttccctttaacaatttgtcatcttatacatcaccagattccaaactctctcaattctagcaattctgctttaggataagaaaaaagcgtgtattacttttgcaaacaggtgcaaagtaaattggtaatcgtactgaagtacattatgcattgcagttttttaaagcattttcttgtttattgtagttatctggcctcataacacacacttgaggtagatgtggcacatgtgatctccattttgtccacagaggaactgtggtttaggaggtggcccctcaccaaagctcacacctgtcttctctgattttgcatcttatgctatttccacagggctgtgcttcctaatcagtttgttaataaaactcagtattgtgcatttggtaggaattggtttatacaccattcaagaatagtaaacatttacaccctagatttttaatgatctgagacagcaccgaagtatataaaaaagttaggctcctgagcacttaattcttcaaggaaggggatggaggaaaatctctatctgcagagataatagcagcttaagggtatcttaaatgggatgcttctcaggactcttggagacttagagctagtggtgtttaataaccacagtttacatcactcagagtcatggaatagttctattgcataaacagagcattttatggaaacttagaaaccctcactgctgcaggacaaatgctgtacaaaatcgaagatgccaattgtctagattattttcccctaacaattttgtatgaaaaatttcaaacatacagaaaagtgaagatcattgtacagtgaacagctttattcccacctcttccactcccacctgtactctcaccacccccctacccccacatctagattatgcagttgtaacatttttctacgttagttttttgggtttttttgagacggagtctcactctgtcacccaggctagagtacagtggggtggtctcggcacactgcaacctccgcctccagggttcaagtgattctcctgcttcagcctcccaagtagctggaactacaggcgcccgccaccacaccctgataatttttgcatttttagtagagacagggtttcaccatgttgaccaggctggtctcaaactcctgacctcaagtaatcctcctgcttcggcctccaaaagtgctgggattacaggcgtgagccaccacgcctggcctctacattagttttatcacataaatccaggctatttttgatatactttgttaataaaatcattaagcatctttgatgttttggatggaaggcaccctacagtctcttggtggctgagtttccttttatttttcagaatccctttgaaccccggcaacatgggacagagctgagagcaagggccttgattctcatactcaagcctcccgacagcccgctgcatgcgccaggcttcacgttgtactcgtttgtccagataccatgaaaaccctggtcgggtgtggtggctcacgcctgtaatcccagcactttgggaggccgaggcgggcggatcacgaggtcaggagatcaagaccatcctggctaacacagtgaaaccccgtctctagtaaaaatacaaaaaaattagctgggcatggtggccggtgcctgtagtcccagctactcggggggctgaggcaggagaatggcatgaacctgggaagtggagcttgcagtgagccaagatcgcgccactgcactccagcctgggagacagagtgagagtctatctcaaaaaaaaaagaaaaaagaagaaaaccttgataaatattagtatggggatacattgtcccctcccccctttttctctcagttaaaaatctgtcccagaatgaggtttggcgggacatatggtttggcgtgcttgtgggggctggcagggtgaggtatgtatggtagtgtagttatctggcatcttatctgctcactggaaatgttgggcactgaatagattagtcagagtttccagaaatagaaaataaagccatataataaatgcagaagtcccctagttaatgtcagctgttgtgtgatatctgccctaagtcattttattgcctttgtaagattcttaaactgtttatcattatccctgccttttttaaaaatggaagcaacatcttcctaaagaggttgttatgagacattagaaggcctgctttcatgcctaatagttatcaaaactgaaattcagtatagcagtgttgaaggtgaaagaaggtttgggtacttttaggtagcaagagagataattataagctttcaacccaaggtcaagataaatataaatctggaggaggaaaaaaaaaaaagaagtctagcttctcattagtaggacagcgttctcattttataagaccttaatacccaataggaaatggccgtcaattctgttcatttcatattctcacagcctgtctctcaggtgggagaacacagctaattcttagggtaagtgtcctcttttagaataaaaccttaccaaaggagagctgaaatgggttgtcccccaaggctgggagatgtgtttggttccctttgcctcacttcgacctttctgaaatcaagaaacaaacaaaatgaaatcgacttgtgaaaggatgtcaaaacgacatggcaaattcagttggtttgttcagaattttcttcctgtatttcctttttgaagttacaacagtcattcaggagcacgtccagaggagaagagctgggagggaggacgggtggcttctagagtcaaggctgggtttgcctaaccctgaccctcacgggggtgatgcggatgttccgaagaatgcattagcctttgactttaaggaccgcgaggagagttttcttccgaatcaagtgaatgcgggtgcatcaccctgtcttcctcattccctgtgtcagggaatgcatcggtagcctaaatgactttccctggaactgaagcatgtgttggctctactgtggtgctttaatgtttcctgaaatcctccatttggaggatagagtgcccaggagtgagagaatactgtgttattagaatgcttgttaagagggaaaaagaaaatagagcattaacagacaggcaatgttccattcccccgaggaagatttatgtgacctagatgaacggaactacaaatcttggagggacaagagacttcagaaatggcaagttcttagtttgggaggctaggtattgaagtttatccaaattaatttggaagtttagatcagttgcaatcaaaatccttatttgattgacagtggggatggataaaatggagtttggatttgaaaatctacataggaggaggaagtaatagtatatctattttattatacgtgtgtgtgtgtataactataacaattagaatatcataacactgttaatagaccataaagtgacaaactaccccaaaacaaatcccattttcacataaaaatttaatatatgataaaaaagccttcacaaatcaaaggggaatgaaaggcaagattattcatcagatagttaggtcttcatcttacaccggaataaattcaattgaactgaagagttaaatatgtattacaaaaaaaaaagccagcagaaaaatcaatagatcatatcaatcactcctctagaaatggacattatgaaaagtagatgtcagtatggaaaaatacttttactaccaagtgatataaaatgtggattgaagaaaaaaggtgaaatgactggcatgctttattgccagttggtttagggggtcaggtgtagatatttttgttacttgttttccaagatctgtgatgtggttggagtaattcaagagaaatgtatttataatatgcatgctttaaggtacgtctattcctacttttaaaagtggcagatttgtgttttttaatgcataaattagttgaatgttcatccatccaaagagggatttcttctgatagattggggtgattagctgaaagactcagttcctggagaagagaacactagtggaaaatgcccaactgttaggggaatgaggaacaacagtgctgttcactgcattcctaacgccggcttatcagagttttgttttctgtttcatacacttaggaaagtattgttgccacaaagtgcatctctgcctgttagaaggatccagacatagcgtagacggattgtgcaatggagtcagaaataggctgtcctgctcccagtgagtgacttccccaccccttcatcctccttgtaaatcaccggcattcctgatcactttccgtggttccagctaggttaacaacagaagggatcatttccctcataac

SEQ ID NO: 236 - DNA, 13510 bp, Homo sapiens
gaacagtgtgaactagactgacttttcccactgagatttactgataggcaaacttttgtgcacattgtggacactggttgagggtaggctcactagttttggtactattaatggtcagttgcctgtagaacttgtgaagtaagaaaaggtatatctatagcaagttcaaggttcagataattgttgttctctcttaagaaaaaggttttgagcggttgtcttctttacacttagtgtatgtaatgatagtttggctaaatatgaagaagaaagagaaatagcattactactgtttattaataacttttctttgtgccacacatttagctattcaggcactttgtgtttgtgtgtatacatatacattctcttatatacatttgcgacatgtggtaaaaggccctactttttggagtcagaaattgtgctcatttctgtatctgccaccttgtagctgttggctcttgaacaacaactaagcctctactttgaacatcaattttctcagtaaaatgagggaactagactaaatagttgccaaaattcttagtccacacacacacacacacacacacacccattttgtacttctaaagacactggaaagaagtttacggatggaggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaatagataaaaccacaaagatggggaaaaaacagaacagaaaaactggaaactctaaaacgcagagcgcctctcctcctccaaaggaacgcagttcctcaccagcaacagaacaaagctggatggagaatgattttgacaagctgagagaagaaggcttcagacgatcaaattactctgagctacgggataacattcaaaccaaaggcaaagaagttgaaaactttgaaaaaaatttagaagaatgtataactagaataaccaatacagagaagtgcttaaaggagctgatggagctgaaaaccaaggctcgagaactaagtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcaaccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatattctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaactcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagacatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatctctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaagtttacggataaaagaatgagaagtagactgacattgtacttttcattaacgtgttgaatgcctaaagaatggaaggaaaataagcttaaaattttgaatctatgataaagaaaactattgattaaccatatgcatatttgacattaaaataattcataattaggactaacagatttctggcttaaaaaatctaacaattactttaagaagcaaaagacatttccagaataaagtagggggatatatagaaaagttggtaccttttttaaacagagtcttcttttgtaaggaagtagaatttattcatcaaaggagatttatgaaaagtatggtggtatagtgagtggcctcactagttttaatgattgatatttgaatatagcttagtcttataacaactccccaaataaaaatttaaaattcatttgtatccctttgattttcagtgctaaaaactagattgtgaatgtcaaggaaatatttaagttatttctgaactaatgtatttgtagagagaagaagggagtgtgcacgtgatcgagaattatgttttgaaaataaatgaatgattggctattaaaaaaatttttaagccttaaaaaaaaaaaaaaaagacactgtataaatgttagttgtttgagcatttttgtatatacgtgtatgtccacacacatatacacaacattttaaaataacatcagttattttccctcttttatgtttttattttcctaataattcataccagtgatgtaagatagtggtacccagaccccataatctaagaggaatttgttgccatttgaacaaggaatgtgttgcctcattcatattttcaaaaggatataaatacattgttgtatatctttaggggaaatatatattcagtattttaaccagagttctcactgctgtgttcccacattgttaatatcaggtagtttgcctagatgttcacagtagaagtacagggatgtagaaacatggtctttcttcccaaagaagtcatttttctttaaaatttgtgaaataaatgaattaattgagtcagcctttaacatagtaatccattttgcattattcagctttgattgaaagagacagagaaaatatgttttgtcggggggtggggagaatgggagatagagatttctcagaattaacagggtgctctatagctcaataagaggccctgtatatacagcaggatagatttgtagttagttaaggaaatcttaagtctaaaggttgtaattcccttagaattcctgtaagttaattgtttttcccccactgtaatgcatacccttgaaaggcaggaaccttctgtttatcattgtatcccaagggcctatcataagcacctggtaaccaataaatgttgaactgatatatgaaattttcctgatcttagagattaagtattatcctcatggtctaggggaataaaacatccacacgtccaaaccatagtaattctgtttccatattctgctatctatgggtttcattattttaagtattctaaacttacagagagcaagactaatactttaaaattttattttggtctatagggaaaaaaaaaggttatttgagtttggtgactgtgtccatcactttggtttaccactgaattcacagcagatactaagaagtatctgcattgttttgtttggtttggttgggtttttaaaacagggtcttgctgtgtcacccaggctggagtgcagtggcatgatcatagcccactgcaacctcaaacccagagtgaatggatcttcctgcctcagcctcccaagaagctgggacttcaggaatgcaccatttgtgcctggctaatttttatttttttattttttgtagacatgggatctcactgtattgcccaggctggtcttgaactcttagcctcaggtgaccctcctgcctctgtctcctgagtagctgcaatcacttaatcctttaatagtcccaccaatctattattatctctgtttgacaacttatgaaactgaggtcagatagggcaaatgcagtcatgcaccatataacaacgtgtcagtcaacaacagaccacatatatagtggagatccaataaattataataacatatttttacagtacttttctgtatttagacacacaaatacttgccattatgttacagtactgtactacataggcaactatgctattcagtacagtaacatgctgtagaggtttgtagcctaggagcaataggctataccatagagcctaggtgtatagcagactgtacaatctaggtttttgtaagtatactctatgaagtttgcacagcaacgagatcacttaacaatacatttctcagaacgtatgcccattgttaagcaaagcgagactgtaattgacctaaggtcacacagttaacaagtagtgaggttttaaactaaggcctttgaccagtgctcttgatcattacagagtggtaccaacatggtagcataagctttaagaggagggaaaacttggttcccgtggctttatcagggaagacttcttagaggaggtagcagttaagctagcccttaaagaataagtcttatcttgaactgaatgtatgctagagtcagaattatagaggattagattcagaataaaaggccatctgtttcaagttcctaatttgcagaggagaaaactgggatctgtgaggttaaataacttgttgtaggacatatggctaattaagtggcattagaactgttctcttccctcctctatcctgtgttattccctgtccccctccgttaatgcacactagctcatgttaagtctgttttttcatcaacactttctaataagagttcctaaaaacattttacagcttgaaagtggaggctttcttgtgtatctatgtatggtgatgaggttaaaccaggaaagggtcagggcaggcatggaaggagatactagagatacgtggagacatggagagacagaccttttctatctgttttttgtttttttttcctagcattttactttattgttacatctgtttccttccataagtatagataattgagtgttgagagaaaggggacaaatgaaattctaatgagaaaaaaatgatttaaaattccacaaaatctatggaatttcagcctcttaagtaacctgggatgtttttaactttcactaatgtttattagccagtgtccttcctgccacccacctacaaggatgtctcaaggatgaaatgaggtcatatatgtgaatacacacttaggatacaactgccatgtattggcagtcttgtctgttccctgggcctacactgttccttgcctcaaaatgtagtactatcaggtagtgttgatgtttcattagccaagtggttatatcagatttatgtactgctaaacaattgatctgggacttgggtaaatactcattggaaaaacatttgttgtattctgagtgctccctgttaatcttctcctcctcagatagcaagctagatctgggacttaaggtggatttttttccttatttttttttcctttgttttacccaatgattgaaaatataaaactaaacctttttcagtaaagtctgaatcagcagatacttacattactttggcataggctttttatagactagctagaagaatacagtaattagcatatgcatttcctcattaaaatgtcattagtgaaggctttgttcttttaaggtccttcaaataaggtttattgcattgcattccatcactaatattttaccaggagtcagatatcttacttaggtgtgttgaagcaagggttactttggactttctatagggtaatgacctaagagcagacctggacacacataaatctctatgcttacattgggtgggccctactttatgtactagtaataattaccagtctcttctcacactgtccattcagaatcctttggatatatagacatttagcaaacctagacttgtttgaaagaataaactgttatctgcactaaactgttttccttggttatcttggtaggatttgatttgaaaaaaatgtatgaagaattagaagaaaagaaatttataatgtactataatcatttgagatacagtattatgcaggagtaagaatacaggctttagaatcagaccattgaggattcaaattcttgcttcatcatttactggttgtgtaactttgtgatacttagcctttataaacctcaattgtctgaatgtaatacggaaatatgagtggtccataccttataggaatgtttgagaattcagttagattatgcatgtaaagtatttagcactgctgcctggaatatatgatctattattacattaccggctgggcatggtggctcacgcctgtattcccagcactttgggaggccgaggagggtggatcacctgagctcaagggtttgagaccagcctgaccaacatggtgaaaccccatctctactaaatataaaaaattagccgggcatggtggtgcatgcctgtaatcccagatacttgggaggctgaggcaggagaatcgcttgaacccaggaggcagaggttgtagggagtcgagattgcgccattgcactccagcctgggcaacaagagtgaaactccatctcaaaaaaaaaaaaaaaaaaaaaaaccaacaaaaaattatctttataatagaaaaaaggagtgtgtgtattttcatatgtattgtatctgctttctacacatctttgacttaagaaatcctaacatgaaatttcaaaacaagtaagaaggtatttaaggagtggtcattaatatcattaattggcttaaggcaaactttctttaaaaagtcacacacatggtgtattcaaaataaactacttcacttaatcattttaacatttctgctatgcagcgtgactagcaacttgaaggagcaagttaggaaatgcctttgatgaccccatgacatcactatgttattaaataactggaaataaactgaaaattatgggatagtctttaaggctttcatgacatttcagcattttagggttgcagtattccaaggacttttagagtaattgcatgtcatcctttgtgtgttgtgggcaaatttgggttagctaaaagttggtcagttaaaaaaaatttatattaagcatctactctgagccaggcattgttcttttttgctgtgaatatagtgctgaacaagaacagaagccttgctgtcaaagacgtaacattccagggtaagaaaatagataactcataaagaaggaaatgattaattcagatacttgtgaggctatggagaagataacctaggctaacgtgatagagatgggtggtgaggatgtgagttaaggggaggccttttgcaggttgttgggaggagatgcaagtgttccaagcagaagaaagaagaagtacaaagtccctgatacactaacaatcttggtgtgttcaagggacaggaaaaaggccggtgtggctggaatttggtgttcaaagcaagagaggagagataaaggaagatgagtcatgcagagccttttgaaggctgtgggtaaaatgtatgttatacggaacttagttctaaatctagttgcagtggattaacctggagagtgatgcaaactgagttttactctggaaaaacactgtgactgttgtgtggagaatatgctcccaagtgtagaaactagatcaccttgcatgggccaagagagatggtggtagtttaagactaggattgtagcagtgaaatgtaaagtggttgcattcggacatattttggatagagatttgacaggaggtaggtggattggacatgggatgtaaagtaaaaagaggaagcaaggatgacttccaggagtttagcttgagcagctggatggctgatatcatgtgtaggcatagggaaaggttgtatgaggaagaatttatagggtgtgagggtgtgaagcagggaataattttgttttgacatgttatgaaagaaatgccaattgacggctaagaaaagatgtcatctgggcaggtaaagaatctaggagattgggaaaatgtccagcgtggaggtataaatgtgaaaaccatcagcatatgggattgaaagctatggggctgtttggattccctaggaagagaatataaataaagaagggggctgagaacagagtctcatttataatatcctgataaggaagaagacccagtgaaggagatgaagaaggagaagccagtgatgtaacacaagcatggatcatggcaaaagagaaaaaggtgtttcataaacaaggatgcttggtatggccacctgtgtcagtactgtgaagttgaatatgatcaggacaaataatattaattggggctttatatttctcctttactacaaccgattaatgaaacaaaaaattaacctagcacccaaggtgtttcttatagttggtctctccagtctgttttagtatcatttgttagttatttccccaaactaatgtttagcttctttctccaaaaagaatatattttttttcctggttctgcttgttggaatccccccctccaccatgatataaaagtaatggggcttattgtaagaaaacagaaaatacaagaaaataagggacaagatttttaaaaatggattcaattctgggaacaacaaatgacattggggtataggaattaaaccgtgtgcattctgtctctcaccccaattttatagtcatttgctggggaccttttctccccagggtacttgcatagcttttgtcaagaataacccttctcacttccccacctccttcttctacatgcagatgcagcacttttctgggtaa

SEQ ID NO: 237 - DNA, 78395 bp, Homo sapiens
tcacgacaagcatatgaattagcagtttttccaacctaaagagaattatctactgtctctagatgattctcaaaatatgctgatagcaatttgaagcattataaatctatccaggttggttctgaccatgttgtagaagtaatttcaactggcacgtcacatgaaggaacagatttgaaaacagtggtatgcatgcccctgaaggtttcatcttggctaatggtctcaccaccttatggcactactttggattgtgacaacggtaccaaagaaaatgtctatagtctggaaaagatttatcactaagtatgactgtctatcactctggatgtacccccttgttataaatctccagcaagactgatcacttggtatacgtaagcatgtaggtacatgcatgtacaagtcaggagtgtgctgtgtacttgtctagtatcacttggtgtattagtatatatatatatatgtgtgtgtgtgtatttatgtatgtataataactcatagcaaatgtgtggacatagatgagaatataggttattagtttggagaaagacttaccagtttgtggacattgtatatacagaaattctcaagatttctcacatgatgtgtgtgcatgtgggcttgtacatgtgtgtaggtgtgcattccgacagtgtcttccatgagcgatgtagggtattattgacttgaggaagcaatcactgcttacatgaggaggcgtgtcatcttgaccagcatttaatgggaggggaaagcctaactccgtaaaaacgcaactgttaaatcttaactgccttagcctttcattctgagctgagacgttatactaaaatttctaaagcagagacattgttatttttcacgtattatgctaataaaaatagtgactggtgtgacttagtgattggagaaaaggggcttaggactgtaaatattggtagactttcctttcggtacacctttataagttatccatttaatcttaaaggaaattcaaatgccaattcaactgggaaatcaaactctgatgcaggcaactcagggacctgttctctgacccacgcacttgaacagtgttcacagtgagaacagttgagtgcatttagaagctagatccacttcaagaagttagcagtaggaagcatttcttttcctgttggctgggatgtagaggggtgttagaactttttccctctacttttgcaagtatgttttagggaactttataattagcttttgtgcatattttaattatttttgcccatcatcaggtgggattaattttgactgagagcaacagtgtagtggttggtttgtctcatgtaaaaggaaggctgggcctaggctgcagctcagtgatgctactaggaactgaagcacttcctattactgctctacctcttccccatgtagaatgcagtcattacttatgttgcctcacagtcataagttgaacttcagatttcatatcttaaatctggaaagtacaaaaggctctgtcttaggagggtttgtcttttatttatttatttatttatttatttatttatttatttatttatttcaaacagagtctctatcgcccaggctggagtgcagcagtgcaatcacggctcactgcacccttgatcttctgggcttgattgagcctcccacatctgcctccagagtagctgaaactataggcatgcaccaccacacccggctaatttttgtatgctttgtagagacgggtttcgccatgtctctcaggctggtctgaaactcaggctcaagtgatccgccctcctcagcctccaaaagtgccaggattacaagcgtgagccactgcgcctggctgggtttacctttttattcaggtaaggacagtctcttctgggatttgtagcaatcattggccagaactatatcaaatagtcatcccctacatatgaaggaactaaggaaataaattattattattattattgttattattattattattattattatgtttgagatggagtttcactcttgtcacccaggctggagtgcagtggtgcgatcttggctcactgcaacctctgcctcccaggttcaagtgattttcctgcctcagcctcccaagtagctgggattataggcacccaccaccatgcctggctaattttttgtatttttagtagaaatggggtttcaccatgttgggcaggctggtctcgaactcctgacctcaggtgatccgcccgccttggcctcccagagtgctgggattacaggcacgagccaccgcacccagccagaaatcaattatttttaattaaacatatcactgccctgaaaaaaaaatgggattctccttaaaaaggaagaagggagacgtgtacctgtaaaagagcactgctggatgatatattcccctggcctctgaaaatgcacagtggtcaggccaaccggctcatttctattgcatgatatgcacaaatcaccattgaacttcaaaaaaatcctaaaagagcaagtctcaagacaggtaaatccacagccacaattactactaaatgagaacttttagtttggaaacaagcacctagagaatgccaaaaagtcaatgttcctgcagatactagaagggcacagcataggtaaacacactttatcaagtactgtgatactgggatgttgaagcttgcctggtcacatttaaaaaaaaaagtgtcattttaatcagaaaagttttaacataacatacagtcaacttataaaattcattacaccaaaaataatatagatactacatataattagagtcagatattttcacagtgttaatggatgattccaatcctcagtcaacagacagttattgggaacctactatgtgctcacagaccataggggaatatagactatctgaacagataactatgacaacatggcaggtactaaactgggatatgaacgaggtggttttgggaaacaggacaaaacagccaacgctgccaaggattgttgatgaaggagtttaaactctttccttttttttttccttttttcttttttttttttttttgagacagtcttgctctgtgagcgatctcagctcactgcacctccacctcgtgggttcaagcaattcttctgccttagcctcccaagtagctggtatcacaggcacccactaccatgcccagctaatttttgtactttcagtggagttgaggtttcaccatggtggccagactggtcttgaactcctgacctcaagtgatccacctgcctcggcctcccaaagtgctgggattacaggtgtgagccaccatgccccgccaaactctttcctttggtgtttatatcctagaagataaatttggccttcaacaaactatcccttgataaccttaccagaatacctgggagcagaccagggtagaagttcttatatagtcttatgttcttatttttagcttccaggaaattcaagtttgggaaagtaaagaatgcctggattgatactaagagaataagtgaactccaggtctcaaaattttgctaagtaaatccttgtcaaggatcttcgtagagcaaggaatctaagatgatttatgcatctgtagaataacaccataatgaagctgttaacctagccaaaagctttggtggacatgacaccttaaaggtggccattataaagtgagagcctctgacagctttttcatggttttagataagtgggtgtttgaaatcattctggcagctcaccaaatgtttctttgcatcttgactactggatgaatcttgactacaagtacagattttatgtatacttattaaaataatataatttggctgggcgcagtggatcacacttgtaatcccagcactttgggaggctgaggtgggtggatcatggggtcaggagttcaagaccagcctgaacaacatggtgaaaccctatctctactagaaatacaaaaattagctggccatgctggcgtgcgcctgtaatcccagctattcgggaggctgaggcgggagaatcgcttgaacccgggggtcagaggtcgcaggagccgagattgcaccactgcactgcagtctgggcgacagagtgagactccatcccaaaaaattaaaaaataataaataataatataatgtatgtcccagccaccccatgccctgtctggcactactgccagcactggggaactgggaggagagctgaggaacagctccccttgtaggctcctttgtcttcattgattgacatatccaaggagtcctgttcccagcagtggttccaatatgagcaaaagcaaatctttgctcatcttcaaatagccttgtgtatttaagtaaccagaatgttccacatttctgaaatgactatctcacctatctagaatataagttattctaggcaggtggcacctgtgtcttattcctctatcctaaaacagaggagggattcagtaaatgattgctgaaggggtctacattagagccaaaggtggtctgagcaatccagcctgttttagggacctgggtgaaaagtcctggggagtcagaagctctgtgaaaacaagtagagggaaacagaaaagacaacaaaggggtgacaatgtttcctactttccatttgacaaagaacctgggtgtattgtagttaatatccctggggggttatcctgagagatgacatagaagcttgttgtttttggtataaacccgcaatgtcttcttatcttcattcccctttctcattcctccttagagttacctaagcacaatttcttttcttgttttgttttgttttgttttgtttttttgagacagggtctcactttgtcacccaggctggagggcagtggcgtgatctcagtttactgcagcctctacctcctgagctcaagcaatcctcctactcagcctcaagtagctgggactacaggtatataccaccatgcccagctaatttttgtgttttttgtagagacgggatttcaccatgttgcccaggctggtcttgaactcctaggctcaagcaatatgcccgcctcggcctcccaaagcgctgggattacaggcatgagccaccatgcctggcctctctttaaacactttttgcttacacactgcttttggaatgaaaagaacaaggagacttcagtcatatcctcctggatttgaatgctaaggagctgcgtaacatttctgaaatcttcccatgtttattaataagagaataattctacctaccttgtagggttaaaggttgagtacgatagcatggaagaatttgcccagcacctagtaggctgtcagcgcctgttacctttcctttccccaatgctccctaaagctaagttcattggcccatcatgtagagtaatgggtccacaggcggtgaattacttgtgatgctcttccaaggactgaatgaggagagacattttaatcaaagcaccagcaaagcttttgtagcgatgaacatacaattagtgaccttctcctatcagggataatcagcagtgggactggcagaattggaatttttttacatgggtgatctgggcacagatactcagtcagctctgtgtcgcttagaactgggaggcaggaggcatttgcaggttggtcacaaactgggtatcagacatattaagcctgcattcatctgacaggcctccagaacgtgatgtcaggagagacgtttagcagtggggagacaattatgagactctcagaggtgagaaagaggattctgctcactgcctagaaagagagaatatggcattggaaagggggtggtaaaatatgttgcctgacacacaccgaaaaggcctgtcagttactgaggtcccatcgccgtctcaggcttagactgcatgagaggatctatttaggggaaaaaatgtatagcttagccccagtggctgctggggtgaatctccagggctcaaagcacgagttacagtttgtctttagtttacttaataagcttcctggactgtctgatttctttacagcctggaacagagggtaacaagtctcccagtgcagtggatccaaagttggtgggcttcagtttgggagcaaagagctcactgtttgggactgggttgatgtcatcattttatgacagcatattaacacagagtaaatagtttattccccagggtactcacccattccctcagaggtgagtgtcaactccttcgagagaggtctgctcacctaacctgccaattctcaaagagccccacctcaggcattctcatagcctttctctggccttcgtaggtctttgtcccattccccgatgataatgccttcatgacaaagatgaaatgaaggttgggggcagcctaggctgtagtcctggtgctgcaccactagccgtagagccttggccaagtcatgcccctctctgattttttcattatgtcaactggaaaatatagtcagactgcctgccctgcttgcctaacagcacagtctgaagcatgagctgatggaatacatgtgtaagcatattgcatagtttgaggaagtattcatgtatacagtggtgatattagacttaagattttcattttttcatgaaattgaaactagaccatctgaagtcattgaaataggaaaaacacatacagtattttaaattagttctactcatgcagacaaaaaaaaagtgtcctggtacatcgttgtttaagatctggtgatctgtagtgtttgtctaccaagtggctaccgtaagtggcctccacttgataagttgtaacaagatcacagcaaccccaacatctctgccactttctctttctctcttctgttttgggtggagagacatctatattgtggctgtctcagagttacggggagagcaagtcaacggtaacagggaaaaacaagccttgtgtgggttggaccagaccatttgtaaggctcttggggcatttgtgtgcacgcacacacagacgttaaccagtccagaaatgagtgtcattctcctcacacagcgccgacagctgagttcttccctgatatttgcagacctctctgaagcttgactttgaaatcctcttttccttgaaccctacgtgtgagagagaagcccttctttgccactcaagagtggttctgtggtaacagtggctctgtggatcttttgtccctggctggctccttcatatgttattgtaaggttttagtttgtgctggcatgcaggtgtgtttttttctcactcagattttctcttagatgctgtaatacaatctataatttttggtacaggagcaagtttttacaaaggaagatatgtgcaatttgtcattttccagcctgatgacatataattaaaccttcaatagtctatgccttcaatagcataactacaacaacccatcacactttggaaataaatttgtttcatattttatattatctggactctctttgtccagtgtgtaacaggcccccaggaaacaggaagtcccccactagtgagcacccctaatgtgaatgactgcacactcagcctattttggtgagaacaggcagcttgctttcggtgggctcttttgaatgggccttgcccaagctcaatgctctctctctcctcttggcttgtggcacctggccacagtagcaggcattgcctgcttgaaaagaggctgtccttggattttcctgcctcttggaacacagagcttaattcagttccctaactccgggaagaagcaatgatcttcagccctatgaacctgtccggcaacccacagcggcccacaaaatatgttctctcgcctacaacctcatcccagctgctaccacagccctgccgacgcagcgcctgctgcggtcacggtccactcccaagggacactgccttatgtcagcaggccctgtcttgattcccaggtgctgggaagacatgattgcagcctcctgcacccctgctcccctcctctgacacacacactctgagcctgcaaggtacagcagcccactaaagctctagttaaaagtaccaagttgctggaatgcccagggaagtgagaatgagcgggtctcacacagggatgatttgaaacaagccttgtggctttttaataatgtgccaaagcggtctcagtggtgggccagcagggcccccagtctatcttctgtgaaaggagaaagcccagcaggccctgccgaatgcagacagcccctccactctgctggaggagacagactccgagatggcaatcaaggcttgatttgccaacacatttccaatgattaaaatgtaattagcacaactgagtgcctcctccccagctaattttaatacatgctgtgacaggcaggcagccggctgtgcctttagcccagcagcagatggaggcagaggcagcgggagaggaaaaccattttgcaatgtgactattcgcatcacaaaaccatcagggcgctcagctcttagaaggcccttgatggcagcacatcaaattggcgctgtcatagctgaccgtggcaatggcagtcatccttcatactgtcccagaagcacagcgaggcaatttccaggcgtaaccctttaagatctagaaggggagagagagacttggagagcacacttgtcgtcttgcagtgacaggcgagagctttgcaatgtgcgctgtgaaacccacgctcttggcagcttgcaaaccgttacttacatgttccttttccaaggcacagtggagtgtggttcagaagctttggaaatagctgtttctccaaatgggagacaggcgtgagctgccttctgtgtgcattatctgaactgggaaggatgagcttttcagcctgagatggtatggcaggttggaggtttcctcttctattccattcatcccatagaagcctttgagcctggggcctctcatcatgaccatctgcttttctcctatcctgaagggcatgtcagacaagctgcaaagtccagaagaccgtttgcctatgctcctgttctctcacctcctggcagaaacactgggccctcaccactgttgtttggcctgccctctccttccaaggcaccacctgaaaaggaggcaagctccttggaggctaaggatcatttggacctccctgggattggggtgcacaggataatcacagggggcacttgtgatctttgggatctgtcacccaggcttggtggctaactttctgtgtgtgtgtgtgtgtgtgtgtgtgtgtgtgtgtgtctgtgtgtgtagacggggtcttaccatgttgccccagctgatcttgaactccagggcttaagggatcctcccacctcggcctctcaaagtgctgggattacaggcatgagccactatgcatggcctggtggctgactgtcatagaacaccaaagctagacaagcctaaataataacagtgacgatgctaagcatgtattgggcatttaccatggctgagaactatgttaaatctcttaaatgcattaattttctcacttcatacccacacaaacctaggggctccatattattattcccattttacggatgaggaagcaaagtcacagtaaggtgcagccactttcccagcttctgctgttaagtggcagaacccaaatccaaatacgtatctttctaacttgtgagtgggacaaaaaagtcatagctgagacatgctgcaccacagagatgcttcaccagtggaagcctctgagcagagaaatccgatctgaaaacaatgggattattctttgccatctaatggcctctgaagatcagcagccatgggaacctccagaactccatcacacgggtgacgtttacatgccgttgtgcatgtgtatctttttctcctctaaccgaaaaataatatgtaatcgttaaagatcaaaaacgacagtaaatgtaaagatgaaaataaaagtgacccaaactctttatcactcagaaataaacagtgtttggtgcatttttttccagtgttttttttttctttctgtgtgtatgcttagcaattttaaagtaatattgtatatataactctatgtatcttgtttccttcattgtagtagtaataataaaagtagcagtttttaatgtattttctccttactgctaccttgagaggtagttactatcacccccgttttattgattaaaaaaagaaattgaacctgtgggagggtatgtgactcacccaaggtcacttcagttaggttggtgaaaagtaattccagtttttgccattacttttgcaccaacctaatatgattttttttaaacttccctatgactgtgatcacttttccatttcagcaaaattctttatgaactttaatttaatgagtgaacacaaccctggcaccttgacctgttccccaatttggtaacatttaggtttatgaagtctgtgtactaggttagtgcagagagttagaaacaccaggattcaaatgcctggatcttcctcttatagatttatgactcttgacaagttgcttcatgtctttaagactccttctttcactgtaaaattggaaaactaaaacctacacactgggggctggggggtggggggagtttgctgtaaggttaaaaacgtgaatatatgaagagtctatcttagcagatttcgtggcccttgctatgtgctgacagtagccatataaataatgtattattgggtcatttcctaattccataatgaaatttttaaacaaattattatagacatttttgttcctttttgagactagttgagctagacagtatggaaaatatgaaggctcttgatgcatgcttctcttcttctgatgcaaattgcaaaattattttccaaatagaaattgacattcctccagaagtatatgagtgtctgcctcacgacagccttgccaacactgcatatcagcatttacatgtttttttctaatttgattgatgaagagaaatatatctctttttaatctgcatttctttgattactagtgaggtggaacatttttttcgtatgtttattagccatttatatttcctcttccgtgaattgacctctttgcttttgaaaggaaggatgagtctccaagggctagctagagaaaagatgctccagtgataattatctcagagccctggggtgaggagttgcaggggagagaattaaaggtctcctggggctatgaggcggctactaagtgagcggctttctacaccagagcgaggctttctacacagtcagcttgaaatcagtatttgttctctacctttgtatttgttctgttaagaaatattttggattttttagtgggactcttcacattctactcaagccagcgcttataattctttcagggcagacaacgagcatgcctgttcagtttgggttttttgctctgaaagtcccattggtttacagtgaagttgctgtaggtcttgcttgagtcttttatgatccctgccatccagccaggagctgtgactgctctgtaaccttcttagatttaaatctgttgcttgtgttctcctcatagtgttacagagcagcagaggccatccatactgatgtcttaatatcattctctccttagatttatagggtaaaataaaccctctgccatagaagtgcttattgattactgaagtacataataaagcctaagaataaagtaagaccaagtaatcggttctgttcctgggggatgacaataaactctggccgaggcagcctctgaaggttgccttttgccttggagctaggaggctcctttttaattggttgtcaaaatagtaagcagtgactgatagaaatcagacaaaaagagtacatactgtatggttccatttatgtaaaatttttaaaaatacctactaatctgtagtgacagaaggcacatcagtgatacggtaagggacctgagagagggatagaagctttggggagggatggacaggttcactgtcttgatcgtggtgatggcttcacaggtgtgtacacatatatgaaaagctatcaaattgtgcatttcaaatacgtgccttttaccaatgtcagttatatctcaataaagccacaaaaaaatagtgaacagtatcccataaagagacaatccatggctcactctgtgctagaaaaattttctcttttcttagaaagctatattttgacaaacattcagggggaattgtgagactacatttcaccttcacctttagctaaataggggttttagaagactgaaagatgccaccggaaattaaaaaagaaaaaggcataagaaggtaggatagccctctttcttcattcctttttctttcctacatctgaaccttaaaggtgccttttaacataattttttagtaaaacaaaaaaaggtatttagaaaatattaattcttttctctcatcccccccaacccttctgctattacatttcccccacccagaaaagagattctacagtgcagagtaaaaactactccaaaatgttggcagtctaaaagtggacaggcattttcaacacaaagagatgtttgttttccttgcattttaactcttaatttttgacacagtagggaactccagcatggctgccatttaaaatgtaacaatgccatgcagctctgattgcctctgtcacaggggtgttgtgactgaaggccaggagacaaagcaaatgaggccagagacagtgcctgctgctgaagtgctggtccatttctccacccgcatttgaatttgtcttttctctggctaactgcttttctgccctgatgaggagtcactcggggagactgaagctggaatttgtacaacctctttcagtccccttgattttaatcagaaatacacaattattcttttcctccaaatagagaaactcaatccccattttaaattcaattattgtaattgcagcattcagaaaaatagcacattcattttctaataagagattgtggataccaaattactgcatatagtatgtcaaaacaggaaacttgagactggcaaaccagtgggtgtttttatcttggcaatttgtattttcttgcagacaatttatagtaatcctacccttccttgtttatgatatagaagactaggttttaaagccatcctaaaataaagactgtttttgttgggtacagtttaattgaaaatctgttatgagtatgaggaattctacaaagggcaaaagtgaaggcagatacccaataaagggaagaaaaaaaaggaatcactttaggatcctatgtgacggtagcctaagatgtctttggatcttcttgaaccattctcattatctcaagccatatttatattcctttagccaagtttctcactatcttgcatttgtaaaaaaacaaaaaaagaaatctggttggtgagaagttgataatgtggccattatgtcttagcaatatgagagcaccattgtccctcttcctgctcaattccagttgctctagttggcttgaagtgaatcaaatgtgaaaagaaatacagtttttttattttgagtttcctgattttcataaaagagtaaccttaagatgtgatttcttcaagtgcatgctgttattttcttaggatttactgtcacctcaaaattatatccatgtcagccaggcatagtggctcatgcctgtaatcccagcactttgggaggctgaggtgggtggatcacctgaggtcaggcgtttgagaccagcctggccaacctggtgaaaccctgtctgtactaaaaacacaaaacattagccaggcatggtggcgcatacctatagtcccacttatgggaagctgaggcaggtgaatcgcttgaacccaggaggcggaagttgcagtgagccaagatcgcgccactgtgctccagcctgggcaacagagtgagactctgtctcaagaaaaaaaaaattatacccatctttttcatagacacattcagacacctaccacactttcagatcttttagtgttcatgccgccaaccactgtctctctcttgatctcttcactcagacactctccatgctaccttccctcaggtattttgctactgtaatttattaattctttcacatatatgtattgagcaccttctaggtaccagcttcaagtggagcaagatatgagcaaactctgagatactgtcaaggaaactagccaacagtgttggaggtgctagaaaccaacagttaaggtacagccagtgaagtcagagccctggaaagcttccatatggaagaaggaacagtcatttccatgtgtcctgaaagggtggtggtctgttggatccttgagtgcctactaagtgccaggtactttagttatattctctcagcaaatccccatttttgcagttacctctgggaatttttatctctgtcaagattactctcctggttgattttggtaaatcagtccttaaatcaatcttgaatataaataatctgtgagtagggctatcaaaactatctcctaattctgactggtcagaatcgctagacaaagtttaaaatatgtagcttcctacttgtaccagtaatcacctagtgtttttaatatccattctatttatctgtgtatttatttttccaacttaactttgaacattttaataatgtcaaagcccatatgcactatgcatagcataacttacaaatttaaactccaaatcttgtacctatgcattttactttagtccctgtgtgcaggttactgactatttgaagaataagtccaagctacttccatcccaaaaaaaaatgttcatcaagaacctaaagaaacacttcaaaatttcagctctaaggtgtctttcctttttggttttttatcagtgaaataaaactattagttacctggaagattcttcttgttgctcacttcgttgagagggaatgatggtttctggttttgtttgtctgggtggttgtttctgttttcgtgtagcatagtattgagtctttaaacacgtcctgagcagaaatccttgcagaatgtgacttcccctctggcaataaaacggtacaaaaattcaacccaacatttaaataattagtaagttaccctgttgttgtgtgtgatataacatatctttcatggaaataactggaaaaatgaaactattggtatgtctttctggctgctttcacatacctgaactgatttaattctcacaaaaatccggtggggtgtgtatcatcgccattcactggttaagaaaggtagactccaagaattaagttcctttccaaacacagcatgattattaagtggagggggtcagaatttgaacctacgtcagcctcagactgaatgagcacttcctgtgagccagggactgtgctcagtccctcttaagggagagctgtcttctgtggagcagaaatacggctatatggctgcattcactgctgcttgtaggcgctgcaatctcttttcggtttcagcttgcctctgtactttgccaagcaatcaatcaggaaaatattttgaagtagtttctttgtatagcctgagagagagagtgagatggtacgttatactggctaagaacatgaactttgaaggacataactgggttcaagtgccatctctgtcactggaagccttacttaccttctcatctctaaaatggaagggtggtagtataatactttcttctagagctgttgtcaggattcttggtgttttttgtttgtttgtttgtttctttgtttgtttgttttggacagggtctctctctgtcacccaggctagagcacaatgacatgatcagagctaactgcagccttgaccttccgggctcaagcaatcctctcacatcagcctcccaggtagctgggaccacaggcatgcatgaccatacctgctaattttaaaattttttgcagggacaggggtctcgctatgttgcccaggctggtcttgaacttctgggctcaagagatcatcccgcctcagtcttccaaagttctgggattaaaggcatgaggcattgcacctggcctcaggattcttttttgatgaatgccagccaacagctggcatttctagaggaaaacatgctctgccgttgttcctgtggaggaaccctgcaagatgtgaaatgcacttcaacaaccaggcttttccaaaatagagagctcagggctgccctgccatcatggacaccccatctctcctttagcttgagatggacattgaccctttggctgggaattgaatcatgttggtgatacttagcatggaaagccgtagctacattcagtgtctcacaaccttagtggtggaaggaagaatggttgcagcagcttcattacctggggaaaaagaacttggaattccaagcactttaagaaagatgcttttactttgagtgttggagaaaatagagcaattacctattgaagacaaagtggatgaaaaaacacctctgttcatgctaccctgatcatgtaatctattcatattcattctgccttcctgaaggtgattcaagccagactggctgttcctgctggctgtgcctttccttccccaggatacacagggcacatggtgatcacctgagattcccagctaaactcagacattttctactccaagaggagattcctcaaagggctatagcacacaggcagcatcagataatgtggaatgagtggaaggagggagggaggaggaatccataaatcatcaaattgttgttgagcatctttgagggtcctcaagaatacactagaccctgtgatgattccagggacaaccagcctgcactttctgaggagttcactgcctgcctggggagcaagacttgtatatgttaaattagcaaagaatttatgcaagacgtatgtgaaatcagtgaagaattctattctatctagactagagccagggagatttccaacacctggctcatgtatgctttttaaaaaaagatattcagtcttactgaagatgaatagatggatggatggatggtttctaacatctattgattgcttcctatgtatcaggcagtgttctagacatttttatgtttattacatatgtacttatacaaattatatgtttattaactcaattaacgttcttagcaacactatgaggtacatactgtcaatagccccatttaatagatgaggaaactgaagcacagagaggttaagttccttgctagaggtttcacagatggtgtacagtacaggcaggctttgcacccaggcagtctggctccatagttatatatgaaggataacgatgtggtcttttcaagagctgttggcatcttggttcacactgaaagctaccaggctttgttatctgttcctctggctttggcttcctgagtcttaagcacccttctcttttctagaacatagaccagcttgaaccaaccctctgtgattccaccccgcctctcccctggctgcaccaggcctctcatttgtagtttctcttactgagcacatttctaaacgaggacggttgctccactttaaggacatacaaatggcttgccctcacctgtcaagcatgatccttgtattttaccaggcccattatgaacgcaatctttctgttgaaaatttgcatacctcctttcttgaaaagtaatgacagcaatttctttccctccgctcactttctgagtgtctcatttaacggcacctgtgaaaccgacaggcacagagatgagaagtgaaagagagcagttgattaaatcatcatcaagtcgggcctcagaaagtcaattctgcttgccgtctgcaatgatatccttttatcttaaagtaatgagctatggcacttttgcatcgggtaatgcgataagttctattagcatgttccatttgcctcacaagcaagggcaagtcattttagctagctcatatcactgcaatcaaagcaattggcttcccaggcagagaagaaagggaaaaggctcagggtgatttctatggatcacaacacagcggaaaaaatagactcttgtattattttaacccataacatacttttcctttttactcatcagcaaatttgggttttattagcttacacaggactccaaaaagaacccagcatcagttgaagcaaacctgggggtgggggctcagaccccacccaaagcaccaagaaactatatatgggaagggaaaatcgccccattacagaggggtcacaaatagaattctgccaaagcacacaggcaaagatgtcttcctgatagtaacactgtggtctcataataaactcttgcttcacaccatcttcaaagtcatttgtaataggtccccaggcaagtacggattaatgctattgatgacttagaatcagtaaatcaatgacagagaagcaaaggatctgttccttaagcttaaaagagatcatttacaaatcaccgggccccagactgtcagttttacctttggacaagatacttatttttctgagtttggcaaccactgaggtttgtggactctgggttttaagtaaatttcatctttggggtttatgtatatttatacttggcaaaatgtgacttcctttcttagaggaaaacaagctgaactccccaaagatttgtgaaatattcacttccaaccccacttccaataactcaacaatactttaatgatctgtggaaatttacaacatacagattgttttatgaaatacacttggatttcaaagtgacaaaaaggaaaaaaaatattagaatttaatttatgagctttaaaacttcaagtttggacaacctgatttctgtcaatatatttgcacttctaatgggtggtagaatgaacctagcacatagtagttacctgaacattgttggttgaatgagtgtgttattatctgagacactggagggggaataagaagtgttcccttagccccctcagatcacattggttatttgagctctggccagttcaaactgagaacttgcaaaaatgtcagattctgagaactccccattcagaaatgctaggttatcagtaccgaattccagaggcttctgagagttgattctcttgtatctcctgaacaattgaagattggtggacctcatattattttcaaatgggctcattagtgattaccaaaagctttattcttgtaaactgttgtttggaacatgaatattttaattaggctttcattttatctgagctattttatttgatcaggcgtagttactgttaagatagaggggaagagtcgacgacattatttcacagtcagtaagaatatggtctcagtaagaacattttcaggtttaaaaatttaaaaatttctagggccccagtagctttaaatttcacttagtccaaaaccaatatgagagcaatgtaaacagtgtgaaattagggctttgtggattgatgaaaaacagacaacatcagagctgccatatgtggcacaaaatggcggcccatttttacatgagcaaaggattgggcagctgggcaggggatggtgaacgtgtttttagtcaccatgctgctatcttacttctttaaataagaaaataagtgtcatgttttctgcaggtggcttcttctgaaattgcttttaggtgagggatgtctttaaggtcttagataaaccgcctgccccaaaggagaatcgatttgttttgtcactggcaaagttaaattatacttgatgttagatattgtagtttacaagttggggttctccctcattttcctctcatttcctttaggcagaaacaagaataaaataactttgttcagcagtggtattcagccctgacatctttggtggcaatgataaatggatttgagatacgaaataactgttccagcaaggtccattgagcagaatagagagcaatgccctcctcaatgtcattgtatgtgatatattcaatgattgccactctgtgcttaagaatgcattccatcacaaggtacctagaattccatcttgttgctacattctgaatgaaacagagagatgtcacagaccttgactgatttcaatttggaccagagtcttaaaacacagataccgagattcccaaatgaaaatgaaaaatatttgcttttgaataaatataataaagtcataatcacatcttttttctgagccttttaatggaagatattttcttctgggccccaactctaggctctgctaacgattttaacctccctcagtatgttcacacatacatctctttgcgttaagcagtcatattagtgtttcttgtactttctctttggaatcacctgccttttaaatcatactttgcttatgctgcatggaatcaaccacagtttgaacaatactcaagaagaatgagattgacttgtcagtataattgagcatctattgtgtcccaaggcctagagatacaaagataagcaaggcactgtccttacctacatggagctcattctctggttggaaagactgttgtggcaaacaacggcagtacagttttgtaagggatggagatagaagcaattaagtctttctggaaaagtattggaagattcaaaaaaggaactgtgttttgaaggtgaatgtcaggcttttaggtagaaacttggaggaatagaattcccagtagagggaattgttaagtgcagatggctggtggcatgactgagcgtgagtgggcgtggttgaagcaaggtatgttaggatagtgccacacaatgcgaggatgccaaccagggccggaccacaagctgtttgcaaccaacctgctgtgagattagtatggggagtcaagagtaagcattgggaaacttttagagtaactcagtagcataattttgtgtttcataaatctaataattttttaaatgtattatatatatttgtttttctttttcatttttcaagaatttgactttttattatattttacaaaagtaattgtcgtaacatattagaaattaaagaaagcaaaacaaaaacaaatggctcttcaccacagaaagcttaagaagcattgtgttgagagagtggttgggatttgggagttgagggggattagaaacagaatgtgaagggtcttcataggccttgtgaagcatctgcatcaaatagaaatttaggaaatccactcttgtcaataaggacttggattagaaaaggaagagagcatagaccttggaaagcagtcattatcctcttgtaatgacaaaataaaaccctgaactaacgcagtagccatggccacagggatggagagttagaaagcagaatcaataacgtggggtgagagaggaagataagtccgctcaaggatggggtcaaggataaggctcttcacttacgcagttgagtgattgcttggtgatgctattaccaagggcaacgtgggagaggggcagtttcaggtgagcaaagatgttgagtccagatttagatggatacttgagtctgagtgttcgctgcacttcaacagggggcacatacccaacggaagcttaataatacttaacatttatcatctgtacatacttggtaccatgcactaagttgtttacatgtattaactcattctcctcttctagccatattttacagagaaatatactaaggcccagagagtttaaataacttttccaaagttacacagctggcaaatgtgggcatagagatttttgagtttcagcatatacatggtagaaaggaccaagggaatctttaaggtctcccttgaaagtcacatagaaacaatagaactccagatgcaactctggggagacagtgacattaaagaatatgcagaaaaggaagggccttgaaaagacagtcgcagacagcaatattggtgaatgggtgcaaagggaaaaattctaaaggatgtgcaattgaaacaatctaaataaccagcactggggaattttttaattagattatgttacaatccacatagcagattgcagtgtcgcctttttttttttttttttttttttttgagacggagtctcgctctgtcgcccaggctggagtgcagtggcgggatctcggctcactgcaagctccgcctcccgggttcgcgccattctcctgcctcagcctcccaagtagctgggactacaggcgcccgccagcacgcccagctaattttttttgtatttttagtagagacggggtttcaccgttttagccgggatggtctcgatctcctgacctcgtgatccgcccgcctcggcctcccaaagtgctggtattacaggcgtgagccaccgcgcccggccgtgtcgccattttttaaagtgatgttacaggataaattttactgattaaactgaaatatttgacgtgttatgtgaaaatcaaagcaggttccaaaatggtaggaattcatttttatttcttaaaatgtatgtttaaaagacgagtgggattatatccttaagactggaaagacttacaaaaatgtattaacagtgtttacctaaggattgtagatttatgggtaatttttaaaatgtatccagtaaatatgttttttttgtttgtttgtttgtttttgagacgaagtctcgctctgttgcccagggtggagtgatctcagctcactacaacctccgtctccctggctcaagcgattctcctgactcagcctcctgagtatctgggattacaggcgcgtgccaccacgcccggctaatttttgcatttttagtagagatggcgtttcaccatgttggtcaggctggtctcaaactcctgacctcatgatccacccgccttcagcctcccaaagtgctgggattacaggcgtgagccccgtcacccggccgtaaatttgtattttcaaaaggagaaagattgggtgggttggtttgttgtttaaggggtaagacttgtctgggaaaggaagactgtgcctccagcagttcacttttaattcatgaaaccaggggaagagacggtgaagatggaagttgagtggtttcagtattgagatggctggaaggactcaggtttaggaactagtccctttctaactgtgcatttgaggcctttggccaggcgtgcacacgtcctctttctctccttttgtgtgtgatggtttgggtcatgtctttgtctgaaggccgggtgaccatgaattcttatctgtgattgctgtaaggcctagttgtttctttttgtctcttttcatttcttgcttttaaaatggaggatatatttttagcttttcacagcgggctctgaaatcttgtcatggagagtacttcgtcacctcaagctggtagttagtgtgcaacctgtttgctaataaaccaaagcaggaccccgatgtcaaaatgcttaaaatggtcaaatccgctgggacgccgtctctgcatctgacatgccttttccatttcccagcctcatgcagaacataaacctgcatcaggaggtggctcaatgtgaactcttataaattggagtgggtatctagggattgaggagcagacacttcttcttttaacctttgaagaccaagaatcacttggccaaaaaaatccacagtgtattgaacttagggtgtgaaagctatacagtgtattaaatgtgaatttgagaccatgaattctacccacactgactctataaaacagcctccctttttcataaagcaggcccataaaccgctgccagtgaagcagaaagactccttaggactgtggctcgctttccgtctggggttgtcaacaaaccccctttatgagtggaatagacctcttgtatgtgtcgagcttctggctttttacagagtgtgttaggagccaggcaaggcaaacgttaggcgctgtttgctgagtgcatttattggctttgcataatttatgagctggaggggttgaccatcattcgtctctgccaggggctggcactcgaggctccagagagtggagctgtaaattggatggtgcgctcctgctgagctcacggcaaagtcctcaggtcagtatgggaatttaataccagaaatggaactgttttctcagcacaccatgtggaccccagtgcagcagagactgttttggcagactccacgactggccttgtcgaggagctgtcactcacccggcatgttgtgtggggagcctgagcatttttaatcggcttggcatccgtgctgcttccataatggataccagtaggtctcagttcttcaccatatgcttaactctggagacaaggtgcttctgggtatatcagtaattacttgatgcagaattaagtggaccttgaaattagaactggactgttggaaagcaggaagcttaacactttgatagaaataaccattcccagggacatactgccgttaggatagggggcacagtggtggttctttcccagctaccccactcctcgtcctccctgcacaccagatccttggggaggtgggcaaatgcgatgccacagccttcagctgtcattgattacctcacaaggagcgctgtgaacatctgggaacatgagcctgcctggcaaaatagtcttctgccttccacacccctcttgaattgagcgttgtcactcttgaaaatgtgcccagatcttaggaacctcacagagggcttaattaaaggcaatggagagatcacacaatcaggacagtattgttcctcatccacctgcggttctaggccttcaaagtcttcatctcatccaatttctttctcaactcatttgacttattacaataaagaaaccactcatcaggtcaaagaatgtaaatgtagacaatctgaggttggaagctgggttggaaatgatgcaccgtacttggttaaatcgctgtcactgaatatctgactaccctgtggcactgaggagccaatgggagaagtagaaaatgttctaatcctccagtctataagactgtgatataagttcctaaatgcttttactacggagtgcttagtctgaaaagaataagtagtccccaggttgtctcataatagcaagaagtccatttagatgggtgttctgttacttcccattaaaagctctctaataggagcttaaacaataaggtaacttagtgttttctgaataaaagtcctgaggcaggctgccctgagatgggttcagtggtccaattctgtcaggcattttttcccttggtcccactctgttgtttttgtactgagtctttttgcctcatttttgcaagatggctgctacgtatctggacatcacgttcttatacactcatgttcaaaggccaaaggcaggtggttccttcttttctttgtttactggggagacaaaattgtttctagagccctcagcagatttcagaatctcattggccaaagatgggccttcaaataagcgattacaatgcccagaggtttacctcttttcccatctttagcctcaagaaaaattgagaaagaaaatacctggcatttttaacctcaaagtgtcaggagaaggtacagactagggagaagggagttgtgaatggctgtggggatctagccagcagtggctgccctacaagcaaatttatttcctgtttctgttcaaagctataccaactcccatgtccaggtggccacactaaaaaaccttggcatcatcctagacacatccctgttacttgcttcccatatccatgtgttatcaaatcctgttggttctaccttcagaattgctgtgccatctgcttctgccttcctaaaccatggcaccaccttgggttagacagtggaatggctgccaaaccactctccctgtgacctgatttttccccactgtgcactctctccacgttcccacagaaagtcatcctcatggaagcagctctgatcatgccacacccctgctagtgtttgtatcccagcttcatgtcttactgctaaacggaaggctcctttagagccaggcctgtatctcaggtgaatttcagtctagtttagcagttccttatcaagggctgttgactgaatgaatagatatatttacctgctgagctttactctaacaaaacacatcccccagtttttcattgaatattgaattaacaaaacacttcattttttttaagttgtgttcttttttcccttgcttatcatgaggatcccaaagactggggttaattattaattatcactctctgcttatcccaaaccaaactcagtggttggaatttgggatctgtttgatatggtctgagtctatggccctaaagcatacttttttgcccatattttttatttactaccctgacctcttgtctttggcatactttttatagggaatgttccttctattctctgggcctctaaaccggaaaaggcagccatcacaagtggtgagccttggccattatgttctgtttccttcaaagttcaaatgagtgactacaacgcccagaggtttacctcttttcctgtagaaaagcaccggtagagatacagccattcacattagctgaagatagaatgtcttcgttaagaaattgattttgctctgaatttcattgaacaatcttgattcaccttaatcctgtggctgactcctagaggggcatcgcctctaccctgccatggtgggagggaagcgctcacttgtgtgattgagcaccttgctggactgacctgaggaagagccacagagtacaggcatcagatgaaatcaacaaaataacttttttgcatctggatagcattttgtttcagatgctgtttactagcacttgaactggagaaactctttctttccaggaagacagcattttttatttcctttacttatcttgcactttttttgtatgggggttgggggaggaggcatcaaaagcaaaaacatactcagttcttgcactaacccttattctcttgtcttcattttcagtgtgacagtgacagtgaccaggaagagaaggtaagaccccccctcccccattgtgggcacagcacataacacactgaacaccagagtcctcccacacacagctgcagggtaggatgccagcttcatgttgacaggaccttttctctttaggaaagatgggcattattcacacagtgacatttcctatgctatgacacgtttaatttgtcagatctacctttttttcatttaaacaagacctttaatattgcatatatgtgacactgagtttttactttatggaagatgactcatagactcaaaaacattttaaaagacaaaattatttattttaataaccatctgatttttaaaaatccatgatgagaacgttaaacttgctagtttgtgtttataatgtcatttctgcatttattttactgacccatatgcttttctgtacctattggccttcttgatagaaatgttaatggtctgtgtctaggaatctcatcatggggtacgggtgggcaagggaggtcagatgggaactgccctcttcccatccgggcggaccgccaggtaggaggacagttcttccagcaggtacatgctctgtttcgaggctcatgggcaccagcctctgtgtatccagatcaacatggatcaagaaaaggaactcagtttctgaggttccagaagattggatcacaactcggtaaagtgagctttctgctgcctgaagcaaagggattatttgtctgtttggtctttctttctagccgttccaatccccaaccaaagttccttccatttttactgctgctttatgttattttgaaaagagttacctgaatatcacggtttctgtattgcttggtatcaaaaggatggactcggcctcccttcccccgtttctggatctgtcctgtgccctgtgctttgactttcacctcctacatgcttgcggattttattcagaatgctgcagttagtatttagtgggatctttccaacaaacccagaatttttctctccttctctgctgccagcctccaagagagatctaaaggctcttgttctgtactgtcgttaatttgaattcagcatatgtagcctgttataaaatgcgagacatcatcatttgagcaggtcaagcatattcagatgaagacaaatggtgcttatttgatttccttaaaatcaggaaatgaaaaaaatgctctctggagaaatcatgttctgcctgacttggatgatagaccaatgcatgtcccccagataagaacaggctctcgccttgaggtttttatctctgaaggacggccaggactgtcagcttgctgacatgtgcattatccatgtcattttaaacaaagtgacctatggaagggtacgctgtgctgtgacatggtaatgggctgttggatgacagtgaaagtacacactggaaagggggctgtggattattcttttgtttaactgacaagtaggagctgcctttctccagcccccaggagccttagctccttggaagtaggactcctggtgtctcaggcagccagtgtgtagtgggtgccagggacatgtgcacagcagtaatggttagtgttcaagacacggtcattggcccccaaacccccgaggccacattcccacatggtgggcatcactggtacccagggagggactggtaccttctggccattccagatctatcagcaatggttgatctcactttctaagtctgtgccacttttccaaaaggataaatcttattcagggtcgtacaaccaagctgacattctttccttaaaaggaaatgtggggccaggcgcagtggctcacgcttgtgatcccagcactttgggaggccgaggtgggtggatcacgaggtcaggagattgagaccatcctggctaacactgtgaaaccccgtctcaactaaaaatacaaaaaattagctgggcattgtggcgggcgcctgtagttccagctactcgggaggctgaggcaggagaatagcttgaacctgggaggcggaggttgcagtgagcagagatcgcaccactgtactccagcctgggtgacagagtgagattccatcaaaaaaaaaaaaaaaaaaaaggaaatgtgaattccaaaaccatcaccagtcttcagcagtggtagaaggtggtaaggatgcccggttttgtgttccttgtaaatgtcttcaccagtggcctcaaccttgacacccaaatcacctagggagctgctacaagttccagtgcctgggcctcatcccaggtcaatgaccttggagcctttggggctgtcttgaaccatgggtcttgatgatcacctaactctggtaatttctaggagtaatctgcctctggttgtcagagggatctgggggccaatactgagagcaccccaccaggtcctttcccatcacctgaattcctgagtagttattgcctgggtttccatctctaagtgcaagaagtaaagtgtcggaataatgggtattgggaaggtagctcccacctaccactctgagcttgagtagatttcagggtaataaagcggatacatagttgtttataggcgagtccaagagtggcaatggcaagaagggaaggggtattaggagtgttcctcagattcatggcgcacctcctgccctgcacccccagccattcttcctttctactgtggtgatcctgcaggtcttaagtgggagccacaccataaccagtgttgacatcatctgcctctgttctgccccatgccatttctccagggggctcccaacaggagccattgagactctaattgccctcgcacctgcttggccctgttgcagttaagactgttaggcttccccttttggactgagattgtctggtgtttatcgccaactttaacaccatcctccaagacttctgctctgtcggagcctgggtccctgtcagcctcctctgtgaagaaacctcttgcctgtgcccccctcgaagccccagagctaaccagggctgctttcatgtgttgcttggaggattcgcattcgaatctgaattgctaatggtggaaaagatgccactcagtgtcctgggataccttcagcaagccccaccagggatgctgttggaggcaaaagtgaaacttgtcagggacccactgggatttctctctggaagacctgccattctcttactccatagggatctgcagaaccggcaggctaaaattagggtactgtgtttcacacagctgactgaattaagataaactctgctttcctctgatatgaagctgtaatttataaaatgatacccttactaattaacgtggaagtgactccgaaaggggctaaaaaagcagagctttccctaaatgcaggagacacacttgtgcacaaaaaggctttgatgagacactgagcaaagtatctcccttatcctcccctcccagccacgtgaatacattgcacattaatgtcagataaccacaaggacgttcatgaagagtagaaattgggctgggtgcggtggctgatgcctgtaatcccaacactttgggaggccaaggcggggagatgacaagatcaggagttggagaccagcctgaccaacatagtgaaaccccgtctctactaaaaatacaaaaaattagccgggcgtggtagcacgtgcctgtagtcgcagctactcgggaggctgaggcaggggaattgcttgaacccgggaggcggaagttgcagtgagccgagatcgcaccattgcactccagcctgggcgacagggcgagactccatctcaaaaaaaaaaaaaaaaaaaaaaagatagaaattgggtggggaattacagaaggctgtgaacactgcatcttagatgtgggattgttcttcactgtagtgagagctaagaaaagaggcagcacttggcacccttaatcacccaaattaagcaattattctgatcccccattcgaaatgaattggtatcatgagaacaaagaggcaacatgcaattgccaaatatttggcctatattttattgtttcctttctttctccagtactggcagcagcccatgatgctaagaaatatcccgtttggttatgaagttaatgtggagattaaaagtcattccctgttctacccacaccctttttcttgtgtatagcatgtgactgagctgattggaaggcatatagcccagtggccaagcacttgggcctcagtgtgatggctgacacatgtttctgactctgtccatttctattttgttgtggacaagccttggctttctcagctgtcaaatgggggtgacaacagctctacatatagtcctgtagcaattaaatgaaagcatttagggccaggcatggtggcttatggcggtaatcccagcacttagggaggccaaggcaggacaaagtgggctcttgtctttgagccctagagtttgagaccagcctgggcaacatagtgaggccctgtctctaaaaaaaaaaaaaaaaaaaaaaatcttaaaacttaaccaggcatggtggcatgtgcctatagtcccagctagtcaggaggctgaggcaggatgattgcttgagcctaggagtttcaagactgcagtgagctaagatcatgccactacactgcactccagcctgagtgacagagtgagaccctgtctctaaaaaaataaaaatatatgaaggcatctggctcagtgcctggtccatagtaactgctcaataaatgttagcttttgttcattttacttgagataaaatgagagaggacgcttgaaaaaagaggaagactagcatcctctttggaaagctggggttcttctagagaacctgctagagggtttccccagaatctgaggctcagcctttatcccaagggcccttctcctggacacaggctgaatggaagtgttaaattttgaagggttctgaaacagtgtctttttaaaccccttatccaaacatcaggccttcctctgagcagaacctggagccaagagcacgtgtactgtcctggagggatcaaatggtgattaagtgaattgtatagctcttgtcccttcagcaactgttcccaaatgccaaacactgtcggttcccagaaacccatcacaggagagatgttctggggtagggccagagcatctgtattttttaaaaagcttcctaggtaattttggtacacaactggttttgagaactactgccttatagtaaatgtcaaagggaaacatgatttttccccgtgtttaatgctcttgaaattttgactgcttaggagaaaaacttgaaagttgtggagatgttgcctgtgtgtgcagacatgtgccacccatgcttatgtctgtagataccgggcataagtatacatgcagtacacacatacacaatctcacagaaatgaatccttctccttttcctatcaatcttttaacatgactcctgattgcagttttttctctctgtgctgttagcagtaggaacaaccacctggagaaggtgtttgtgctcctgggctttgctttggtactgtgtcctgtacccaggacagcctactggcacaatggctaactgcaaatgcagtactaccgatttttcacacctgctttccctctttccacacactttttggtgcattcccttttttgtttagagacagggtctcgctctgttgcccaggctggagtacaatggcataatcttagctcactacagcctcgaactcctggactcaagcagtcctcccacctcagcctcccaagtagctgggactacaggtgtgtaccaccatactcagataacttaaattttattctgtagagatggagtctcactatgttgcccacactggtctcaaactcttggcctcaagtgatcctcctgccttggcctcccaaagcactgatattacaggcatgagcaaccatgcctggtgttcatttttaaattcatgctaaaagttgttgtgtttgatcattttatgttcacttgtgtgggaaggggcttctaagaaaaggagcaaagaaaaccagcaaagtcttatgttcctaactcaacacaaaccacatgcctaacttggctcgtgcaggagtcagaaactgctgagatgtcaaactgaagactgggcatgtggtttgtgcttacagtggaagagtcccatcccttggttggccatgtttcacactcggtaaggtttgtgcaccctcagcaacattccagaagctcagaaggccctcattgttgcttgtggaacccccagccttagttttcaaataggatatattttggtcaggagacagtttggaggtactgtcctattttgtagctagaaaggaatatctccacctttccagatttcatagcagcaaagcagacagccatcacccagggaaagagaatggatccatgttcttgtctttatatccctaatactttgcacagtgcttgatatgaattaggtgctcagtgttttgcaaaatttgcattttctttcctggatactcatctccaaacggaggggataagtgaaccaagttcagaagactcatactcaaacctgattgcacctcatacagtcgcaatgtctacttcctggacccccaaaatgtgtgatctcttcctcaggcttctatatttcatctacagttttctcatacaatatatctaagccatttataagtttcctaacttataaatagacaatttcttatggttcttggctgagtctcaggagatttttaatttatttttgttttttgaaatggagtctcgctctgtcacccaggcagaagtgcagtggcgcagtctcggttcactgaaccctcccactccttgattcaagtgattctcctgcctcagcctcccgagtagctgggattacaggcacccaccatgcctggctaatttttgtatttttagtagagacagggtttcaccatgttggccaggctgatcttgaactcctgacctcaggtgaccggcccatattggcctcccaaagtgttgggatgacagtcatgagccaccgcacctggcctaagagctttttattttggatgcgtgatttccgtgatgcccatctactcaacctcttcttaccccttcaggattttgtctgggttaaaatgacattttattgttcttccaaaatcatcatatttccaattggcttaattacattgcatacatcccaaatacacattgatactatccttggattaaatttctatggtaaattattttaaattcagaatctcattatctttttcatatgataacattttcaggcaaaaccaaaaattacttcacttatactgaacatgtatgtacaataatctgttcattactaccatgtcatgcacctgaaaaagaagttataaatgtacagattttcaattaaatataggtaagtcaacagaataaatacttgttattggaaatatgtcaggcattttcagctaaggttttgtttcttgaaataaacagtgagaagaaagaacaggttctagatgttctattgctcgcaataggtgggtggtggagaagggcactcagaagacccaattcctgatttctcactcaccagctgtatggccttgggcaagttacctaatggtgcctagcattagttttgtcatctggaaaatgaggcagtattcaatgatccaacattgactatccagattttccaaatagctatttacctaggccccaacagcatggcagaacccagagggaaattaatatgtgattgtatcttccctttgccaatgtggaaagaggattatataagaattgtctccattctttcgtctctctcagtcttccaagagagaataaacatataggggacatactcgggtatatgtgtgtgtactctcaagcaactgaaggaaacttacatacagacctgatgtctaaacagggtccttatctgtttgttggttcagtctttcagtcatacatatccactcattttttcacaagtgtctactgatgaactgacatgagaattatagttgcttaactctgatggaactgtcaccatgtacctgtgagtaagtagcagagcagttcatttaatctgtgttcctcaactactgtaagtatttaggaaagcatggggactaggtggagagctagcttacggaatgtgtttcaagaactcacttgtttggtaatgaccattacttgatctataaaaggaattgttccagaaacatcaaggttgagtgcatgattctgtgttcccacagaaaagttcctgctgcttccccttgggtgaatgagccatcgccttgggtgtcatggcttacctgaagggaaagttgtaaagccaaggaggaggctgggggaggtgatggctatcagccccatgaaattgaccatgagccctgagccacctgaataccaggagggtcatgagcagaggcatttgtacaggtgatgtcttgaacaacatgcttcatgttagtggcctctgatagagtgtaacctgggaggctctttggttgtcagagaatttgtcttatactgtattagggttgcagagtgttctgtcttcaatgaagatagaactttttggtcatgtacgtgtgtgtgtgtgtgtgtgtgtgtgtgtgtgagagagagagagagagagaaagagttaatcccccttgacaactcctggatggcaagatagttacagataaatgctcctcagaactgtgccattctagtgtgacaaatataatcaaatatctatattaggatgtgttaataattatctaaactttatactttaagaagtccccagattcaacaaatgaatggacttctgttttcttttttaattaaagttacagctgggaaggtcaaattggttctcttttatacaggttagagattttccctatcagtttccatgaggagcatgttgagaagttctagctgtagacctgcatgacctcttcaggtacccgaagaataacccaaagaaagctggaagcagctttctcccttgttgttctaaaccaggcttgactcatatacttacggagacagccgaatggggtctttgaaataaggaaagaccagtaagccctgtggtgggtggttgtagtactcaaggagcccagtttgggcttcatcttttctttctagtgctcttagtggtttttgaagttcctaatttcctggtctaaaaatatagatgctactaatgtcttcggtcagtgaaaaactaagattagggtcaataatagcaactaaatagtaataataagcaccacttcacatgaaagagaacattgcattattcaaaacacttttaaaaacatcattttataagatctgtttaagtatttattgtagggatctatatattctcacatacaccatcgttgaccatgtgccaaactctctgttagggcttttcaaggctttatcttctcaagcaggtgtcattgttttacaaataagaaaaatgaggcataagtgatggagctgagatataagttgtgtcttaggattccagaatctgggccctcttcccatgccgtgctgcttccccgtacgtcagtgtgagttgggataagcctagcagtgccattcaggagctcatgctgtcatcccctctgtgtctcacctacttgtgctgcaagagacctggatcctgtttatctatccaccctcacccccacccaaacaattgcactaactcctaaaaattcaaacatggcggtttctcaagaaacatggaacgaataaaatttgggtctactaacaacttagattgtacaggctcttctgaagtgggacttttttcttattttagcctggaatgcagttatccaaggtgagaagggaagggctatatacaaggtatatattttaactcttacagatgggtagcaaagtcagcccatgattaattagggatgtaggctacaccagtcggtggacttagcatgaaccatatttggacacagaactcagtcttcctttaagtgtctgtatatgtgtaaacatttaatattttattaaatcatagactccctgaaagcatcccatgcctagcatgtacttgacacatacggccctgtaaatattagtgttatacccagaagttgctttattggttatccaagtctcataaaggagaagggccttgcctctgtcactcagaaagcacaggaagagcagggctggagcagaggaatttcttctgagcttccagtccagagcctcatgaaccccatatggtccctgcagaccattttcttcctacgaccccacacaggagaaggggccatggttccatggtggctcctgcactgcaccctctaaggtagttttgttctgagttataattcgccccctcaagaaccctcttgtccatccccagacactgattctcaccctgacagaggtctgggtccatcagggccacagggccttttcttttttaacagcaaatgctgcgtgggctgttcctgcagcccaaatgatagtaaatacctgaagcagccatgtccatgttaaagattatgtatttgccactaaggggagaatatagtgtttatcggccggagtgcgtgccggctgagctgattacggcacaacactctgtcagccaatgatttgtcctgtcctttatcatctgtgtcactcagcagtgtgctggcgaagggaacggatcacccccttccctttttttgtacccattttgtgtagaaaatttgtatttactttgggagtgtaatttgttcctcatggataatgtgaccctgagcggagctggatcatgggttagttgaagtgatattttccgctaatggtagtcgtacatcattgctgtcagctcgggttaggaggcaagcacattacagctccattttacctctgcaggcatctgggattatttgccataaccgagtatgacatgaccgcactacagagtgcattaaaattttactggcttctcaggcaagttccccagctccagtgtgtgcttcaggcaggcggtctgatggggagtccaagggccctgacttcctgctcagaggtgctgcgggcagtggcctaagcaggggctactctctccttgccctgagaaagaagcagggaaagactctgtggggagccacccaggggatgtttatgtctctatacgtcccggactggcaagtgactagctgccttgtgtacataaccaggtgccgcccacagtggctgctgccatctgctctctctccttgatgacttcagcccccagggtggattaggcaaaaactccttctctaaggagagcccagggtaagtgcaagtctctgccaagccttgggctgatttgtattgttcttgtctgcctacgttcagactgaagaaaggaggcgtaagtcctcattatggcagaacccacgtccagccatgtagctggactgagcctgatagagtctcatcaacccagttagaaatgtttgccaaggtgttttacacattatcttatacagtcctcacaccaacccaatggagtgtaggcgtgattacctccattctacttataaggaaactgaggttcaaaggttctgtaacttacattatacagctaatggtagcagaaatagccttctgacttcaaattctatatggtttctagtgttcagtgctacagagagataaagaagtaactattgtttaaatagtgcttagatgtgctatacatatgttgacttgtttagtcttcagtacaatcctaataggtaggtgctaatattatcccccatttacagaggtgggaactgaatcacagaggtattaccgaacatgcccagtcttgctcctggttaatggcagaggcaggtttcaaacccaggtcagtgtggcagtgctcttagccgctaagctggactctcccacatgccacattccaataagcctgagagctgataggaaaagaccagtgaaaactgtaatacgttggaatacaaggaaatgttcaaagagtattttatcactttctgttgtaactctaacatccaacaaaatatcactcaaagaagatgttttgtgatgagctttaattaattaataagtcccatttgcagttagcacattacttgcatgcaaatgatgcttctaaggtgcttgaaaggtatttattttgataggttaagactaagcagtcactctggcaaatgctttattcttttatattcttattggaaaggctgtaataaacttatgttgaatcatgttctttaaaaggacaatttaaggttgtctcccagtaattagtgggatatggatgagggcccataggctgccatatagaataaaatgactgcagattccatattggtggattccgaatgctggacacttgaatgtactctcgtgcctacagtgtggacatgactttttgttctgacacggaaatacccctttttacctctctagccgcctcatcgctttctattccaagcttgaaatgttacccctcctggacagaatggacaagccattcttaccatcacctgtgtacatgatagggttgtaattcatgaatttattcaataagccagacataaagtgagttgtaccttcagggcagttttttaaatgctgcaacagaagagccatagataagcatggcttttctcactgagaaatttaaaattaagttagcacactaagaattgtcctccctgcccccgctcccctccttgggctcacaagcacacacattgatcttccctgctagattaccataggtccaggggattgaccttagtttctcctctagccttagatccaatcactcaagtagtaaagaataagaacaaaagtattgatccagtcatggaacagtaattatttctctcagatggtcgtttagaatgcagcaataattttaaataatgtattcctcagagacagcatgacaacatatgtggattatttagttggtgcgtttaagtaagttacacttgcaccctcacccctttactggacgtccaatgctgtgcaaggaggcctactttaagaagagtagacattgagaaaaatcagagtttacccaacaaatcaattaccaagcaattgttcattataaaggggcttatccattttctgtagctggacaaaataatggacctccacatgctcacatgcttacagtgcaactccacccttccgtatgaagagacttcatgaagtcattggatccttttgaaactcttaagttgtaacagctttgactgtgtttatgttaatagagttaccttttaaagactctttttgtttcaaataacatacattaaactaacaaataatgaaatgtttaggcttttggaatttaaatgtgttaaaataaccaaaccatcagaagggcagagccaggcaactggatatcagaaacagtgagcagagggctaaatgccctccttgctttgtctctacttatttttgcccgtccacttgaatcttgataatttcggagacttcgtttctccttttggtagaaatcatgacccatccacttttcagttttagctacaggcagagagactgtctctccttttccactgccattgctaagatccaagggagagattctgactggctgagattagctcaggaaaggattgtgggttggtgtaacttaagccaggtgcttacacctggattggtcagttatgggtagagagacgggaccatgttgtccaaatgtgcttctctagaggtgcctctgtacatggtgctggagtcagtagagaacccagaaagttaggagttgggcctgcagcagtgggttctaggaagcaaaacctaatcttcctgccatttggatgaggcactacttacaggcataaattcttgacagccatagaagctgcctgggtcatccaaagttgacactttatagtgatcacaaaatctcaaatatggatacgtatttacaattatgtataataattgcctaaatattcatagagtcattttaagtgctattcacagattagttctatcttgcttaagctattaaaagccatagaaatacacaggattttgtagagtgagagttcatgtgtacatgcacttagaaaagtccagaatttattaatattttaagtacacctatagtagctaatgaattactcccctgccccacccaagtataagacagccaccttgagagacacaaagatctcaaggaatgtcaattagtaaattacatatctagggtacaaaatgaaacttctttgtccaaagggattgtggtcaacctggagaatccaatttgcatgccatgcagtactacttaaacttcagcaggcagccttcctgaagtgatgttcctaagactagaaaatagtaactcactcatagcttctttcactcatgtttcattcaacaaatttaatcctcacttgtatgctaagccaagcactgtcatgggaactagggatgggaagaagacaaagacatagaaaaccttcagggaaatatggcctaattgaagggaaagctgaggtacctagatgaattacaagaccccgtagcgtatgctgtttctgaggaatggcatgatgtctgaatgcaaaaaactgagccatactctgtaagggaggaagcaattgagttagatcttgctgcagcacatggaatagatgttactaggtagcaagaatggggtagatcacaggcaaaggggatatcatttgcaaataacagagttaggaaaggcttagcatgtggagagaagcatgaaaacttctgtttgtttggtcagggtccatggcagtgttggggggaagatgagactgtaaacatatgttggtatacacagttccataaaaacaggccttgcacggcaagatgagagtttggacttgatccagatggaagccactgggtaccttatgtaggtgaatgacacatcagaattgacattttggaggaggattcaggcagtggcatgaaggatggagtgaaagggggtgaaagttgtcataatgggggatttgagaggtgatagagatctcaaccaaactaatgtggaaagaaggagtctgattttagaggcatttctgaagtgatgattttgtgaccactgggaaggggggtcaagggaggaatcgtggatgactcaggtttcaagtcaggctgactgggtcagtattgatgatgccatcaatcacacagcgaaagtggggggatggagaaaataggagctcagggaggggctttcaggaccttcagctggatgaggtcagaagagagtacatattgatgatgcaggagtgatcccaattttagttcagtgtctgggagacaaaactaccttagtagcagagatggagctataggggaatgagtgggaggccagccagaacactgggattttgtctgtgtctacaggaataaatatacgtggtgatgataaccattaaaaacaaaataaatactggggactagtagagagggaaggtagggaggaaggcaagagttgaataactattgggtaccatgctcactacctgggtaatgggatcattagaagcccaaacctcagtatcactcaatatacccatgtaacaaacatacacatgtacccccgaatctaaaataaaaattgaaattattttttaaactacaaaataactgtatattaatcgtagcacttgatatttgtatagcttttttttttactgtacatatctttattttttcatttgtggcaaaatacacataacataaaatttaccatcctaaccatttttaaatgtacatttcagtagtaatggtaagcacactcacatggttgtgcaacctatgtagtttttttatgccacatgtgttaaagtaccatatatagttcatttaaacctcataagaaacaccctggatgaaaggatgttaaatatttattttagaaatgaggaactttgaaacgggatgaactgaaacaaagtcgtaatgctttggtgataatatccccatgccttctagggtcagtattggggttataccacagtatccttagtgatgatattttaacatctaacttccagtggaccaaacagtaactcacttatagcctgagatcctattgctttccttaaggaaactggaatggaatcagccccacagcatgaactgggccacccagcagcagccaggtcgccgctctgagaggtctggttctgaggggctctgtgggagtaagacagcatgaggccatatagctttggatataggaaacgcctagaaaggtagagagatatgataccacacttccagctctagcaacatagtgctgtgtgactgcggccttgggcagtttactaatgcttctaagcttctgcttttgtgtttttttgtttttgttgttgttgttgtttttccttttaaaaatctagatataaaatacctagaattatatggcccataatagtaactactcaggtcaggcactgtgactcacacctgtaatcccagcactttgggaggccaaggtgtagaccaacctgagtaacatggtgaaaccccatctctacaaaaaaaataaaaattagtcagatgtggtggcaagtgcctgtagtcccagctaattgggaggctgagggaggaggattgcgtgagcccgggaggcggaggttgcagtgagctgagattgcaccactgcactccagtctgggcgacagagcaagatcctgtctcaataatactactattaataataataaggattcagtaaattttacatttcagtcccttccaccctgtttcctcctgctggtcccccaccattgaccgacttaccctgcaaaaaaccataacacacattagcaagattcatttattacagccaaatcagcaccccaggatcaggccttttaggaaatgggatccaaaacataagtgtcttaaagaggtagaagatcagagggctttgaaacatggccatgtcatcagtctgaaatttagaaagaagttccctgtggcaagagaatccgcaggaaatcactaagctttggaggcccaggatatacccagtaaagcacaggcggtgggcccccaagggaagatggacagcaaagacagcctttataatctgagtagatttcacccatgtccccctccacctaagctctggttttcctttagaggaggcttttaacttaattcctgttgaatttactaatgttgtgtggtgtgagattttaagtatcttctccagcctcctgggcccctctctcctcccctgtcccttccccacctccctatcctgtcttgaacttccaaccccaagagctcttctttacactgtttgctaaaatggagcctcttgtgtgatgcatacccaggaggtgaagctttcaggggtcctaatgtgtgcttcaggataagggcaccatgggtcccctgcctgccagtgtgcccctcaaagaatgtgggctttggcaacatggcattaattcactgccaatgaaacaatgatgggaattttaatgatagcgttgctgtctaaaagatgacgggggagacttctcagcgtctgtgatccagaaaacacactttctagtaagtatctcttatggtcagaagtgagagtgaaatctctgtcagtccttcctaagcattaccttggcaagcgctacagagcaatgtaacataggatgtgttcagtttaagtaacagaatgcctgatagtggctttgtccgtgtattagtttcctgtggctgttctaatgaattatcacaaacttggcggcttaaaacagtagaaatgtatcttcttggcatgctggatgctagaagttaagcatcagtttcactgggccaaaatcaaggcatcagcagggccacattcctcccagacgctctaaaggagaattgttccttgccttgtccagcttctggttgccaccagcattccttggctctggcagcatcattctcatctctgcctctgtcttcatgtggccttttcctctttcgtgtgtctcatctccgcctgcctctctcctataaggacactcgtggtggcatttagggcctatccagataatccaagaaaatctcacttcgggattcttaattagtcctatctgcaaagatactttttccttgtaaggtaacatttgcgggccttacaaaacacattcaaggcagacaaggagacaggcggtcatgtgtcctgtatgtccccttggctagaagagtccattcctaagtgtgagagagaaaggaaaagcaaagatctggcaaagaggggcaaggatttccatgacccatcatgattgtcccctgtgggttggcgttgtgctgtcttctgttagcaagaaagaggcggaggacatagtttgtgggtggtcgaagaactatgactgccaccaaggatgcgggcttccacacccccagtgtgtcagacaaaaagatctgaatgggggtctctctttttttggggaaggtaacgctgttttttaacgctattaaaaatctagatataaaggccaggtgtggtgtctcacgcctgtaatcccaacactttgggaggccgaggcgggtggatcacctgaggtcaggagttcgagaccagcctggccaacatggtgaaaccccgtctctactaaaaatacaaaaaaattagctggacgtggtggcaggcacctgtaatcccagctactctggaggctcaggcaggagaatcgcttgaacccaggaggcagaggttgcagtaagccgagatcacgccattgcactccaccctgggtaacaagagtgaaacaaaaaactccatctcaaaaacaaaaaataaaaatttatatataaaatacctagaatgatgtggcccgtaatagtaactactcgggccgggcacggtgactcacacctgtaatcccagcactttgcgactgagcgtttccctgctcagtcacactgataaaccaccatcgcctttgagtttctaactctgcctatctctggaatccactgaggaggaaagtgggcttaaggtttggtcttggattctgaaggtgcagacctcatcaccacctgctgctgtgcaaagcacactactggacctctctagaacctcagcaagaattcatacctcccaaggctgtggcaaagatgaaatgcaggcctcgggagtgctttgagctctagaccattccacgagctgctgttcctgttgtcactggacagtagggcccactgctgcttcatagcctaaagccaggtggagggagtccagtacccttgttgattctttgcttccctttcccttgtcagccacacccaccacacagacttccacatacccatgtgttgttgttgtttgtttgtttatgttcgtttgccagttctgacttaggagcaagcctttggtgctgaagttggtactgttctcactcctgaatgtaatgcccataatggatggagaatgtcaggggaattgtgggtaatagtaagattactgtcatattcccaaaccctggggtgggtgggaagaagcccctaaccatgcagctttatttccactgtgcttgtggtggggcctggaccaccttattcctggtggccttcatcttgggtgctacaggtggcaatggcaaggactgaagtggggagagtgaagatgcccgcagcatctgtgcctggccctggctcattcgtctgattggattgttagcaagccaaatatgacctggcctgcagggtacaagaagacatggaatacctggtaggcagctagataggaacgcgggacttcccagcagctgagcgtggagaggtggttccctacctggctacacatcacagtcactcagagtgctgtgctcagagaggcactttggcaataccctggacattccgattcagaagtttcttaggcaggtgtggtggctcatgcctgtagtttcagctacttcaagaggccaaggtgggaggatcacttgaggccaggagttcaaggctgcagtgagctgtgatcatgccactgcacttcagcctgggtgacagagtgagactctgtcgctacaattaaaaaaaagaagtttccaggtgaggtacaggaatctatatttctaaaagcaaccctgggactactgatgcatagcctgcctggcaaatacacagtttttaggagaaaaccatgagctttggggtcagggaaacctgtttttggtaacagctgtgctacttactagccatgtgagctttgtcagtcacctaccggcctctaaacttcagtatcctcagctttaaagctagtgtggtactaatacctgcctcacaggattgctgtgaggatgtaataagatgtttatgcacaggttatatgtatgcacatcatggtgctttaaaaaccctcaacttccccctaacccagcacggaagttcaagggcagactggcccactggctttggctctggtgcccccagccacttcccaccaactccatccatgtaagatttacatagccatggccaaattgttactgcaattaacaatcacacctaaaagcttttacttttacttttactttacttaaagggaactcttaaagagtgtttacttcatatcattagcaaatcattgttaattcttgtgatactcaccgtaataacatctatccaaatgaacatgtttgctcttaatgcgagtgtcatgtgcaatttgggagaaattctgttgtcatttagcattaattaatgcccacttactgtaaagtgttcagagacaccaatatcagcgagatttccagaccacatagacaggacagaagagctgggaaggggccagaagccactagcagggctgcactgtgactgaaggcagtggccctgggcacacttctctgctgagggcaggcaggccagccttctggctggaggatctaggtgtccacccataggtgttcagagcacacaactgggccatcccagcctggctccactcactgtggctggaaggggttctgcctctccatccccagcccttcaatcccacacaaccacctctgatgacctctcctcccagctgcagccaccttggatgttgatttttaacctgatttcacctggctgcacatgtcagctggtgggccctggagtgtgaagtgtgacttgcttgggcccctgcagccttgcctccctgcagcgacttcctgcagtttgactttggggcagcggctgccggagaagcctgaaagttgagctcaggaagtcatcttcatctccacccccaagcaggtgcttgatcaggactgtttattaatgtgttctattttctcaaatgcgtcctccaaaacagagtgtgtgtgagatactactcctgtgcctgggacagtcagtgtgacagtgaacagtgctgctctaggtgtggggacacagccttacgttccctttcttccaggcagctcagtgtagtggaaactacaataactgaccggggctgtgcccaccagctgtgtgagggggcctcagttttcccacctgtaaacggggctcactttacccaccccgtggaatggtttaattaggtgtgatgaagtcctgcatgccacaggtggtgcttagtagccatcgccttattaaaaatgccagtgatcaccgaggatcatgatttccctccccttgtgtccacacctcagacacgtcctctctccttctggaggggtaggaacagaggaacagtgcctctcacctgaggagggaacttctctgaatccaccaggaaacccagtcacaaatcacacagaagcagtgttcattttttctgtccacaaccaatatgactaaagtacggtggaaagacaagtattttttgtcctggtgaggaaaggtgccttgatatgtactttttttctgccttgtggatggactgcattggacagaggtgggggtggtggagggagtggaatttaccatggtggtacaaatgagtcagtctgctcaatagggatgtgtcccatacagagccgcagatgcctggtttaaaagactcaggctgcagttaactatgctaaactcaaattttactgagtggaatttagtctttctctgatgattaaaaggcccttcagaatcttctgagccgttttgttgaacagtgcttttttgttacttcctgggtgtaggaaatggtggggaacagagggttttgctggaacacccactggacttgtgtgtcctcctctcggtttctaagggcccctcaggccacacgcctcccatttccaagagagtgagaggggcctagaaaaggctgaacacaaagccccacaaccgccaaattccctttcaagggtgttacttagtaaacatgagcccttgagcccacattcttccagactgtgtctgcctcaggccacccctccttctagaaggagcagtgggggccctggcaggaggctgccggctcagcctggagtggcccacagcaatgctccaattcacagtgaaatgatttcctctgcctcgtataatttaacctgcccacattgctaaacttctatattacacatttctgtcaggatgtcagaagaaatgataagcctccttgaaacagcaacctctattacatgctaagagcattgcgcctggctccccccagctctggtccttctggtatgtttctgagatttttagcatggtctctcaagtataaagaataccctacttcatgaccccagcctcttgttagctgatagatgaaatcttttctaaagctgactctcttgtctattatgttttcaaaattcaaggttttagattcttggatggctgccaagtggccgggctttcttagtaggtgaattgctcctctctttttttgatccttaaacaggaagtagttgttttttagggtggagggaagcgggaggcatgttccacctcccttctccctttgttgatgtttccaggcaattggtggggaattttttcaggaatttctcctcggggaccatactttaggaataaacccaaacacggaaaagccatttccttgtctggtgggagcttgtgttttctcgctagattgtgtcacccagaatttgttgtggagcttcttgacaattgtgctgtgcacgtgactgcagcatggaccactgagggggaatagcaccaagctgctccatccacacgggagacacttgcgagatctcagggccatggacagtgcagctgcctgtcgctccctgcaacttactcccgacccgggcctcctcagagacagccacaatgcagacagtccacacataggatggctcaggactctcttcattattagctgtggttgtgtggtttccccgggagagagaactaagactgagtttcatttaaacctaaaagtgaggaagaacagatgccatattcctacccttagttgttaatttggattacaaacacccatgcttttcttcaggtcattagtcatgtggcttttttcttctttgtctcactagattctgtgggaacagatttctttctgcatagcatttagtggtgggaaaatgatgtttgctgaccatccttgaaattgaggcacaatgtagttcttgattaggaagactctggaataagcgcccaggagaaatggaaggtgtttggtttccaaaagtggtaccttcaactctttttgtaagctgagtgtgtttctctccaaagttcctagcccattagtgaactgtcatacacttcaaggccagctcaccactccgatagctaagctgtcatacatagtccagggtccgtgtgagccccagctcttttaaaactcctggctggctgtgtccagagaagacattcttatcagttttctcagttacttttgggaaaccatctcagagtgtaacctaagtctaaactcagacaaggcactgtgtgttttacaaaatacacatcccactcacctgggcttaattacctgtaaaactgaagtaatgaaagcagtgcctcaggcttctttgcagctcaaaggggatgggccagggattggaatgtagacctgggagcttcctttgggtgcctcctggatgaactgcactgtaggttcagtgagactccttccgggataagccaaggacaacagagccagactgtggggcagagggtctcatggtcctcatggcaaagccagccccagccctcagtgtgccctcatgactatgagtccagtctttacaacaggaacataacaattctacagaagggtggaggatctaacactgaacaagcaaggccccatggaccaggcccccaatagacgttacttcattcagtcatccccacagccccgggaggtggaggcatcactttccataccgtatagaggagggaactccccaccaactagtgaagtttaaaaccagcattccaagcagggctgcccagctaccctgcctactttgtcctgttgctgcatcttctctctgattcccctgaagtctgtgcgaagtgccacaggaggtcgaaggagggaccagaaaggtgagggtttcccggaagtagtggaagcggaccgtgtcctgagaggtccccagcccgagaaggaggcagccaacctcagcaaggacagcctggtctttttttttttttttttttttttttttttgagatggagtttcgcttgtgtcacccaggctggagtgcaatggcacgatcttggctcactgcaagctccacttcccaggttcaagtgattctccggcctcagcctcctgagtagctgggattacaggcatgtgccaccatgcctggctaatttttatacttttagtagagatggggtttcaccatgttggccaggctggtctcgaactcctgacctcaggtgatccacccgcttcaacctcccaaagtgctgggattacaagcctgagccaccccacccgctgagcctggtcttagagtggggtcagcttcggcttcctattgtgagaatcaggcctctggcacttatcagccctgaggcctggcttaatttacttcgaatgtctctgtctccatttcctggtctgtaaggtatcactggaagtgttctcaaccctttagtatgctttagtgtgagaaagcttgtaaaaatgcctgcatggtgccttgctggtgcccagtcagtcctgcatttctcggctctgcaaaatcacagacacatggaatgggatggtatgccccagaagaactgggggattgggagacctggcaggtgtgagccctgggtttgggaagggcagaaggtaagtggtgacagataagtctaggaaggcatttgggtgtcaggtcataaaggaccttgaaaaaccaacccctgggttagttgaagctttggtttagtttggtttcacggaggaacaggatgatgagatttttctttaggggaagatgacggcagcaataagagtgttggaaaagtcaccctgaacaacttttgtaggtaacttaagggcagaaaaaaggaactctttatttttcaagtggcatcatggctatcacagctcatcagtgcctggaacaacacctttaataatgtcaataggaacgcttcgaactgctgcagaaattctgcttcctgaatgtttgaacttaccctcccatttaatctttaaaccatcccttcaagagagggaggacacaagggtttttctcaattatgtaccactgtgagcttggcttagttaccaaaggctgatgatgggctcagcagtgggatccgagtccctgcgttcccacccaggcttcccaccattttcctcttaggtgcgcatccgctttgaagctgcattctctctgagacatgtggtggtaatgataatgttaatactagtaatgatcatagtaatcgctaacattgagaaagcatttacttattatatgccaggaatacgttgctagttttgaattgttttgtgtaattatcatctcctctttccaactaagaaaactgaacggtaatgagataaattaccctaggacacataacaagggtgtggtaggatagaaccacacccttcccaggtgaggagttgcctgtcatttctcagggtcctccgtggcacctggggacaggtggaggtgggcgtgggttgtcaggacatcaggggcctaactctgactctgcgtcaatcagagaagcttgatttttatctgtttcattggcctttctcaaaagagttgatttgagaaagtgttttttaaatagctttttaaagcggaaaggggccgtgtgcgctggctaatgcctgtaatcccagcatattgggaggctgaggtaggcagatcacctgaggtcaggagtttgagaccagcctggccaacatggtgaaaccccatctctatgagaaatacaaaaattatccaggtgtggtggcatgcgtctgtagtcccagctactcaggaggctgaggcgggagaatcacttgaacctggatggcggaggttgcagtgagccgagattgagtcactgcactccagcctgggtgatagagcaagactccgtgtcgaaaaaacaaaaacaaaataaaaataataaaataaagtggataggggttgattggggtttttcttttttggaaaaaagcaattaaaaagaagatggattgatagatacataatgagctgggtagatggggagacacatgataaagcaagtgtagtacagtgttaataaagtcagtggtgggtatataggtattcactctaaaataccacttttctctatgtttgaaaattttcataataaaatgttggaggagaaactagccaagtaaataatttctaagggcccttccaattttttaaaaaattttatttcctgcacttctctctacatcctatagttgtgatcatgtacaaccatgacgtgatcattaatctagatagatctcctagtcaccactggatgttgccactaaaaaaaaatctaggctgggtgcagtggctcacacctgtaatcccagcactgtgagaggccaaggtgagtggatcatctgaggtcaggagttcgagactaggcagaacaatatggtgaaaccccctctctgctaaaaatataaaaattagccaggtgtggtggcaggtgcctgtagtcacagctactcgggaggctgaggcagggagaattgcttgaacccgggaagcggagattgcagtgacccgagattgcgccactgcactccagcctgggtgacagagcgagactccgtctcaaaaaaaaaaaaaatctgctggggagaacaaagtcaatcatcactcatttggttctccaactacctgagcctaaattttgattggcaagtttggttgggttcagatactttcactagaaagccgtaggcctgtgagtctccagatgaaaggtgggtttagatctacacatctcctgtttcagggcagtgagctgttttggacccatctctagtagaagtttcttggagctctccagccacaataaaggtacagtgttcctgttcactcactttggcagagccttgaaaaggagcacagagacggtcaaatagtaaaatctaaaaacccgtagaaaaccctagcagaaagtattcttaaagacccagctgtatttttctgttcataagacccagataagcatagtcttcccatttgacattctgactttaacatgagagggagtttcatgcccccttggtaggacattggagtacttgttgcagcgtgcaagaagtggactttgtccagcttatatttagaataaccttgccagcacattccagggagttgatcaaggagttttgccaaactgtgataaatcagcacattgagcagcctctgatggctgataagcttgggagtgccagttaattgacaagaaccgcacttgtcaatcttttgaggtcatggaaatggatctcttgtctttctgcccttccccaagtcttcacccgcttgctctttggtagattgagcatggccttgcactgcatggagcacacctcccacctttgttcttgtgtgtttgctgagtaattaatctcattgtgctagtatggaaatagtctattaaaacattccggaggacaccatggagagggaggaaggaggatgaagactggcggagggagtagtttgctctgtttaattggttctttcacctaatggtagtttgtcaattaaggggatacttagagaaagtgaaattaatccatgtgggtcaaatgcagctattaatttttaatcaaaacacaatgttcaacaaatctgtagctgtgcttagtacaaatgtaagcatgccaccagcctcttcccaaaggatgtgggagcaggcacaggaaaggggggcctgttaatctagcaaatgtttgcctcctcccacactccctgtgaccctgaggtaagctccgcagagcttcgttcttgtctcttcaccatctattgcattgcctaacacatggtagatgctcagtgatattgctcttctggaactctttccatccctattatgtgcacagctttggagtacctcaaataggttttaggcataacagctattctctaagagctcctagcctgcttgagaaagcagaggaggcagttatgaatgcatccccaagtcactcagagcaacgtacaatcaagtacaagaatgtgtgataaaccgtggcatttgttgagcacttgctatatgccagatacttttaagcacttcacataaaccaagttttttaatctttgcaacaacacaataaaataagtaccatttttatcatcctattcataaataaggtcactgaggcccagaacatttaggtaacttgcctagggtctcacggctagtacaattagtctgctagagggttgcattcattacctaatattataagacccagagttgtcccaagagagctggcattgatcaggggttaaggtatgagtttattttggaaagtgccagaataagatgctccaggtagttggaatggtaatcagcacggttttgtggaaaaggagtgcatttctggttaactggaatatgaggttggtgaggttgaggtaggtctaggttaatacactttcagggtcttggataccaggatgagaaattttcatgtcggttattctgggatttctttattgtttatgggttgtttcactttggaggagcaagtcccgttcctctatttctgcacttgggcattgtgccctcatcattatctctcttacctcctctgcctccctccatctggcatctttcttctcatttatggcatccttagctcctcctgcttcccatttttagagagagggagagagaagagaaaatcaagaaagtacaccagccggcctacttctactgactttcagaggttgaatgaagcttttctcagccctctgccctcacctcagtttggtcctggaactttgagaggaaaaacaccagaaggacttggcctcaggaagttttcttctgcctccccttactgagcagaaagcaggttggaggaaccacttggctctgtgacatttatagtgacatggtttggagaggtcaggaaggactgtcccagtggtgtctcttcaggctgctcacaactgcctgaaacctctcagtaggagaggtttctcatgatccagtgaaaaatcaggcttcaggtgtacatagtttaggataggctacagggtatgttaaattccttcacattggccagaagctggagaaatgtgaggacaggtaaaatccttggatattttcttctttacttccaaggtagcttacaacctggcctcttgaagtcattgggctgatgataactggtggaaatttgcaggtaattgccaatgacaatgagggagagaattggggaatagaggggccctatgaagaggatcctctgcctcgtattccatgcagtcctatgggctgctgcagtaaacctgggaggtcatcaggattaccacaaagactcgtgattgggtgggtgtccctctgggcagcctagtttccctagacatacaacacgtgttcttctccagcagtgcaaagctgagaaggggcctgagtaatcgttctggtcttgctccaggaggcaaagccacagctgtctgtgtacccccatgcaagtgggcaggaggggttccagcaaggctgcttgctgggggagacagggtggagggaggaacagcgactctggatcatagagcagaggtcagggaagcacagttaggatggaaagtctcgggcagaaggtgggtagaggtggataggcagtgtacatggtgtttcaccatgtcatcttgaccaggaacacggtggagagaacagatatagctgactctgtgtgatcagtgattttaaaatgacactagtgtcagactcttaaccagcaagggaacacatcttgtaaatctgggaaaactaggtagcccaaagggacacccacccaaacaagagtccttcatgttgaagaagaagaagcacttcttgataaacaatgaaacaagctgatatggaagaaattgttatgtcatgggaaggaggacatttttggtacctaatgattaatatgaaataataattatgtagtgattatatccttgcctctcaatctaagaatactcagaacattgtcatagtgaatttcagtatcttctatgtgaaaagcagcttagctagtgatatctgttattcatgcattcattttttctttcctttgccatatatttaccaaaacctaatctctgctaggtagtgaataaggcttttgggatgcggcaacaaacaaaatgggcatgttcactgcccttaaaatgtaaggtgaaatacaacctttatagtgtccactttcctgcgatggttaaggttttcttcgtggacaaatacatgatcaattctatagctattccatgcacatataaagaaaagtgaataatacctgttcacaatctcaaaatacctgttaaataaaatgtatcaattttaaacattagtgtgagacaaaaacattaagtaacagattgtgtgcgtgtgtgcaggcatgtacagttagtcttgaaaagatcaattgggagtcagtggagcatttaaagcagggatagacatgatcagatttgtcatttaaacggtaactttggcagctgtgtggaggacggattgagggaggccagagtgaagatcagcagtgaggagagactgttacccaggtgagagaggatggtgactcagagtaggcaatgtgggggctgagagaagaaaaggagctaaattcttcttggagatcaaataagcaagatttggcaactgatggaagagaatgtaaaacaattatctacttcctaggttggttgtgggaactaaatgagacattattcgcttcattttacaaacaaggaaatagagactccaaagtgattgagataaacgtctgacttccacacagcctttgatctctctactgcacaaggcataaaaagggtgtaaacagaggtagattcacccaggctaatggctgaaagcctcaaggcccttcacttgctgggatctcatccaaggcctcatacctaattttatattcataactttgtattcattttcttaaaaagcaccctccacaagggtttaagcttcagactccaggaaacctctatctacctctggccaagtaagtaacctcattgggtaggactgaaacttgatgggatgagacctaggatcaaaatctgacccagcaggcagagaaagtagtgtgtttaggttgggatcaactgggagagaaacagatgccatattggaggcataacaaaaatataactgttagtgtttattgaatacttcttgtgtcaaacagtgtatttattgactttgattttttgggggaagtttcttgtattatatcacttaattcttatacaacccaacagggtggttgctttcattatccccattttatatgtgaggaaagtaagccctggtaagagtaagtaaattaacaaagtatcacaatactaagcaggtgagcagcactggcatcttacaggcctgactttgatgtttgaggctgtccttaacctccactgctagagggactgtggtccgaagccagcacctctgatagattcttgacatgtgctgggcatttcctctcctagaggttggaggaagcaaggtctaattctgtcctgctcctttccaaaaaggaattgcttggtgaaatgtcagtgggagaaagtaatcaccccaccttcagatacagagttgaggacttatctgacatgtgccggagaagacaagaagattctgaggcttgaggccgaaggagggcatcaagagactccagcagccttattttgttattatgcggttgttattttgactcaacagttggctctggtgaaggggagagatggggcttatatgcaacaacaagtgagggcgatttgagggaaaacatgtgacccagactaggagcattgtgtccacattaactgaagctcacagaaatcctaaggataagtagggttttcagcgtaattttgttttttatgttctgatcaagattaagaaaaggaggctttgtcctttgatggaaggtgtggtgttgatggatgacccagagaaagcagagaggttcacctcctgctctaccttcctgtccagaacatgatctttagaaggaaaggtatagaattttcttggcttaaagggactttagatccaagatcagtaaagagattgccttgaagatttaaatgagctcacgttttcctgacctggacaagttacctccccacatgctgagagatcttgtaaatgaaatcactgacccctccctgccagagatgttggagaaaggtgggacatcaggagagaggctgggagactagaggggggcaaatacattgcgaaatttttaaagagaaaggagtgttctgtagccacaggtcagtgagcatcaggtgctctacaggatcctagacccggtcagcatggagcaggctggtgaagaggaagcaggaatcaaagagtcgggtcactaagactggtcactggagcttagcacctttttttttttaacaagcttactaggcagttaccaaaagtggaaagggcagtcttactccctcttctcaaggtcttcgacaaggtcttttatgaagcctttgtggattcggtgggaaactgtggagtggctgcagcaaattggtgaatttgttgaactgaccaagttgatggtcgctctacagtttcgtcacgggactctgccctatataaaataatcgtcagtagttgggtaataattattctgcaccaaagttgcagaagacagaaagttgtgaggaaaacagatagcttcagatggccaagtcagaatttgaaaaagaaaactcattcatacagtcaacaagtatttgagtgtctgttacatgccagtcatatatccatcacggagcagctacttctgggttgattctcctagtatggatggtaagcaatgaagaaatgtgtgtggtgtctgcatgcaatgtcagatgatggtaaagaatatggaggaaaaatttaaagtcttaggagataagagcaaggtgtgaggggggtgctattatgatacagtgatcaggggcagcttctctaaggaagggcccaaataaagagaagctggtagatacccacaaatctgggggaaaactatacctggtataggcaacagcaagagcaaaggccctgaggctggaacatgtttggcatctctagaaagcctgagtagctggatatcagtgagagcaagcatgagaggtcagagcacagcttgtccttgcaggctatgggggatatcagatgtcctgagggagagggaagccactggaagcttttttgatatataattgataagatccgactcgtggtttgtttttgttttgttttgttttctttttaattgagtcagagtcttgctctgttgccccgcctgcagtgcagaaatgtggtctaggctcactgcaacctccacctcctgggttcaagcgattctcctgcctcagcctcttgagtagctaggaatacaggcacccgccaccacgcccggctaattttttatttttagtagagatggggttttgccaggttggccaggctggtctggaactcctgacctcaggtgatccgcctgccttggcctcccaaagtactgggattacaggcatgagccaccgcgcccagccaggttcatggttttagagactcagtctggagataagcttagcacagtgtgatgggctggctcttcaaggatagcatgacacacatggcttagcaatggtagatgcgagaaaggcctagaaattttagtaaaaattcaccctaatattagcaacagtgttatttgcctgaggaaaaaactaacagtattaaatggtatttggtatttacagtgactggtagggattggtttttaccctccctcccctgcccaatctctgaagtcttttaggataagaaccgattggttaacaaagcttcctggatgaactcagcaccttattcagctggccactgccagccccaaccaacagagaaaggagcatcagtgaaccagttctggtgaaccagttcaccccactgtgaaaactcaaaacccaggagatgtggtagatggaaataaggatgtttaaggtaaagagagcctcatggtcaaggtgaatcactggattcagatgtttggaagtctgctcaatagagagaggagattaaatttggccacagcagttagtactgtgacagatttcttttccatatataaaatatgcttcctagagtcaacgctatctaaacatggactgggcccacgcagcatctggctcatccctggacgtgtatgtaaactgaggctggataagctttgggtgcagttatgtagagacttaagtcagtaaatggacacaatgcagtctgataaaggaaagagggtggaggcggggagacaatcaggaggagaaaagaggcagagaagtagaagcctgtggttgtggagatggtctgtaaccccaccgggagcagcagcatctgaactggttctccccttgctcccctttcttttgccctccagccaaaccagtaacaaagggcattgtctagtagtctgtgtcagcaataaaagccatggggatctgacccgcggcagtgtgtttcagcctgcgaacttcctggatatctttacggggaatcattcccggggaaggaagggcaggctggaaataatataaggagatcaagaaggaagtcgagcaagtgacacctttaaacaggccaagcgagccgggctcttccccctgggacagttagagttatgcagagctgtaattaacccagcagcccactggatatgtctatttcaccgcacaaaggctgttgaaagaaggattcttgaagaaagaggttccaattcaaatggtatttgagtaagtcccttgtcggatatactgtttctagagtttatggctataatcaacaaaacatggccattctttcatgcaggtttctcatgactttctgaataccaatctttagaaagaaaaggggaaaaaaaaggcatccagaattgtctaggggtagaatgggggaaagggaaggagggggaaatatggctcgaatcaaattaaggacttggttttcttttcagaggatgttgaaaacatttaaaaagcaggtgtgtccttctttcataaatgaagactctgagatatgtaagaaaattttcagttgtgtattcaagtccctcaaaatcattttatcaacctccctaatttcaattaattttttaacaaatattttttgtatgcctaccctatattaggcactattataggcgctggggatattaatatctctctcctgccttcctggagctaatagtggggagagatagacaaaaacgtttaagtatgtagactaattggtgtgtgagatgatgtgctatagagagaaaaatagcagggagggaaatacagtggggagggatgcaaggaaggccttgctgagaaggtggcatttaagcgaagatctgaaggaggtgagatgtggatccggtgggtgtatgcgtggtggggtcagcgggtggggagagacagcagtgcaggcagtgtgcacagggattcgtaaggtagcagtgtccatggtagtgtgtgtgaggaatagcaagcaggctgaccgggccagagtggagagggggagagccagagcactgggagatgagggcagagaggtcagttatggctggagtctgcctttgccctcaataaggcacccattcagttactcaagtgggccagcacacagtggtgtgtcctcccacatgctctgagtactggccattcagaatggttcccatcacacttaaaaccgtagagaataaaattacattgtcactgtgctactcttcacccttggatagtcctagagtcctttggcgtagcttttacatagtgtgccacatcccactgtactccctttcctgagaacagactgatggaccgagttacgatttatatgagagaaccccaaatcagaattcctagccatgtctaatttatatatcagcaggcaagttgttttgtttcttgtttgggttttggggcttctgttttggggtggggtttttttttttttcccagtaccgtaacttataatctcagatcatggaagagcattctctaatgagctttctaaagccaagagctctacccagttgctgggtaaaggggggaacatggagaattagaatgtttacattgtaactgatttatgtacactatatttgcatgtaagtgtactaaaatattttttaaaattaccagccattaaaaatgtgtttgctaatggggataagaatgctggatacaatgaggtaagctttgtttaaaaggatttaggagactcacaattcataatcaatatttcaacacactcgtctgcatttttagggcaatagatctgtaagtagaaacaggcgtatttgaagaaaaacattagtttctgagatctggccagctcctgttcttaccactctgtcatctctgattggattagacgtcacagaaagggcctcagatccttgtttcacgttaagtttaaccactccagttgaataccatccttgtggagctcagtggagagaaattaaatttctatcaccagaagtatggcactgaatcaggtatcaagggggctacatcagtaaacttcgttggctacaagatgtatgtccttcctgaggctctgtagctgttaagttggctctttccaatcacagtctgatctttcattttcccgtaatgcagttagacaacctagttattcaggcatagacttctctgtttttcattatccctgaataacatttgatgctgaaatagggaagacgggaaggacgggggaggggagccaagcatttttcacagcttgtgtgaaatgcttaatatttgaacgtctttaaaatatactgtacacatacattccaattttataagactaacataacatgttcaaaagttttatgaatttcagcatgtaaccagagtaaacgttagcctgttttaaataagccataatggcctggcaacaaacctgcatagttagcaaatccctcctctgtttatgggcagccattcctcaccaggtcactacaaaatacaagttttatcagtttctgtggactccgtaagttggtctgtgtactgagttcagcatgaatctggttttaagagcacaaaaccaagggcatcatgatgaggtgatatttcgttttgattttaatgaaatggcatgaatctgacttgcttaagaatatgtccaggcctctcgtatcctgtgggggcaacttggttcctaaatgccttccgtaagcacagggccacacagacgtagcaggcttaccccttcctcactggagtcaagagagtgctttgtgcctagaaaatgtttgtttttttggtggggcttttttttttttttttacttaggttggaagcgccccccagatgatgctttttaaggtaggatctcctcttaacaagtgagagcatcaaacatgctgggtcatgcccagttccatcccatcgtgtgtcctgggtctaaggtattagacacagtcatgcctctcaatggtgaaggttctatgttaccagatcatatatttcatggaaatctgctagctcaccagataaaatcctcccagcttcttcaagcgtggcagaggagagagacttcccatgtgttaaaaatctgctaaactttgcagccccaactcttttgcccgtagactcaccctggcctcagccatccctcaggaatcatctaccgtagaccaaactggcttcaggggatattccaacccctgatgtactctggcatcaaaagctcctttaattacaaataggacaccagagaacaggttggagcatttaaataagactgatctaaaggctgtgggccaaagatttctcacagagggcaacacgtaattaggtaatctgactcacaagatgaagtttactcgctttcattgtggtgccccccagggcagccttccccacctgccctctaggcctgtgtccttgtagcacttaccacttgtaagcccagccttctgggagaccctcagtcaggtccagatgcttccagaggccgactccagactcatccagtttcttctctctttgtcttataacagtcatggtcctcattgctccctaaaacatcctacttagtatttagagctcactatacatctgttcaaagcttggcttttggaagtctttattgtaccagtcttcttacctcctgaaataaggaaaatataagtataactgcccacagaggcatataaaactcctttccatttacctcatttattcgtcttatttaggggaagcgcagttcagggtgggcagtctagtttaagccattgagtctagtttaagccgttgttcaccatcatgattttatagcctttagttttattccctgtcagccatagacatccccagagatgcaagaactcatgcaggaaaacccatttaattaggacccactgtgaaggaccaggaaacagaccctaaagcactttatgacggaagctgttgatcaggaaacaggatgttttcctttccctgggtttaggtctggctcatactcctttggggagatctgggggcctgtctccatctccacggaaacagaacctgtaaccttcccagaatcaggttaccctagagggcagtgacatttatatctgcttttttgtttgttcgttgttctctttcctaagacatgtaagtggcaggttttgaactcctggatctctgcccaggggcctggcatgttgtatatctgccattctgatgtgtggagggcctcctgtctacactctctctgccccatggctagagacagctcattctgagagattctttttttataggaaggcaaagctcacctatccctaacatgcaaaaattttcacttgaggaggcggggaactggtttagtaaagatctttgcgtgaaattgaatccagtccttgccatccttcatgttcaactcaagtcctccttctataatgaagtcttccccagccagaagtgatctttctctttccattacatcagggccttttccacattcccacctttcccccctcatactgttgactagttttatttcccattagtgctttgcaccctagtgctcctaggtccatttaaagacctaaatggctgggatcacatcttctacttggttatttcccccacagcattcgatcacttataaactgtgttaattttccccacagtgcctcacatagagtggtgctcaattacaacttactaagtccatttgaaaagaaatacactgttggtcaagaaatctgtgtgctgagtgcttcaagggacacaggcagtataaatgagacatcctgccctcagggaatgtatagtctgagtggggataagacgaggccacatgaaaagtctactaatagcggccagggaccatggcttcctacaatacaagcactttgggaggccaaggtgagaggatcacttgaggccaggaatttgagaccagcctgggcaacatagtgagaccctgtctctacaaaaaactttcccaggtatggtggtgggtgcctgtagtcccagctactccagaggctcaggtgggaagactgttagagcccaggaggtgaaggctgcagtgagccaagatcacaccactgcaatccagcctgggtgacagagtgagactgtgtctctttgaaagaaaaaaagataaaaaaagcaaccagtaatacaattccatataggatctgggccagaaaaaaataagtactgattgtcatgatcatggtgatacgttagttatcttgggtatatacactgtttttacccatccccataacaactctacaaagtagatggtgctagacattcttagtctcagctctcttgtctttagagtgaggacaaatgattcgtccagtgagtacagagtgctgggattcagacagctctgtgagccctcacgtgaggctcaccctgggttccaatggctcagagcttctcctcttgcttctctctcattacccttgtgccctgcccactcccaacctttcaaatatattaaggaggattaaccatattgttcactgctattaaacaagaccagagacagagtctttccagcagaggtgacaccttggtgtctgaatgagaaaggagttgtccaaagacatctgccccacacagaagaaaattagacatatcacatgcctgctttgttataatggcataaaagtatgtgtatgttttaataagtcatgtactgagtgtactcagactatagcatatccatgtgtattacggtggttaagagctcatctctttagtaacaaacaggggttcaaattctgactttaccacttacaagctctatagccttcagcaagctagttaacttctcaggacctgttttttcattgataaaatgagtggggtaatacctagctcaaaaatttgttgtaatatttaaatatgaatgtaaagcacagtgcctgaggtcactcagtgaactgtgattgtggtgagcatactgttatatcccttcctgagccacagaacttgaatttgtgttcagagctggagactccagaacatctcccaaagggaagcaatttaaagttgaagtagcctctcccttctgtcagtgaggatgccaggtcttttctgagtttcctgtaagtcctctaggatatgttactttggataaagtctcactactttgacctgtggaaagaaattactgtccaagtacacaatttattttgacctcccaacacctttggacaattccaggctggctccaggcttcatcagaacaattatgtcctctctgtggaaaacattcctttcaaatgaatcagtagttactcaccttttcttttcccagccatatttttcagttgccaacagtgggatcagtgaggggtagtggtgtagctaacattagcccaatatagataagctccagattatccgtcatcttgtttgaaaaaaggcaggcctgccaaatttgcctacagttcccagtgagggaaagaaacaacaggttctatgaagaggaaggcacagaactagtcgtggaagtcacttttccagactccctccgttactcaggaggaaacaaacccagagtgtcttcttcaaggttaaactccctagaagctgatggaacctggccagaggctgtgaactttgcacagagggcatcatcagaatcaccctctgctcagtggatcgctgccctcccattactctgctggcacgtacctgatttggttgacatttccataattaatttataacagcaataaccctgagatgagcctatttataggtttgtgcaagctaggtaagaatatagattaaatctcagatcattaacatacttaaaggacttgggagagttttgtgattgtcaaatgatgtgattaaaaggcctccaagcttgatgtgtactgggaatccacaagtttactttccttgccaagctcagaaacaacaaaatagcaaaagataagcttacattccacccattcaccaaagatgttgggtcatccggggaactggaccagggtcatcactgatggtctacagctgctgccccacagatgaggatctgtgagcgtggttctgacccttgatatgccagcaagtgtggcaccaagagtcccatgggaagaattgctgtgactgtccacagcaatagagatgagtgtgagaagcacacctattagttgaaaggatgctattatgacctggactgctgtgcagacccaatcttactttctttcctcctttttatgttctgttgttctggttgttaaccttctgaaaagtaacatggattgcttttctattataaaagtaagacgtgttcaatatcaaaaataaaggtaagtacagagaagaaaataaagatcactcataattccaccacccagaaatacccactgctgaatttcagtgtgcatccttctaatagagtcttcattctgacatcatgctagtagaactgttctctggacacagaggcctcccattcaggtgcttgctttgacagatgtgtttcctactgaggaaagcatcttatactcagggggtgagaatccatccatcaagaagaaggaatgactaagggactccctgccttgcctgcaggaggctcttcaaaaaactaccacccagaagtagttccctctctctcttctttttacatttacccagaccactcaaccctatttatccttttcttacctgtatatgcaaatatgatggcaccaccaacgtcatccacctctttcgttcaagaccataacttcttttaaggctctcatgagtccttcacaccaccctccagcatagagaagggctcttcacccattattcccattactagtgttcaagacttgtttttttttttttgctccagttttttattagcaaactagctacaaaatgctgaaaatcaagttaaagttaatacatataagatcatcataaatgattgcacatgtacacagataattattactttcatttgttttattattttaatctacaaactttgagctctttaaaagtggagattagatgttatgtcgccagacccttaacttcgcacttggcataatataaatacttgattaatatttattgaattaagatgaaaatgaagagaaaatttaattacccagtctactttttttttttctatctcagtagttaagtgcagagaaaaaggaggtcatataaaaatgatgaaaaaatagtaccttagaaccatttttatggtgtatcagtgcattttttgtgctaaggtatcactgttaaccctagtgtggaccctttttaatgactttttaaaatcttgacgatgtccttttcacttctttcctaaatgaacattaatataaagccataaaatgttccttggagggttttatgagttactgtgttgtaaggttggggaaaggacacttggagccatttgttttatggagcttgattctgaagtccagcaccgcccctgacccttcagaggcacgctctgaggcatgaagcctttcttgaggacagtgagcactgccacttctccccgaaatacaccagccacactcctacacttgccacttccccggagtccacagtgtcaacctcaagccctgccctccacgagtagcctagacaccgtggagcagacgttactgatgatgcattgaacagctcttcttccacagtgcagatggattttccgttcaccagcatgaatcgcttttgccatatataatatcatgtagtacctgaaaaaaaaaaatgatgccaaagactagagatttggtcgaggacattggtttttctggctctttttgcctccggaactcttcttcagtttatatcagatgtggaagggaagcctaatctataaaacaaagatgggggtttgagtccccggggtttcccctcaccactgtgctaaccctaaatcagctttcaccacttacttgaaaaacccagggcccagagaaaccaaggtgtgagagtgtgaaaggtaagtgcaggacagatagacgataacgagggtgatataaataataatagcttacatttttttaggtcttcttgtgttccaagcactgtgctaaacacagactgtccccccaaaatatggcaaattgtgatgcctgaggcagagtatggtatggctgtctgggaactcttgaaaaggatattggattgcttgcaggcaagaaacaggccagattatcttggcagatctcgctctcactgtggttcttagcctttattacactgttggaatgggtttctcacaagtgatatcaagggaaaaaactagacggatatgtccagtgtatgtgtacgtgtgtgtgcacatgcacttaggacaactttgagccaggagtgtgagccggattagcacactgagttgtactttattctaacacatgcagctcagtagaagtctcatcttaagggacatatagaatgttgaggtagaaatagctcagaagaaagttgataaagtaataggatacgtgcttttgccaatctacatggccatatccttgcatgcttattttgacagaagagtcacagaacagagcaagttcttaaggctcattcattcccatttccctcttgacattttgagcaaaggactggagggaccaatccataaggggaatgcacctggtcatcttttcctgagcatcttgggatcaggtgctcttgggaataagatgatacgtatacccaagagcacttgatcagtcaggcagtgagtccatcaatccacagccctgttctgtgctggatcccatacctttgtacctgtgtggcaggagacaggaaggatgtgtggtggaaactccaggaacttagtccagctgaggagatgatacagacattggaaaacataatggaccaccaggaaatgataagcttaggaactcagagaacatcatttctaggatgaccagagaaggcttcaaggaagaagagaaatttaagcagtgcctcaaaggttgggtgggatgtgagttactcagctggggcagggagtagtctttgcagggagggaaactgctgaggaaagatacggaggtgagccgtgcacattgttcctgttggaaccacacatgtgtaaaggctctgagatgagtttagtgagagttgaaggctcatgttgaaaaacactgtgagaggcacacccagtacagactgtggcaagtgttgaatgcctggcggagaaacctagagccttttaaatagttctgagcagggaagggaggcaaggaaagcagttaaactggttcagctctcaggacaaatgtaaaatgaagggctcatgcttgtgtgtcagattgcaggtttgcttagaaagcacagtgcagggagaaacccgaaggagcaggattctgtcttctggagccctaaccaagggaggccgaagttggtgctttcattgaacgtccatgttctgacatgaataaatgccacgtcatgagtttgtggtcaactcctgtggtcaacttttaagcaagctttaaaacaacagcaaattgcttctatggaatttctcttacagcatcttgacattctggaaaagccagtgcagcagtcaagggagtaggtcctgtcctgtcatttacccaggcttcctagattcaacacatccctgtgggtcccgtcacacatctcaccctggcccatttaactgagctgggcctactgcagaccttcagatatttaatttgtaaacacttaataaagcactgtcagtaggtcggcttgtcttctctgtcggccacatcaaaatcaatacgtcccctgtgtattctgccatgattgtctgggctggggaatctaataggattaagtgtttggggtcctatctgacgccacagtccacagtcctagttagatgaggttaaagactggcttgccattgtggaggcacgattgcttaggggtctgaaaaatcattaaagcttgtcctcttaaacgttgattgttccctggtgatttattgacaaaacacaaaaaagtgctctatactgcactctaattatatgtatgaggccataagatctcatgggaaattaaataaaatttacagcttgatggttttatgctcctgggagacataccttcttaataagatcttatagctgggaatatttatgaggttaaagtccgtaggcttgagcaaaagacctaacctttccatgggaggtggggatggggtgcgttttgatttctttgaagataaatgatcgtaatgaaattttcaggggtttaggaaaaagtgttcagtaagacacatcaagcatttctccttaaaacctctggaggacaaagctgtaagggcacggggatttactgcgaccatttgtctcacataaggcccccatagtcctactccccacctctggggcacttcgtcctcctcctgtactctctgtggcttcctcgtcttattagcccccatcacactttgaaaaggtggggaggatcctaattaagggcaatgatgtaagaggtcaaggaagggaaaggaatttgagtaaggaaaagggagaaagactgagagaatcaatacatgttaagacagcccccagaggagtcactggacatttagtattttaacgggtcaccttctctttatgttaagggatggctgaggaccaggctcagattccacaaggattatcctgtgctgttctagacaaagaatcagagcatatctgggataagagggatttggggggagggcctctgcaggtgtcatgaagatgaagatgatatttatttgttacctttcttgactctgaatagagtgcttatcccaacgtctccgtgaatcctaaacgaagcttcatgcttgaaagtgggctgtttcaataagagtgaggagcatcgtttatgcagccccattcctgctgctttctctaatagttctgaaatggcaagaaggaggtaggtaggtagatagagagctgtcatatatatatgtgtacacacacacacacataattcctatgtattgaattatatttttatctactcaaaggaggataattgtgtggaactcaaagcggttgggacatgtcatatgtgatctatttttctgtttattttttctattgagttttttatatgaaatctgcatggccccttctttgtgtggggggttggagatggggagggcattgacagaagggttggagatcaagctttagagggacttggaacagatgggcacatcacctctctggggcccctgaatttgagagctctgctcccagccttttcccaccaggggagctcatgactggctgtcttctactgtgtgctccagtttatctccaagggtcaagcaaccccaccttgagagctccctacctaggctcatgtgaaaagcaaaggactatgtgatgaggatgaatggatacagcgtttgacctgctagggtgaggcaagtgaattgagaagttcctgactttcctcattgccaactagtcatgttcctcggcttccctcttccagaataaaccaaaataaaataaaagggactgcaaatgcccatgacttagatgtgttagagtccagcttctgtttcccccatttggtcctgattttcgaagtgaaggggagacaggactgagtggcatggtggtgagcaacccgtgtgcttagcccagcggctctctggtttgtcattgtggtatccctctctggaccacagtttcctcatctggaaaatgaagatctaaggctaggtgattttaaagtccctttcagctctaaaatattattttacagttgtaggatttatggaggagaacggcattccgctctatcccttgctttagccttttgaatgaaagtgagatgtctcatcagctcagatagagccagctcaagcccagtgtctcagataaaaggagaaagaaaaaaaaaacttattaaagatagctaagttcccttgataagcagcaagtgagaaatcctgatttaatttaaatatgatatttctgtcttcattaatttaaagcatgtatatgataatgtatccttttttatttagtggtctgccctgaagggaaagaaaggcttgattgtgaagcagaggggcaaaagcttgggtatattttaataaagatgaatatccctaaaaatgcttgaattattatggaagtaagatttgttgcaagttacaaatcaaagcctgaattgtcacttatctcctaatgatacttctacacagattattaatttcattttagaagcccaatgaatgttatattttatgacattgattaaacatcttgctgccatctaaccatccatccttttcattttcaaaaatccatatcggaatttaacaaaaacagctcataaatttgtattttacagcctagcaaagttgactggttctctactctacttaccctcgggcccattctgaactctgggcttgggccatttccactcttagaagtcagcttttccaaactgacatcatgttttgtggtcagagtagtacttggggatttgtttggaagagcacgtgtggcttctggagctgcaaagccaccaggggagttctgaggtggttggggttagcccctgacgggaactcagggtctcagctttcattctcattcttagacaagctagttacctccctcctcagtatcctagggataattatgccctccccagggggctcccagtgccactgtggggatgaatgagacagtagatgtgaaaggtcttcttgctctttagaggcaagcagtgtggtaatggatttaagagccaataaagaacagtgagattgtaggtttaggatcaaccttaggcattataggaaaggtgtaggatgacttgaaagcagggataaaagccttttgaaaatatctccaccatgttattatttatcaaacgtttgtcaaaagaagtacctctggacatagacagttctcaaaaaagatatacaaacagccaataaacatatgaaaaaatgctcaacatcactaattatcagggaaatgcaaagtaaaaccacaataaaataccaccttactcctgcaagaatggccataattcaaaagtcaaaaaataatagatgttgccgtggttgtggtaaaaagggaacacttctacactgctgatgggaatgtaaactggtacaaccactatggaaaacagtatggagattccttaaagaactaaaagtagaactaccattcaatccagcaatcccactgcttggtatctatccaaaggaaaagaagtcatatgaaaaagacatggcgcacacatatgtttacagtagcacagttcacaattgcaaaaatatggaatcaaactaaatgcccatcaatcaacaagtggataaagaaaatgtggtatatatacaccatggaatactactcagccatgaaacaatggcctttgcagcaccatggatggagctggaggccattattctaagtgaagtaattcaagaatggaaaaccaaatgccgtatgttcttacctataagtgggagctaagctatgaggatgcaaaggcctaagaatgatatattggactttggggactcgggggaaagggagggaggtgagtgagggataaaaggctacatattggatatagtgtacactgctcaggtgacggctgcaccaaaatctcagaaatcaccactaaagtacttatccatgtaactaaaaaccacctgtaccccaaaaaactattgcatttgtaaaaataaatttctgaacccttcaaaaaaaaagtatctctggtttcacgagactcatatgtgtgtttcctcaaaaccactgtgggctcatcctttccctggattggctcccattaggggaccccgtgtgttcctgtcacatttccttctttataattgtgatctttatgattgctgttcatttccatccagcgagggtgctggcacctggatcgccatgcagggtgcagctgtggccagctcttcctccaggaaggagacctgaagagacgtattctgagaagcctgaattcgactctacattgaaaaattaaggactggcaaccaaaggctgtcacttgttgaagaaaaaaaccttaattaaaaaataaataaataataaataaataaataaataaataaataaacctaatgaagctgagggtcaaggggcatcgggataaactgttttgcaagggttgatgacattaggaaaaataactctattaaatcagaagtctgcctctgccaggtaatccttaccaaaagtatgcaagaagcttgagagatcagccctagaaggaaaggtgccaccccagtcctccaagggcacagggcacaggggttagcatgtaagcttgctagtcaggctgctgaggctcacatcttgtctctcgctgtacccttggggaagttatcaaaccttgctgatctttggtttcttcatcagcaatagccctgtcacctagggacattgtgaagattaaatgaagtaatagtagtatatgtcaagtgcttattagtgcagtgtcaggccaaagttagtgcttaataaatgttagttgttgtttggccaggcacggtggctcacgcctgtaatcccaacactttgggggctgaggcgggaggatcacttgaggtcaggagttcgagaccagcctgaccaatatggcaaaagcccgtctctactaaaaaacaaaaaacaaaaacaaaacaaaacaaaaaattagccgggcatggtggcacatgcctgtaatcccagctacttgggaggctgaggtgggaggattgcttgaacctaataggcagaggttgcagtgagccaagatcacgccactgcactcccgcctgtgtgacagagtgagattccatctcaattaaaaaataagtaaaaataaatgttagttattgttgtcacgcgttggctggtagtctgtggtggtggtgctggtggtggtggtggtagtggtggtagtggtccttttggtttcgtttgttttgttgtttttgtattcccccccccccaaaaaaaaagaagaaaaggttgcatatcatcactttaaaagctgaagcagagcttttctaggccccacagggcctttccctgtaggcatggtggtaaactggtgtttagggacagagcatccttgagtgaggttggctgctgaggacagcccctccctatttgggaggcaagggagttggtatgataggagcgttactgggagaggacggtagccgcttagtgtgaagacttctccagcatgttgtgaaatgttcttgagtgacacattttgccctcctttttctgactcatctacctcatccttctcctttcctcccccgcgcccccctcccagccaaccctccatagtgtgctccaacactgg

SEQ ID NO: 238 - DNA, 104054 bp, Homo sapiens
agcgtgtctgaaatttcaatgtctgaagcatttccaatgatttatgtatctgattgttgttatctgccagctttcactcatccttttgcctttccttacttgtttggtaatttttactgtgaattgcttatttccctgagaactttgtgtgagtattgcttgtttttcctggaatttttaggaattctttgacacctgggagaaggtggtttttaccagatatttgattatttcatgcctctagtgaaactacctgtgtgagaccatcttatattctcagggtgaggtttttcttttcagaccattttatgtaaattaaggctttaaaactctatgagagtcagcttgtcattatgcattatcagaagagattttttttttctgccggcaatactatttgagatgagaaattttcattgcaatttacttgagggagagggtagtttatttttagttcatctagcactgaatgtgtagtaggtcttttgtgtatagctctgttgggatcttctactagatgtcttacctggggtgggggccatgtgctatgctcttgatccctggatttgtgaagacttgaagccaaagctgaagttctaactagtttgggaaatattcataagaggaaacaaaaactaaattttttttcttctctttgctttatttttgacctgagtattgcttactttctgtctagctcatggatgtagattagaataatattttaaacttcattctgtttagtttttaaatcgttttcagtggaagtatcagtcttagtacctaatctcccatggcataaggctggaaatagccatgatcctgccaaacacggacactctgcaacctggaacaaaatattctactctaaaaatcaagtaattatgtcttttttcaataaaatataaagtataatcattaatgtaatttacttctttcattccagtcttcactcatgctttcaaacatagattatattattccaacccttcttaagtggaattagtatttcattattccataaggttctacaaatacctacaaagaccatcatgaattccaggtgctctgtaacctgatcaggttggagaactgctgatgcaaccaaatttaatcacttaatgttcttactaagcactcatttgtttttctgcttctatgacttgctctcactgcttgctatcccaaacactgtccgtttgtacatgttccaatgtcaccattcctttttcgggcaaatgcttcaaaagctactgtttctataaaactttcctttacccttctcttttgacttgttatgagctccttttgtagtttgtaatctccttaagagcaaatttcacaaatgttatatttgtaatatcttatgtagcagagtattctcacagtctagaacagatggttcttctgtatctgttgaaagaaatgggaagatagcaaagcaacataataggataattttatttttgcctactagactatctcaggatgtatgtgttttaaatcctaaaactggttagtggtatttcagttgaaaaggtcttgaccctttcccttctaacataacaatcctcatcataagtgagagagaagattgggtgagtagggctcagtgggggaagctggttcctttcacccaccttcagaaatccaggtatggaatacaggggttgttctggacctcaaaattacctttttttttttttttttttgacggagtctcactctgtcgcccaggctggagtacaatggtatgatcttggctcactgcaacctatgcctcctgggttcaggggattctcctgcctcagcctcccgagtagtggggattacagggatgtgccaccacgcctggctaatttttgtatttttagtagagacagggtttcaccatgttggtcaggctggtctcgaactcctgacctcgttatccgcccgcctcagcctcccaaagtgccgggattataggcgtgagccaccacgcccagccacgaaattacctttaaaaaggtggtctttaaaaggcaaatagggagatactaattgcaaaaaaaaataatgatgaaataagttatctttctgttttccactttttctgtggtgttccttttgacatttgcattccaaaccagagccccacaaataactgagtttgcactcttttggcaagcaaggactgctctcagatgtattttataacttcagcttatatgggaagaacttttctttccagagacggtttcatagtaatatccttcaaaagctcacattgtagaatatgacttttttttttctttgttgttatgtttgctttgttttggtgggttttattcatcatttcagccagcttatagaaagagatagaacttttgttggatactaaatcatgtctatcaaaagcactattgaccttgtgttgttaaaactaaaaatgtaagaacaaaccattttctaaggtttttaattatatgcactaaaacagagtaaggcctagatttattaatcattgggttatggtttgatgtggaaagaaccagcctataacttttccctttgtttaacaacgttattgctgaaaactttaatagacttaagtgtactggaactagggagtgaaatcttatctttccctgaacaccagggctgctttgttatggtgtttccatttgtggcataatgaatgtgtaggacgctaatgatgtggtctctaggtgttctcctactacacagagcactgataatgagctgcgagtaatctagtacgagtccctgaagatgaatcctgattaccttcatggggccattccgctctgctcccttcctccttgatgtttctgtaaagagcatttggattttgaagagagtattgtgtatttgacttttaattagatttgcagtgtgttgggttaataaactagggcttcttcttcttcagtttcctctaaagggatgtgtgtaaatgttgcacagtgggccaagagaacagagggtcataacaggcagcaatggtggtgtcgcccacttcatgccccagtcctgaaaagaaggcttatagtggctgaaggttgatttcatcccatggtccatagttacaaatggcttccaagctgccaaggacctgctaaacctattgcatctgttctgtacgaggaagcagtctcagaatgaaatatgacagttgtctgtcagggctgccccagagtcctgcaagttggtattatctgcttgcgttcagaaaacacatcaccgtggctgaccacagctttgtacttactgtgatcttagggctcgcatttttagggacaacttgccctttatgcctttggtccctttctgccttctgcttttgtttttctgccagttgggttcatttatcttctttcctgtgtgttttgccatgcttttcttattatagctttcagattcatcatggacagagatagaaagtactctagtgtctttatcccacctcagctctcagtctggtgtagagctaagggaaggagaattgccttcacagtcaactttcagtgtggtccctgaactttttattttgttcagtgaatccagcacatctcatattgtgccccagctataatgggtagtcctttcctgatcttctaagaaaattagatgcctggcttctgccttgctcttcattgttttttaagcatagtccttacatgatggtccgggccttccttacaggtctaattgtgtggctgggccttccttctgcatgcctattctgttttttagtttttgtttttcttttaagaattggggtctcactctattacccaggctggagatcagtggcataatcataactcattgcaacctcgacctcctggactcaagagatcctgccacttcagcctctcaagtagctgggactacaggcacacgccaccacacccagttcattttgaattttgtttttgttgttgttttgagacagagtcttgctctgtccccctggctggagtgcagtggcacaatctcggctcactgcaatctccgcctcccgggttcaagccattttcccacctaagccttcttagtagctgggattacaggcacatgctaccatgccgagctaatttttgtattttaagtagagaagagatttcggcatgttggccaggctggtcttgaactcctgacctcaagtgagccgaccgcctcgacctgccaaagtgctgggattacaggtgtgagccactgtgcctggcctgaagttttttttttttttttgtagagacggggcctcactgtgttacccaggctggtctcaaacttctgggcctgagcgatcctcccaccttggcctctcaaagtgctgggattacaggagtgagccatcatgcccagcctgcctatcctattttattctgaggctactactactccttatgggtagatccaaggatctgacatcattttcatacatcctgttcagtgtgtgagtatagaattgaggtaggctgacaacacaaaagtgggcagaggtttcccactcatccccgacagggattctctgttggcataggtgggctctggtccaactcctggccgacatgagcatggacaatgtggcacagttgtggctctgcatcttgtgtgtgactgctgccctgtttttgtttagcaagctgctgtgccaatttactatgcatgttgttacatattctgctctaatttgactgccattttgcttcagcgagacgatgattgtttatggcagggctgtaatgtgttgtcagcacaggttactcgctacttgttggcaatggcctaacattgcctgagacatggtgtcactgtgaaatggtttgacaatgttgagactgtagttatgttgagcagtaacaactgtagaggtcaagaaagggcatctaagaggaactgtgttcataggggaaagatggagaaggaatactaagtaggacagtagcaaatgtcatcaaagagcttcattttcacgcaattttcataattcagtctgttttctgtgaacagtgttggttcagctgttgctcgggagtagaagcacatttctgagttagaaatgaattgtgctgatcatgaccctatcattttcttctttgaacatttttagaaagttatccagcttgctgaagaatgcactagatccttgtccatgtgtgaggcaagggactcattgggccaccttcacagggtttcatttttggaacatttatctaaggactatcttactaccctgagagaccaagatgtaggctaccttaagtcgtatgaggctgctgtgaaaatggcatttgtttttttggctctaagaaattttcaggacctagtcaagcatgtgacaacaaatatttaatgatagtggacaaggtaaacttcaaaagtgactagaaacccttgtggaatctaagacagagggactctaacaagcttgatgacattttgaatacgttttgtattgattactgactcttttcccaataatctgtgaagctggctttctgtttggcaaggcagccccaaaaggaaccttcatcccatacctccatgcaggagtagcacagaacagcacccagcatcgggccctccagagtctgggagggttcggttgtctcatgaattatgtggtgcccttcaggaactcactttgacctctgatgcctttcctttcaagcaagtggtgtggaaaaatattaaaactctcagtaatgacagtttccagatatgcatatctttgagtggacaatgaaggcaacatttatattctgtccacgatgcgagcatggtatgcattctgcagctgtcacagagccttccttctggtaccaaataccttacttcctgacaggtatgacctctgagacctccctaacccctttctttcatttcatacaaaaatctagagcttggcttttttttttttccttctttttttgtaaaaagaggtttttccattttaaaaagccttttcagttcttaaacttgatcattgatatgttccacctcatcaaaaagaggagtgcagctaaactgacaatcagttcatgccattggcctcactcatcatcatgtcaaggacctggcatgcccattgagaagggcctctgtgcattctgtcctcaccaagcctaattccttcccctgttgatggttttgccagattctttgcctgttgatgcccatgccagggccacggtgcttatgccaaagcctttgacagaatgagtcaaatctggtgccagtcacccttggcatatgccaccttgttcttgaccacttcctaccagggatgggctgaaaagaatagtgtctgctaagagcttgtagaggacttttctgttaagtgctaagtgttgacattactccagtttgaatcagatcatttggaactcttgcttggatctctcaaagctgttgactcatttgtatcttggcctcacattagtggggtagataggagccaaaaagtttgagtgaagtcagaataaatatattttaagtgtggatctgtggagaagaaagaggtcccaagagcataatgaaaactgtggttaaaactgtgaatcaagaggtttgttttaatttgccattttcttacgaagttttaaaatattttctaataaagcttcttatttattgccttagtacattttctgttacttataacagaatacctaaaactagataatttatggccaggcgcggtggctcacacctgtaatcccagcactttgggaggctgcagcaggcggatcatgaggtcaggagatcaagaccatcctggccaatatggtgaaaccctgtctctactaaaaatacaaaaaaattagccaggcgtggtgttgcgcacctgtggtcccagctactcgggaggctgagacaggagaattatgtgaacccaggaggtggagcttgcagtgagctgagatcacgccactgtactcctgcctgggtgacagagcaagactccatctcaaaaaaaaagaaaaaatactagatagtttataaagaatgggaatttatttctgcagttatggaggctgaaaagtctaaggtagaggggctggggctgcatctggtgagaggcttcttggtggtggggactttctgaacagctccaaggcagcacagggtgtcacatggtgagggggtgagcatgctaacatgctagctcagttctcttccttttcttataaagctacctgtctctcaatattgctgcattggagattaagtttcaacacgagttttggagggggcatttaaacgatagcatatatatagtgcagcagtcccactcctaggtatttacccaagagaaatggaactatatgcttacacaaagacctgtaccctttttacactttttttttttttaagacagagtctcactctgtcgccctggctagagtgcagtggtgcaatctcggctcactgcaacctccgcctcccgggttcaagcgattctactgcctcagcctcctgagtagctgggactacaggcacgtgccaccacagctggctaatttttgtatttttagtagagacaggtttcaccatgttggccaggatggtctcgatcccctaaccttgtgatccacccgcctcgggctcccaaagtgctgggattacaggtgtgagccaccgcgcccggccaacctgtacactttttgtaatagccaaaaactggaaagaagcagtatacattactaggtgaaaattacagcatatagagataatggttatttctaagcacaaaaaagaatcaaactgatattcctaacaacatggatgaatttcagaaacattgtgctaagtaagagaaggcacacacaaaaaggtacatacttaataattccacttgtgttaaattctagaaccaacaaaacttatctgtagtaacaaaaagtagttccatgttcacctgggtgcaggggtgggaacactggctacagagttgcatgagggaacattgtgggtgatggaaatgttgtttcttgattgtggtggcagttatatagatacagacatatttgtccaaactcatcaaactgtatacttcaagtgggtacattttttcttttatgtgtattatacctcaagtataatgaagttgattttaaaaatatatttgttgtaatcccacttttgccacataaacagggtccagagaaatattaggtattccttctctctctctcatgtatatcctgatcaaaacatttatatgaacatattgaaatcagatttaaatatcagtttccctaatggactcagctggactcaagttaattgacttaataaaatttcgaatctcatttgttcctattttctcctccctacagttgttatctttactgttatttgaaggacttgaataagtgaattttgaattcagataatacactatagggagtaggaaagcagacccctggcctcaggagcgcctctttgatcatgaatgtctatgactgccattttgttctctagattcatgtctttatattgtctatttggcttatagttttttctatcaccatttttgttttcaactgttttttcactaaaagacaaaatttgattttcatgctattaatttcgtactaaaaagagcacagcaggcataattaaagcattttaagatgtagtaatttgatttaaaatattttactaagcgatatattacaaaaagttatttaattatctgtaaactttaaaagcaggtattagcattctatggctattgtctttaataattacattttaattttaattttagttttttaaatgtatgtttctttttgttgttgttgttctgagatggagtctcgctctgtcacccaggctggagtgcagtggtgcgatcttggctcactgcaacctctgcctcctgggttcaagcaattctcctgcctcagtctccggagtagctgggattacaggcacctgccaccacacccaaccaatttttgtatttttactagagacgaggtttcaccatgttagaaaggcttgtctcaaactcctgacgtcaagtgatccacccccctccgccttttaaagacctgacatcttagttgttactgtgaaattgattttcttgttttctcctcatcttaaccttgttttatatatcaaagtaaagaagaggaactgttaaaacttatatgaagtatggctgaatcttcaaaaagatatcaaatatttagaaactaattttaagctgcatatgttttatgaatggtagcaatacaatttataactgtcatttctgaaatctccggatttaggtctccattgccaaaaaatgtaaaaaatagaattatgacaagtgatctcttgaattaaaaccaaatgtttttgtattacaatacctgtgatgatgattccaaacaggcttctctttaataagtggccacagtagagtcatgatgttagcccttatatttataatgaggacaattctgggtcaccaagggcctggatatgggacccttggggcccactgtgatatttatggacatgaaatacagtcataggccatttatcagatttatcaaatttggaaacttccaaataaattaatttgacaaatatacataaacttcagtaaattttattagttttattttttgccctgtgtatttgcataaatgttactaggaaatatatttaataaaagtagaaggattttttttttttgcgtgatactcagctatattcttccaatagttgtggaacagcttagtgccttcagcagtggcagtctcctaaaacgattgtctatcagttaaaggttaactgagtatttggaccaagtagcaaactagaattcttttcatctaatctctgtttaatatagggatatccaatataacatccttgggtcagtgtagtacatcttacgttaagttttgtctctaatgaatatttatattacataaatgggaaaattggtgggttcccttggtagaaacatgatattggtatttttaaagtaaacttaaataggtcagaatttttatcctctagagaaaatttcacgtctgattaaatagtttacataaacttaatctttttctgctagatgcattataatctcagatattattcatgtagctattcctctgtgaaccataaaatgttcatttcttcaaaatgaatatgaagctcaaagcattagtggtcttaagagcataaaaactttattactttgtgcttcacatttttcaagtgactttggaaagccgaaacaaattttgcatttagattaatggaagatgttttccatgtgaaggaactggcaagggagcaacaataacaaaaatcccccaaggttaaaaatgtagtgcttttgattcttcccagaactgtgttagcagaacaatcatttctcagcatggaaaggtatcataattggtctatacagtggcaatactgaaaacgagtatgcttcagagaaagctaatatgactctacttaataatttccttcaagagcctgaatttgaatgtatgttccacccagcttgaggcaaacaatttgttcctataagttctagtggaagttaccggggggtcatgtaatttatttttgtcttgaagttttcaaaactgtgtagaaataaagacacgtttacttgcattgttccactagtaatttgatccaattggcaatgctcctttctcttcttctcaattctattatgttggaagagtggaagcgttcataaaatgttgtgacaaacaattcttcctagagacgtttcctctttctgtttgaacctctgatccacttgcgaatgttagcattctttttgtttgtttgtttgtttttgagatggagtcttgttctgttgccagactgcagtacagtggcacgatcttggctcactgcaaccttcacctcctgggttcaagcgatcctcctgcctcagcctcccgagtagctgtgactacaggcatgcaccactacacccagctagttgttgtatttttagtagagagagggtttcaccatgttggccaggatggtcttgatctcttgacctcgtgatctgcctgcctcagcctcccaaaatgctgggattacaggcatgagccactgcacccagccaaatgtttgcattatttagtaagtggttttttattatgggtctttacttacatgtgctgttattgtccttttcactgggattatctaggttttcaatctgtttctttgtattaattttttggctatgggactagttttaaagccctaccacagaagtagagggtctgtagttggagtacggtgagtaacatgagagaatgtttcctttttttccttgaagaatggatagttttaggggaatgtgtgcagatgtcagaagatggctacatagagaatgaagcatcagaaggtagacacaggtctctgcattgcaaatatcagtaacagggatgaagaaagaacagcaaaatttttagaaaaagtgtaaaggatggttagacacttagaccctctcttttataagtttgattgtgtacttctaagaagcagcaataagttgaaggtaaagttatctcaatactctgataagatgtggtctctggattcataccaaacattagagttcaaggcattccccttcagtttattttatattcctcaaatgtatctaattccttaggattaatgatttgtttctcttaaaaacagcatttattgctttaatctgagaaaaaaataagacttccagtgtttatatctacaaacacaaggattgaaaaaaattttataatcagcctcgctgctaattcttataggtgaagcaatgacttagaagaatggggagactggagtacatgatagttttgtagacagccacagttggcaaaagatggtggtgaggctgtccccgttgtaaatcctttatctccatgagagcaactgttgctggctagtttcttgtgaattaagtatgcagtttgtcttttttttaatgtgataaatgaacgtattttctaactggctatttgcttaataaaaatgagtaatataataaggaattaggggagcattggaaagataatcactgggaggtgagaaaaaaagttatctctctgcttcagtcccttattctcatctttatagatcagttctcccagtgagaagccaaatgggatgtcattctttgtttgtttgtttcattaattctttgcaatctatagtaggactgttgaggagaatgtataaactgcaggttaccagcaggtggaaggaggggaatgagggcaggtggtccataagcagaaatattaattcttgactgattgggacagtgaatattgaccaacattgaaaacattatattatggtcttatttaggcctgaacactgacagccagttgacaagtctaattttttataacttaaatgtggttcatttaggaaaaactgccatcaagggcaattcaattctattatgacaattaactctgactttgaagtaagtagaataaatcagtttatttctcagtaaggcccaaataaactgagattgttgtgaaaattatgcagtttgtgactacagtgtggatgttgtgtgttgggttgtgcagtgtacaacctgcaaagctgtatgaggcaacctggacattctactcctagctatatacccaaaagaaaatacatgtttctacaaaaccttgtacagaatgtttatagtaccatcattcataatagctaaaaagtgaaaacaacccaaatgttcataaactaataagtggataaacaaaatgtggtgtatccataaagtagaatattatgtagccataagaaagaatggagtaccacacgtgctacagcatggctgaaccttggaaacattatgctaagtgaaagaagccagacaccaaacggcacatactgattgtatgagtacatttagatatgaaatatctaaaataggtaaatccattgccagtggctgaaatggggagtgattgcttaatgggtatagggttttcctttgggggtgatgaaatgttctggaatcagacagtggtggggttgcacaaccttgaaaactactgaaaaccctgtgaaatgtacagtttaaaatggttaaaatgatacattttatgttgcataaaagaacatttaaaaaaattaatccagtggggtctgatggcaaattgacatgagggaacttttttgagggtgatggaagtgttatcaatctagattagagtgatggttgcacaactgtataaatttataaaaactcatcaaactgtactcttaaaatgtgggtgtattttatggtatgcaattatacctcaataaagctgtttaaaaaaaaccctctctgagtcattactgaaatcagtgccattttctgaatttcagaaatatcaaaggagagctttcctagtgtgaatttatcataaataatgtttggtattttttttcctttgacttaacgagagcctgagatgcagaaacaaatctgcacttccatgttgtgttacccgctttgggccatggcccatttgccagttgcagattgcctccttgtctgaaaatgggtgtgtttcttcatagtaactctcaattctattgttggtgacagcgcaataatggaactttcttctgtgtggataagccccttcagtgatatttgcaaatcaaatcatatctgctttttgtgctacattgtcctcaaaatcttctgattggtttggttatagacatccctatatcagctttcctgttctctttcagtttaaatatctgtatgctgtagcaaattgcattatgaaatcctctcacatttatcgctgtttagtgcatggaaatggcatttcctcattaccagtcaaagataaactctaaatgtttctttttttttttttcctgaagtatcaaattatgtattcaaaaaacttttctctatagcattatttctctgagctgtttcttttttccctcctgaatgctgacaccagatgcagtctgcatggacattagtcccagggaaatcttgtcttctacccaggacaaggagattataggaagcaatgctgactcttgttgtagattcacaatgtgctgacacgataataggacatgaatgggcttttggaatgccttttcctttgagctgggctgagagggggacagaggcagacagctccatggcctgaatttcgttagctgtgtgacaatgggagagataagtagatgtgacagttatgaatgatcctctgtcatgcactttcacgttcagattcagataaactgacactgctgtcaaacacaagctatggagagctgagacctctgatgaaccttctaatatggtaaatgggagtcttaattcttcattaactgaaaaaaggagatttggccatgtaattttctccttgctgcctgttttaaagattccaataacccagcatttacagttgactaggcagggattgcttttccccccctacacttgcaacatgcagactgtgaaatctgaggaaacgctgcttaaacccagacttattgccttggttatctttaatgactttgaaatgtattggcctcattatggaacagtgcagttatcaattcctctaattaggtgatgtgctcccataagaaatttaacattaaagcacaaaaatgaactcgttagaggcatctattgctgggaacttcagtatcaatggtgaattgaagatactgtgtttcgttaccaactcttctgcaccatacatctgactcctccttgaagactagagcatgggcatttttttctttttccttaagggtttaatcctcatatagcacctctaacacctttgatgacattttagtgcttctggatagtaaactgtgtgcctttgactaaatcgactaggagtctagggaagggaggaggtgagcagtttacatttaaatgctccacatatcagcccatctttctttcttggaatttaacccatggctatttactctttcttatgtaagtccaataaacttcctttctataagtagcttagtacagtctttgtttttatcacgatagggaccattatttgtttattaaatagtgatgctgtttcactcataaatatttcagctgtatttctagagaagtaggatggggtttctgggtttaggcttcagtgaagggactttaagtctcttaacccttctttacctcaatcatccatctgaacaaaaaaaatcattatagcctcccctttggggaaactacatagtttaattagtgttttctaataacttacaaatccttagagaaaagttatagtagaagcataagaaattatctttggggttagtttattattattgctattattatcattattactatatgggactagttgtttttttaaattggctacttgaaaatgtgtttcagatctcatggagtgaaatttacctttcatttaccttagggctcaaataagagtatactgaatataaaaatatggaacactaatttctttaaaatacctgaacctattaatagccaggagtgttaacttcgtcacctggaagaagatcctgtcctaacttgaaaatgttagaatgaaaaccttaatcgtctcctctcaaagggtcattgaggaagctgggcttgagtctgtgcagctgttcttcaataatgttatatcattctgaaccaattatcatccttaacccagatttgctttgaatctctgtggcatcttgactactgtctataacaacggtgattgccagacactgcctgatgctcaggtttctatcaatcctcttcttctcctcacagcaggtaggagcttcttggtgttccgctccttacccaggcttgaggaatagtcctactttttgccatgatgccttgctgcagttctggctcttcccttgtgctgttgttctctttgtcatgcaggtttcccagtatcttagtagaagccttgaacaattcctattaccttttcagaccttccttccaagaactgggggatgggggtgttctggtcttgtcacaggtgggtgccacatgtaaggacccactggttcatgggattctttgagagagtctgacgctcacttgtctgggttaaaagtctggtgctgacacctgctttctgaatgactttaagcaagttatttgacttctctttgcctcagtttcctgcctacaaaatgaagataatagcgcctgtcttatcaaggttcttagagaagattagatgcattaacacatgtaaagcacttagaacgctttaagtcacatagtaagcattaataaatatcagttgctaacagcttttgcttctgctctgttaccattttactatctcacctctctcatagcccataacagcaaaccaaactctttggctcttggtagatatattattcttaatgtttgagccctactatttgctattgcttccttttttactcctataatgtgtgaaattgaaataaaaaacagaattgaggccaggcacagcagcttgttcctataattccagtgctttgggaggccaaagtggaaggatcgcttaagcataggagtttgaggctgcagtgggctatgatagcaccactgtactccagcttaggtgacagagcgggaccttgtctcaaaaaaaacaaacaaaaacagaattggtcaccatgatattaaagagccatgaaatatattagcatgtcttttttctgcctatcccctctatcctaaacattccatgtagtcttgggaaataaattctttaaggtaggccagttattatgaatataacatgattatctattgtgttatgtttactgggttgatgccaaggaaaaatgaatatggcaggtcccagcaaataacaacaacaacaaaaatagtattgtctactatttcacagagggtgtggagttagtattgggttttgaaggatgaataggagtttatcagatgaggaggattgagaagagcattcagggcaaaggtatgtggaaaaattggtgtggtagtacacgccaatcctgggaccttcaagttgaacatttaggagtgtagtgtttatgtttcagaagcagaggatgagtggagagggcagcaatagaatggcattaagacccttgtacagtatactaaggagtttggacttaatcctgtgggcatgcaggaccctttgaaagatttgcagtgggaaagtgatcggatctgatttgctaactcattgcaatggctctgtggaagaatatcttggagaggggttcaagacttgagccaggggacatatcaagtagtgtttcaaatgctaactaccccctcctgcttctcacattgctaaatagagtgcagcagaatgaggtgtacttctgaagacaggtttttgaatcagctttccagcagtcccttgagtacattgagagggtgcatggagggaagacatatcatctttaccctgccctctccccatgttaatctattaaaagagatgggagcaaagctgctatcacattgggcttgactgaagacagaagtccttgagcatccttcccctgagtgcgggcaagcctcgtgcttgcagaggagaggagattagaataacatcttcactcttcggtgagagggcaggcagaccctcacactagatggttccaccccggagttcaggcttctcctgacaagtgttgcgagcatctgatgtccttggcctctcttctgcactgcttaccttacagcagttaagcatgagggcattctgtgtcttcctttctttcccttcagttgcttaaagaagatgagaatttgctttaaagaaaaatattaataaatctttataaaatggcattaaatagaaaatctcacactcttttcttcagaatgcttttcttcaattgccattgtatctttttgccccttccaaagtcttaccaattattattaatatatattatcataattacttgtagaaaatcaatagaattgcttgtctttatcagcagtgctacctttctacctctctctcccttttcatcctctcttcgtctcttgcgaattgttgtttctgggggtattattattgtaattacggaaattgataaaaataccatgacaatttcatgcctcagaattattacacagggtttataaaaaaagattattatacatcaatgcagtatttgttattcctaaatgattattccagaaatactaatcaaaaacatctccctgcagaatagtactgtggctttaatatcagctgctgtttctttgaatggggttgcccaatctttcatcaaagaaacacatcacccatatccctgtctttaaaaacagcaattatgtgtaaatgcctcctgatttatttgagccagggccactggccagtatgagtcaccacaatttattgctaaccgtcacttttacatgataggtctgtaacaaatatctgccgcatattgttaaattaatcttccatttaaaattaatggagttagactccccaggttcaatgtaatttcatgttcacgggcagggagggatgtgtgctgcatacaaaatgagacaaggcccaacgccctaatctttcatcaccttgaacctggagactaggacgcgtctcagcaccaactaatgagattgagcctgcgtctctcctgaggatgccggctcaaagaggcttttctgctcagaaatagcaggctctgtcttattttaataattcctcagatatgacaagtctgatgttatgtatgaaagagccaggcttgaaaaagagataaaatgaattttatatcattacttcaaaaccaaaccaagggaagtgtgttgtagttaaattaaaaaaaaaaaaagataggacacattttagtcatgaaatatactgactgtaaaccaggagtcatcctttcatttattttaatgcacaatcaccttagatttctcttctgtaatttttaaacctattcatgcgttaatcaaaataatgtggatgaaagcaggagcttgttcaataaacatttagatgaaaatatcagaggggacatgtaattcctgatggggtatgtcatactgaacctctgaagtcccatcgcttcttttggtggcatcttttgaaaatgcatcttttttctgtgtaccactaacctattactgtttagtctcttagactttaaaaatgcctaagccaaattactcaggggtattgggttctctcgtttttttttctgtctttttcacaaaccaggtaactattttgcatccatggaaaagaaggttttacagaacagatttcggctctcatacatctatagtacttctggcaaatggttgctgtttttttgtttgtttgtttgtttgttttaattcttagggaggactgagccccagagacaatgggacccttttcctaggtaaagaaaacgtctctagaaagacactaagttaagagccaggcaaggtggtgcacacttgtagtcccagctacttggaaggctgtgacagagaattgcttgagcctaggagttcaagaccaatctagacaaacatagcaagacctccagataaggtaaacttcctggtttttaaaaattctgtgagttgagttctgcttcctcagaggggaattctaagtatctgcactttgtgtctgatttatttattttatttttttgagacagggtctcactctgtctcccagtctggagtgcagtggcacgatcttggctcactgcaacctccacctcctaggctcaaacaatcctcccacctcaggagggagctgggactacaggtgcctgccacaacacctggctaattttatatgtttttgtagagacaggatttcatcatgttgcccaggctggtcttgaattcctgggttcaagcaatctgccggcctcagccactgtgcctggcctgtgtctgatttataatacaacatatgattgattttaaagctcttttttgtgatttgttgtaatttgggaccacaataattttttttccaaccccttcttcagacatacataataaaatttctaaagaagtagtattggtattatactacctatagcttttattattattattattattattttactggcattctataacttagaattctattttcttacaatctttgtatatttaaatgaacattagggatagaaaaaatgtaaactctaatacaagaatcaagtatagtcacttaattgacacgtgcagttttaaaaattatagtcaccccttggtatactgagggaattggttccagtaccccctcaccttcacccccatatatattcaagtcctgcagtgggtcctgcagagccctgtgtatgaaaagtcggccctctgtatgtgtgggttttgcatcttttgaatactgtattttaaatctgcatttggttgaaaaaagtctgcatgtaagtggatcaaaacccatgtggttcaagggtcaactgtgtatcactttgataggctatttataagagaagattttaaaaatattgctccatgtctgtacttgaataagatttagaaaatcttaggggtattttagaaccagataaattagtaaaaataatgatactgtaaattggaaaataaatgaataatagtagggcatctttctccatgaacctgaattgctttgctttcctctcttttgatgtctgtaagctgttgcgttttgtacagtgggcctcagggtgcttcgtgagtcccaaataccagatttctttttctctcttctacttatagtatatttgccttaagttcttgatattttcttctgccctcttttcttcttttaatatcttcagcatttttcttcttttttctttctctccctctttccttcccttaaaagggcttctttattttatatagaaactcatctttttttgttttgagacagggtcttgctttgttgctcaggctagagtgcagtagtatgaatcatgactctactgcagtctaaacctccctggctcaagcgatcctcccacctcagcctccaaagtagcctggacctcaggcatgcaccaccatgcccagctaacttttgtatttttttagagacagggttttgccatattgcccaggctggtcttgaactgagctcaagcaatctgcctgcctcagcctcccaaagggctggggttacaggaataagacactgtgcccagccttcaatttttttgttattgttgtgagtgagtgagtgagaaagagagagagagcgcaggttgatatgctcaagcttaaggtctgtaatgggtttaaagctccaagttttataatcggaatggtagagacggaaaggatctctgatctaatccatcctccatttcataggtaatgccatggaggcctgaaaaggttaaggttctcaaagatcaaaaatgtatccttttggaaagtattatagtggttcctcaaaaaaatttaacagataattaccatatatgattcagcagtcacacttctgggtatataatcggaattaaaaacagggacttggacagatacttatattccaatgttcatagaagcattattcataatagctaaaaagtggaaacagtccacatgtatatcagtttgtaaatgaataaataaaatgtggtatatccatagaacagaatattgttgttacttttgtttttgagttgcattttattctgtcactggggctgaagtacagtggcacaatcacacctcgctgcagcctcaaactatggggctcaagaagtcctcctgcctggtactacagacatgagctaccatgctcagcctggaacattattacctagccttaaaaaggatgataattctgacagtctgcaatacgaatgaatcaatgtaatttgaaaacattatgctgattgaaataaactacacacaaaaggataaatattgtgggatttcactgctatgaggtacctagagtagtcaaactcacagagacaaaaagtcaccaggaactgggaagaacagtgggatagggagttacccattcatgggcacaaggtttcattttgggatgatgaaaaagttctgcaaatgaatgttggtgatgattaataatgtgaatactcttaatgccactgaccatatacttaaaaatggttagaatggtaaaaaaaaatttgtatatttgccacaataaaatacacagacactggtatgatttggctctgtccccacccaagtcttatctcaaattttagttcccataatccccatgtgttgtgggagggatctggtggagagaattgaatcatgggggcagtttcccccattctgttcttgtgatagtgagtactcacaaggtctaatcattttataaggggcttttttcttctctgggcactcattcttctctctcctgccaccttgtaaaaaaggatgtgtttgcttccccttctgccatgatcgtaagtttcctgaggcctccccagccatgcagaactgtgagtcacttaagcctctttcctttataaattacccagtcttgggcagttctttatagcagcatgagaacgtattaatacagacacgcacacattcttttattacctgagaaaatttctggcaattagtatgtctgtcctcctctgcctccatctctgtagctaacatttggacattcctctgtttcagtttcagatttgctctcataatgtttttgaatgttacatctttccctttcttatttcagttttctttttttctgacattgagtacgtgctttgtgatagtcactagagatacaaatagctcagaatcaaagaaagagtgtacatgaagtattttcaagaatatgcctataaaatattcaacgatttctcagaaaatatcaattgtaaaataaataaaatacaacaaaactttcttatttgcacaaatgcgtaaagtacatgtagtctaatttaagtagtttttattttttttctctaaagtaaattttgtgactttttttttttttttgagatggagtcttgctctgtcacccaggctggagtgcaatggtgtgtgtgatttcggctcactgcaacctctgcctcccgggttcaagtgattctcccacctcagcctcccgagtagctgggattagaggtcccagctaccacacccaactaatttttgtatttttagtagagatagggttttgccatgttggccaggctggtccctaactcctgaattcaggtgacctgcctgcctcagcctgccaaggtgctgggattacaggtgtgagccactgtgcctggcccaattttgtgaccatttcatataatattataagtattcctttactaaggcaacctgttaatataggtctctcagttgcaggcttttcttattctatggattgactaagaagcccccaaaaatccttatgaggaaagatagagtcatgtgtcataagagaaggctagtaataggcttgagtttcaaagaaaagagtttatcagactgaggagtaaagaacgttggtaactggccttcaaaagatagttaagattgcatccggaaagatgtggggaaggggatgtaaaatggatagcaaggcaggatagcaacagggcattcttggaatagacaaccatccatttgttctcagtgtgaaatatacatggttttgtaatgggaattaaggccgaaatggcatgtcaaggccagtagttgagagctttgtaggtcacattgaagagtttgtatttggagtttgatggactcctaggatggatctgtccagtggacaactggatttcagacctaggagagcctctatagaggtattaattgaagcctttggatgatcgagattgtgaagatagaatataagacagagcctcttgagcatttctcccttagtgagaagaaggtggtgatacacagaaggaaccttcagcaaggtgagaatgatagataaaggatggactttccccaagaaacctggcaagggagtgatcaggagtgttaatactgtcacagagactttaaagaggatcacaaatgaggggaaaccttggattttaatcttgactcttagtactcaaggaaactgcatgttaagatgtggtaattaaagtattaaaatattctaagggtcccttgcactctccctttctgtgcccattgtgacagcatggtcacatcattgcttgaggcatgcaagagtgctttattgaagatagtattacggggggagattttattttgatagagagtaacaaatagactaataatctatcttaaagtaagtatcttaaagtcagtaggcaaaggagaaaaaaagatattgataaggaaagcatctgcaggacagattctagatttctgttttttgttgttgtgtatgtcagggcccagactatgtaaatgatagggcaaaatgtgagtagcaacatagtcttattagaaacctaaatatctacaaagagagcaaaaaactatcaagtcaagaatatgttacccattttagtaaaaaggttagatttcatttgccttgtgtatttgtgtgtgtgtgtgtgtgtgtgtatgtatgtatgtgtgtgtgtgtgtgtgtgtgtgtatgacagtactgtattaggaatgcttagtaggcatttggagaagttttgggtgattggtaacatgaaccattcttccctttaatctggtgcatctgaacatattcctgggcagaaggtatacctgtgcacattacagacgtttgtgggtacttttatttcattatcctcaagcaagaatacgagattgctatattctacattagaccaacttgttcttagcaagcacagaataataacctttcagtgtgaatgtttgtacataatagtagtaggatgtattttgtggtattttttaaatgaggattcattttaggcttggcacagtggctcacgcctataatcccagcactttgggaggctgaggcaggaggatcgcttgattgagcccaggagtttgaagccagcctgggcaacatagtaaaacttcatctctacgaaaagtacaaaaattagctgggtgtagtggcacatacctgtggtcccagctacttgggaggctgaggtgggaggcttgagcctgggtggtggaggctgagtgagtgagagtgtgtcactgcactccagcctgggtgacagagtaagacagtctctcaaaaacatacatacatacatacatacatacatacatacatacatacatatgtacatgcatacatacatgcatacaaatgaggattcactttaaaaagcattgaaatgtaaatatcagctatacctgaatgtttataatttaaaggtaagattgtcattaaaggaaaccttaggaatttctcagacatactgaaaatcagcccgaaagtgttttctgttgtttggttgttgtcgttcttttaggattttatggagtactctcattacttatcacttagaccaaaagagaatgtcaaactgccaacaaagttgttttttctacatttctactaaataatgttaagtagtcaggttcatctttggaaggaagattcttaagtgctttggcctccagtagtttagatgagacttcttaaaactcaaaatcattttattggaaaatgctttattttctgtctttgtgaattatatttataataatgcatttaatttaggccttgggattttgtatacctttgggtgggcctcttcctcttctccccctgcatctctaataagcactgaatatcaaattgaaaccatgatattctgaaatcggaaagtttctgccttttgcagcttatttgatgggaataaaaatgactgatggcactctctcttggacccttttgttcaactcacctatgattatggagcctattagctggagttacaacctatttaagagcagtgcttaccagtaatgggggccaaatgattttggaaagttcagatgtactggactccctgcagaaatgaattcagcactgaacatattgatgcagaacccgaacgaggctactccagtgggacaaagagaattgtgagctctgcaagaaatgagtgggtagtagaattaaagatcagatagatgttcggctcaagggcagtctcagctcttaagttcatcacagcaatttaatcaggcccaaatgagcgttgcccagaaaggaatcagccttcggtgtgacaggaaatggagtttatttaaaagattctttgtttctagtaattgtgtgttaaggttttccaagtctacactaaaattacggaactactacatttgataggtgatagcactttggtttaccttggttcagaagatgtactgttgagaagatttatacaagtcatgatcttgtccagaaggagcctgccacctcaaaagttccagctctatcgtcttttggattaagtaggccagagtgcatctttggctatagctatctgatgcccccttccattgtaaaattattttcacaaaaatatatttgtctacagtaagagttatataatatagcagtaaagaccacaaactttagaatgaggcacacctgggttggaatcccacctcctccacttgttagctatatgaccttgagcaaattacaactgtagttgaacacatagttctttacttacgaaatgagaataataattcctgcctcacaagattatggggagaggtcaattaaatgatgtagtatgtatcagttgcttcacaatgtctgcacataataagggctcaataaatagtagttacagctctagagctctctcatcttgtccctcacctcatttgcccactcctctactctcttcatgagccagagtgttcactgctttaggaataagtgagggaaactttttttttcttttttctttctttcttttttttttttttttccgagacagagtctcgctctgtccccaggctggagtgcagtggcacgatgtcagctcactgcaacttctgcctcccgggttcaagcgattctcatgcctcagcctcctgagtagctgggattataggtgcccgccaccatgcccggctgatttttttttttttttttttgtatttttagcagagacagggtttcaccatgttggtcaggctagtctcgatcttttgaccttgtgatccacctgcctcggcctcgtaaagtgctgggattacaggcgtgagccactgtgcccggccaaataagggaaactttttagaggatctttggcttcagtcatggagaaaaagaagaaactataaacacttggaggtctgaacagttcattgattgttaagaacccaaacaaaaacactccgtccccaaccccgacacaacaatacagtggggtattttggattgacacattattagcctggaaacctatattgacagccaggttatgattttacacatgtaataagaagagtctattggtttttcttctttgttgctcactagttcttaagtttgctcactaatgtataggtatttttgtctaacactgacaaaatttgaaaagaagtataataaatttattaggattttacttctctccttcatggacctggcaaatagtgtatctatgtctccatacccatatccacgttcttattttttttatctgtatctattatctgtctctgtgtgtgtggaaagtgataatgaatgaatgaatgaatgataaaagatccaaactatgaactttatggatatcggggtaaacatccaacaatcccttaaatttggtgcactcaagtaaaagctgaactggagagagttgaccagatcctcttaaagttaagctttttatccctctgcccataatttgtaccttgagatcctatagggatgtgcctaggcctgtgtgaatggcagcctcatctatgctgtacctgcagtacagaccagcctcatctgtgctttacctgtaatacagagcgaaacatatctagagaaagagattagtttgcaattagggggatcccacccattccacagcttggcccagtggaggttccctgctttgatcgtctcttggtgaagagaagaagagacagcaagtgctgtagaaagttttcttctttgtagttaaagtgatagggtggaaacaggagcatagaaaagacattcagagaatagaaagtgaccaaccatttgaaaacctaaaggaagacctgggttcaaacatttgttaacatacagagaagaaaaatatgatctgtttggggtattacaatccagtgtgtattttctatcatacttaccaaatgtacttacttgttgtaaacatttaatatttgtttagtgctttgaagattcggagtaatgtttcagatctacatattgtatcaataagcaaataacatatgctaagcacttaaaggctattgtcattctccagctagtacagagcaaatgtgaaagggtaaagactatgtaatttcaggtgcggtttcagtgaggaagccagaacagcagtctactcttatctgctgctttcttccaccccaaccccctgacccataacaacaaaaatcaaacccagaacaaaccgcatagattgatcaaagagcataacatgcattgttaggatttcagatatgtagacagaaagtcagattaagctttaatgataattttgagttcttggagcaatgctcattgattacaatgtgtgtgtgctggggagcaatatttggggtacccataccttccctgggcatgttaaccttgtggggcttgccttgtttcagaacatgtttcctattaaaaaaagatgactgtaaaatcgtaggccttttctagcatgcacctcaaaactcttccagcctctacccatcacccagttccaaagccacttctgcttccacattttagttatttgttacagcagtaccctcccttcttggtaccagtttttgtcttagtccactcaggctgctataacaaaataccaaaaactaggtagcttataaacaacagaaatttatttctgacagttgtggaggctgggaattacaagatcaagatgctggcaggttcactgtcttgtgaggcctagtttctggttgtagatggcaccttctagctgtgtcctttacatggtagaaggggtacacgagctcctagggccttttttctaaaggcactaattcactcatgaaggcttcaccctcatgacctaaccacctccactaaaggcccacctcctaataccatcaccttggtagttaggatttcaacatgtagattttgagtggacataaacattcagaccacagtccctgtgaagaaggtatttgttattctggcagtgcaggagcaagctagcacacttgccatatttagctgatagaagtaatgtgaaatgaaccgttaggaggagggattttgtggaagaaggaatggcggactgagcaagataaaatatggagaattgctccctcttcaagaaacgcctccatcctgatgtatatcagctttcatatccccatggatattttacaggcattgctacctctttaaacatttatgctattaaaaaaatcagaccaattgttgacataaagctaacatagcagcttctatatagacagaatatgaattttttatgctgttgatgagaagtttatgtcatttatatactatagtagggtagaagatggatttggaatcctgaaaaagctactgtttgtaccattcagaatattagcttgtgctttgaatcgaaatattaagatacctgtattgtcaatgtgagtgtttctgtgcaaagtggcttacatatgggtggaatgggagaaattgctctacctggagaaaatagcaatagttttctttcgtttatgttttgttttgtgaaaggaagggttaatagcatttaatacctgatttatctgtgcttctctgcaccattaaaagaatgaactgttgtggtaataaaaccatatttcattgaattaaaagtgccatcacttgcaagatgcaacattattttatgtacctctaaaaaactacactaacaaactgacatgtcaaactgacatgccattgatgttaagatgcattccaatttcagagatgtaaatatactttaaaatgtatatcttggaatcaatgaaatactgcatatagttcttttgtggtatgtgtatatatgtatgtatacacacacatatatacatatgccacaagagaataaagtatacttctatttggttatagtctataatattttgaatcattttactgagttaggttttacttattttttaaagttgctgttgacatctgtttgataccattcatttaacatggcatgaatttagaatctctacttagaatagtcctttggaagccctagtttgttgagttttcaaaagaaaaaagagtctggtgcaaggaggcagactgacattcaagtcagatcattttttaaaaaaggaaagaaaggagggagggaggaaggaagaaaggaaggaagaggttcatcctgtcagttaggaaccagctatcttacttttcaaagacaaaatcagatcatactagtatatcacaatcccgtagtttatctaattgcatatttataattcttcttggatggtgtctctcatcttggattacctctctcacccaaaatcatattttattttgttttgtcattataaaatttactatatgatcattgcaaaacaaaaacaaaaaattaccagtacatataacaatactggatgtcatatattaagttcacaataaattatggcgatttttccacatcaataccttatcttcatgtttcacatcaatacataatcttaatttttagtgactgcatattatatcattgtatagtaaaacataatttttaaccatttccctattgatggacatttagattggttgcagtttatcactttaatggcatggctgccatgtactttctttttgtcacacttacccagtgatcattttaggatcaattcctagcaatttctggattgctggatcaaaggctctgtcttcatgttattatgtgttgggaagggaccatttcctcatctgttcaccaatacaggatatcagccatctcccaccccaccccatctttacctacttgattggttaaaaaaaaaatctatttttgtttttattagcatttttaaaattgtagttgaggttgaacaccttttcatatgttttggccttttcagagtggttcttgataatagaaagcacagcaggtcagagagcaaaaggtcttaatgaacttccattctgcttcacagaagcctatgaggttttgaggtaactttctcaagttcgttataaagaagatgaaactgatagaaaataactgtgatgtagagatggggtctggcccactttcagctggtctactctccagcactggaaaggaagactgagcatcagaaagccagggaagatccctccagaggtccaggattgttctgaggaatactgaaatcaaaaactctagactccttcctgctttctgagatgcagggatttgacagagaggtcaaaaaagggcccctttcctctgcatgtgcagcttttatttactattgtttcctttttgttgtattgaaatgtcttcattgcttgcctttatggatacaaataaccggatactgtaatttgaaagtagttaacaatgaaactgcatagtatgagccatgctgatttttttttttagtgggcaaatggggtgatttctctatgagcctctctgctgtcagaagctcttaacatttgagtcaacatgggaattatatttggaataaattagtaaattcccattcagcatgcctataccatgtaatcttcaggaaccgtaatgactgtgtagtagagtatatttccaacttggtatttataaaacacatttgctctgagaaacccttcagtatttgttcctcaaggcccagccctcatgctgcctcctttgttagtcagtgtttattttgtaatagttgggacagtgttgtacagtggaaacccatttgtctttggagttagcccagacataaatggactcttaggcctgctatttactagcagtattctcatgtttggaaatcaggagcaatgtaattgttgagacaatttattttaatgagagtaagtcatgcagtaagcatcaatcttagcacatatacatgttgtctttttttgtctccctgaaatcttcttcagctgcttccatgtactgatatcttcttccaaattccttaagagccttcatctgggtcatacattgacatttatttgatacttaatattgatagttatctcttgatgtttgtgtatgtctttgtatccataggatcctccattagcacatgtattcattcatcaaatatttattgagccacttctgtatattaggcatagagtaagatgctggaatatgttaatgaacaggagatgtggtcactgtgccctcctaatgcttacatcccagcaggcaagacctatatgaaacaaagtttgaattactaaatgaaagacatggcagttgctattagcaatgttgtaaggggctgtgaatgtagactagcttgtacatgacatttgagctgatatctattggctgagtaagagttagccaggtagaggtgggagtgataagtctttaggcagagaaagcagcacgttcaaagactctgaaacaggaaaggacttgtttcagtggtgcaatagaggatgagcaaaatgttctcagagaatggagtgcagaaagcaggccttcagagaggtcattggcagcgtaaaaatggggtaagaacggcaaccttgtgcagggtcttgaaggccaggtgtaggttccagtctgtcacctgagagcaacaggaagatactgaagggttaaaggtttacctgtggaagagtatcagtaaaacataaatggatagattctaagtgagtctactttaagctggagtttggagtcgcagggtcctgcgtgtgtaccaccatactctctacacttttaaaactaaaacagaaagtattctaaaacataaaacaaaactggattgtattttcaactgttccttcaactctgaaatactatgattatgctagagtatgagaaattttattttccaaacaaatataaagatgtatttctgatgaaaaacattttcaacctaagctaaaaggaaatctaatgaaaactttaaggatcctttaaaatactaatattgtgtttaaagagaaaatgatacttgtctttaaaatgttttaaaacatttaaaatatgctactgaatataagtgaagagtggtagatcctaaagtagtatttcttagaagagtagaataggttatttccaaaatctttttcatggaattttagtgaaagctaccatagggatcatgttgtccagcctctttgtccttataaaaacatcaatatcttcataaatcaagaaaatgagtcccaaaattggacacatgagctacccattttctaagattttgctgaacggaactttgatcataggggtctctttctaaggcaacgtattagaaactcccagcatcactgtattccttataagaatcatattttttacattaatctccagaatcaaactacaagacaattaagttgttgcttttaccaggttgaaacttgccttgatttactatgaatgttggttgccttgatttcttctactttttgtctcagttctacatgttgttgttcttctggttttgctccttatgagattcgctggatctctgtatctcttcaactgtggtgagtttcatggacagggtcagaacttagggaaatgttgagaatagggtgtggtcctatgatgggtcctcctcttcttacaccttcgactgttgtaccactctttgatgttacaaagatgaatgacttgtggtccttggcccagagtttcatattctggataaattattatttatttgtagtgtacttctatatttttacatgctgtcagaatattagaaatacagtgtttcctgtcagaaatgccagctgagcaaaagccagtaagtcagatactaatgaatggattagcaaattatagggactaatgaaattaaataaagattattcaactaaactagtggctcctcccagtagtttagagcgttgctgaccaccttctttttgtccactcacatattagaattaaaaatgtcaaagtaaaattaaaataacattctcacctacaagaggtagggagaaggaaagtaatatttatctttaatgttattttcagttgtgcatttattatgtatatttttgcataaaataacttgtagtttttgtttggacaagccaatcaaatgagtctttaagatgaagaaggagagcgaacccacaagagatgagtttcgtatgtcttctcaaaaaaaaaaaaaaatttttttttagctcaccaaaaaatgttatgaaatgagaattttgaaaccttacctgtggaaatcacagtggtaatacttatatttcagcccttagatattcccagtggtgttttgatcttagatattcccccaaaggtgttgattagattctggctacagctgaaggaagagaatttttgctttttagctgaatagtaaaacaagcctctaaagatatgaggcatgggggaaaaaaactaaaggcttcttcaaggtggtgtaagggcataatttttgtcatctttattttaagagctctaccaggccagacgcggtgactcacgcctgtaatcccagcactttgggaggccgaggcgagtggatcacgaggtcaggatattgagaccacggtgaaaccccatctctactaaaaatacaaaaaaaattagccaggcatggtggcgggtgcctgtagtcccagctactcaggaggctgaggcaggaaaatggcgtgaacccgggaggcggaggttgcagtgagcccagatcgtgccactgcactccagcctgggcgacagagcaagactccgtctcaaaaaacaaaaaaaaagctttgccaaaggtttccccttagtaaagaatttaatacttgaagtcatcagattagatttcagacttcatttacccgctctatgcatttttttcgtcttcctgggtttggtctgcctgtgcttcttagtctacaggtgtcttttctctgtactgccaacctctaattggagatttattaggtgctcttaagtaagagaggaggaaggccaaaggagacagaaaatggagaagcaagaagaaactgatcaaggcaggagagggaggaactggagaggatggagataaaagatgtataaatgaagacaaatggaagaacaatgagatagagaggcctgaatggtagaaaaattctaaaactgagctagtgagaatgcatataaaataggggtctggtagaagaacttcagcaaaagtggtgtaaatcaatgatgagtaaattaatagggcaattgtgcaaatgggactcactcatttatactaagcgtaatacatcatgaatgatttagagataatgcaacccgtagggcataccttttaatctacccaggacccggtagagaatgctgtcacttcaagagtaaaaaggcagaggatcagaatattgggtgtgtctcttcattctaacagtgttaatgagatagattctgagcaacatgaaaattaaccagactcacaagcttagtttgtgatttatagattgaaaagaagcttaatatattccaaacatcttcctacaaacccaaaatatttaagtgttttgaaagtattcatttgaataggttaacatgtgtgattgccatggatggaaatgaaagtaaaatgagtcactgcacatatgatccaaggaacatctgagtgttaagtgggttgtaactgcataagaatccagtgctattggaagatgcatcagagtattctgagaccagggaataaaattctcttccatgtgctcccttctctttcattcgtgtgcctattcactcaccattcaataggtgtctatcgacagccttctgtgtggaaggtactgaggaatgtcctatgggttgctgcttctacctgaaacagaaacataagatttacatccctcaggccctcttaccagtatttttatgggaggatattgaggaagggaagggagaaagtgaatataagaagtggagagaagtcttggtttatagagctgttagggttccaagtctgctgttctttcttgattcagaaatggaagctcacaaaggttgtgtctggaccaaagacccaagatagttggagtgttgaggattagatgattttgggcttcccttctagttcattcttagaatttattcccagtttttgtgtttatgaaagttagagatacagtcttcaaccattaggagttagaggtgaaaataatagtaattggatgttaccaagtatgtaaacacttgtagggaagggaaatacataaataactaaattctctattaaattctgattctgaaaacttcaaaacagacctaatttagtaagaggggctgcatttttatatgtgatcccacagaatgcttctagacttctgtcactgatggggaaaaatcaaattattcaaagtcttgcaccatataacaaaaaagctaaactaagacgagatttcagggagtatagaaaccagcaatttgtgaaaaatcttgtgtatgaagagtcatgatgtagaacattcaaacaaatggatcacaagagatttctcaaagcatgtcttagaggtgagcaggcaggcatcaattttaaaattctctgttataaatgatcataagcttatgtttttctgtgtaaaggagaaataatttcccaattttataaaacaaattaccaatgatgtaaaaaaaacatttagcacagtattatatcagagggcatttaacattcttttgaatcatttgagattttcatgtttccatttcagagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttcatttgcagtgtgttttagtttaaccttcatttgtttctcttttctccattcctcatcccaattcaggtatcagatcctttgacaattgttaacctgcccagctgggatttttggcattaagctatgactgtaacgtttctactaataaattagattttttaaaagagtgctgcttgccaagaagcaaagtcattacatagtgtgtatatgttcaatgtatggctataaaagtctccttagccaaacataatcgacagttaaaataaatttaaaataaccgtgctacctctagattttaaaattgttaaggtgaagataggtggtctaattttactctatttccatttttcttattcacagggtatatttgttctgtaaaaccacatatgtatcttatagtctgcagctgatgtatttatctgcctaaatacacatttctccaatggaatattctgtaatatcaagcatttcttttttagatggaaattaattttataacagttgaacatcatctttgtcaatcagcagctttatctaccataaagaacaaaaacgtacttggcgtggcctgctttaacttttgtagttcctatgtttaaactgaacagaggaatattatgtgaacaaattggaaaattatataaagaaataaaaatctttttactattatagttatctttaccccatagctttcaaaaaggcatttgaagcaatttaataaaataggaataacagtaagtactagatgtgagaggtgagaaaacaactttgtaaatcacccatctcacgaagttgcacagaggttcctgatagcccagacaatgaaataatgtgataattcctattttcagaaaagataactagctccttattttgttttgggtgtagaatgggggaagtggtatatttttgctaagttctaaattcttaggaaaatgttcacatgggttttgagagtcactgtataactgacaatgtccccagttacagatttccagaaaattcagacatggaattcatgttactcattttagttctaacctttgatgaaagattagggcattagattgaagcttaagtaagcaaaggcattcttcaggtgatgtggttcattctaatcagtaattttatgatggtgttcatattccattccaatgatcaaatggactagtaagcttgagaaataagacaaactagagagagagattattttataaatatgaaggaggctagtgaaattttggtccagatggaaagccacccactctcccaggtcaggactgcatagatgaagtataagcaaaaccgtcattcacactttgaaggtgctgctttagagagatgtcattatatgtggtgtcagatttttcaccctgttcagtactgggcactgatttttaaaaccacttatctatattttttaaatgtcttctgactcattggattgattttgtggacctactggtagtctttggatatcccccagttaatctttgcttccatgatgagcatttattgaattctattcttatgccaggcactgtactagattttaggagtacagtagtcaggttttccttgccttcatggagtctctggtcaaatactttggttcttatatagcggttcatgttccgacacgtggttacccacacaggctttagttaacatctgcatcacctgctgcacattctcatctaaaatgcgtatgtgaaagtacagttgtagccactcagtgtcactcaccagtggggctttaggcctgagactttccgatagcctctaattatgtaaaaccatgcctgtattcaggagtcagaagtgatcaaaatgttttaggaagcacaccgtcagcatagatgtgtcaactcagcagcaagatttttcattcttttaaagttacacatttcataaagaagaagggtatcagtgtaaacttctaaatgcaggacaaaatgcatgattggggatggagattggagtggacttgttcaaagagcagcagcaaatgagacattaaaggaatacataggaagccacttccaagtacttccatttttctttagttgtgattgtgagatggttccctactagttagagaaggaaaattttaaaatgctttgctaaacagatgatccttaaattggtcactgtataccgtgatgcagcctaatcaaaatggtattcctttgagtgagtgagccacagagactctcgccaaccccttgtgcagctttctattaacagtataaatactccattgttgtaaagcagtttatggttaacaaagcgctgtcacagacacgttatcttagttttgcagattgcctttgtacatgttattctcatttcctagcatgccctctatccctgctttgcctgcttagcaagctcattcttatccttcaggacataacaccaactctgcaaagtcctcttgagacccttctgagcaggtagatggtcccttccccgtacttacacaagccctgatctcatctctgttgtcatttgttcacatcactgtttctccctggagactgagtctctcaagggtaaggacactgtgtgctcttcatttttcttcccagtgcctttgtaaccagtcttcctgggggatactttgtaagtaaaggtgaatactgtatggtgtgcagcttaggagagcttaagccacttcctaagttaagatactaagtagtagataagagtaaaacttaagtgtcttaactcctgtttttatcggtttttctggtttatcagtttattgctcatctgaaaacaagctgtccacatcatactcatgctgttctacctgtcagagatatattacatggtaaatgtgagtgataaaggaggataagttctttgtcagaatgaggacatttcggttctgtcatcatgcctgaaatgcatgatttcacatgatttccatgtgaaataaaacattggtataaaagggatatggacaaatttgtggatgttagaaccacacctttttctctgaatttattttcttctcactcctacttggcatattccctgtcattgtttgagagtgtgcaccaatgtcctcgtctcagggacaccatttctttcccgctattagagtgtctggatgatgccgtacccttagtgcactgtcctgttgaaaatttggtacattagttattttaaggtttaaaaacattgctgcctacataatattccacctctttggagcatttgcattggagtgaccagtggcttgaagctctgtatggtggagtgactgatggtagttgaagactgcaaaagtaggtatctgagggctggaaggcattcctggcacccctaaaactaccccactgggggccatccaagcctgtgattaacaaaccctagttatttgctaggtagtttccacatggcatagtaggatatatatatgtgaggcacaatacagtgtttatgtgagaataatatagattatttgaatctaggctgcagaacctacctgaaaatgggttttacagttttgtgtaattgccttttctttgtgtttgcatagaaggcattgcatagctggaagatgatggcaattataatttattatgctgtaattgttacctaaatgtttttgaataagcaaaaatcacatctgtttaggaataagttgcacagcaagagaattccctttgaaatgaataccgtgttctcatattctgtaactgtacacataaaacaacatatttatttccccactgagtccattacattcccaagtcaaactgcatcctctcttcctttcccatattaaaccctttgatttaatggaggttttaactactggttctttagggaattttcagtaggctttgcacagattaggttattggaaagtatagttatttgcttgtaaagtggcagttctgtgtcaaaattgcttttctctggagctgcaacagtaaaaacgataagcttctgctttgcatccaaaatgccctgatgttcctagcatgatcgtttttcctttgcttcttgctcagcaccattcggtcacaggctggtttggacaggcgaatatgagcacatgtagcccagaggactttgatatccagtggtgataatagacaaggcctgtcttccattctggttgccactggtctgtgacaaccagtgttccgggcatggtgagcatagtgctgcttcccttctccgttaaataggaaatgcataagcctggagtcgttttgtttgttccacagaaacgtagcagttgaaataattgccttgccatgcccaggctaacaggatttatcttccattatagatcatgaagacataggcaagaatagtttactcctctaaatttactaggctactcacttcgaaatgatttcactgtgtaaaagagaacagtcctagctgtggcttagcctagaaaggctttgatacctagaaagatgaagggcagaagtgtattctctatttttctgctcccagctcataaaatagaattggagtttatgtaaatagcagatagcctgattttattttttatgccccagttgcaagttagtgtctccttaagatgggtcttaatcactgacgttgtgtgcttccattcagcacctatctgtctattaagtggcattctagtggcctccaagagttgagtactttattctgatcagagtcagcctgggtgaccaagatgggctgtatcaatctgttacacctcagacccactggaggccacaatctttgagtgtcttttggaagatactgtcctatgttgttctagaatgctgactcctactgcttaaacctccgttctctctctgtttttatcttaggccagatgtcctttataaattttgattttttgttttttgggttttgtttttggagtttggatctcttagttttcatcctgaatactgttccacactgcatatttaatcagttaaatcttggtctcctggctttgaccatcaaatgttactctattgcctcaactctattgagttactccaactcaactgctcccacctcagggtctttcactacccattcataggcagtagccccttgtttctcttcttcgtgaaacctgagttttccttattgtacttatctcaggcattaatggatctgtgaagaagtatgacgttaagcttaaaggatcaaaaactgggcttccctatgtatgtttcaagtttcatttgtgtgaccaagagagttcatagtatagatttgaagagttcaatcaagaagctaagatattaactcatcttagtaatagccttttgtctacttcatccatctgcccatctgtctgtcaatctgtatacattattgataacttccaatgttgtaaacactgggaataccaaaaaaaaaagaatgagccatgcacctttccttcgtaatgactacattaaagccccaagacatgaagctacttgctgagccttgcagctgacctgtggcatagtggagactagaacccatttctagagggatcttcctcatacttcccaaggtcagttctctttaggcctttggtattcctgtcttagttgttgtaagagtagatttcgactcatcaaacatttgtgatttggaagtatcgcatagttgaagaattgaagaaagctgatgggaacaaagtcattttcaagtttacttgagcacatagatatcatgttgactactttgctgaatattcagaatcatttatatttagtatagtaaaagtgaaaagtatctgtttttaaaatttggaaaacacacgaaatacaatgaagaaaactaaagtaacaaccattttactactctttttatgtatttcctttgagtagatatcaaatatatcagcattttcagcatatacgtacagttttgtgtcctgcctttttcccttcaactatataatcagcatcttcccacatcgtgagatgtgaattttttgaaaacatgataattaatgcaatatgttatttcaaagtaaaaactttttatttaactattattgtgtgtgtaactttattttctgtgtttaggttgtttctgatttttcacccttatcaaccatgctgaggcatgaacttcctattaataaatcattgtgtacatctgtcagtatttccttaggataaatttcttttagttctattactgcatctgaggaaattaacatatcaaagctattgatatgtatttccctgggtatacatttttttttttttttttttgagacagtgtcttgctctgtcacccaggctggagttcagtggtgttatcacagctcgctgcagcctggactgcttgggctcaagtgattctcccaccttagcctcctgagtagctgggaccacaggtgtgcaccataatgcctgactttttttttttttttttttcaatttatagagacaaggtctcactatgttgcccaggctggtttcgaacttttggactcaagccatcctcccaccttgacctcccaaacttctgggattacagatgtaagctgctatgctaggcctcccagggtatacttttaaccctgccttacaccacccagaattcaaagcatggaatccttgacccagtagccagagtatttcttatcttaagtttaggaaagactactctgtggtcaaatgtagtcacagaatttctttccaacaaagctgtctacgtagttaactgagaaccgtctccaaagggttgttcctcttgagggaggtttcagagaagagatggcattgatgtaagtcttgaagaagttagagctcaaaatattgtgaagaggaagataatttttttttttttttttttatcgagacagagtctcgctctgtcacccagactggagtgcagtgacgcatctcggcccactgcaagctctgcctcccgggttcacgccattctcctgccccagcctcccaagtagctgggactacaggcgcctgccaccacacccgggtaatttttttttttatatttgtagtagagatggggtttcaccgtgttagccaggatagtctcgatctcctgacctcgtgatcctcccgcctcagcctcccaaagtgttgggattacaggcgtgagccaccacacctgaacgatgaatttttctaccaggacaaacaggatgttcagaaggaagacattgttagaactgtacataatcttagacatcatctatcccagtggtttatcaaatattttcacagacaaaacattttttcaagccaaatcttgtctagagtactacaaactgattgaagtgaaatgtctccagttaaatcacagtggatgggagagctcggaattgagggtagaacctcctttgctcagctttcttagagcttcctatgcacctgaaaaacccaaagcctctttttttggttttttttgggttttttttgttttgttttttgagacggaatctcacttttttgctgaggctggagtgcagtggcactgtgtcagctcactgcaacctctgtctcctggattcaagcaattcttctgcctcagcctcccgagtagctgggattacaggcggccaccaccacgcccagctagtttttatatttttagtagagatggggtttcaccatgttggccagactggtctcgaactcctgaccttaggtgatccacccacctcagccccgcaaagtgctgggattccaggtgtaagccactgcacctggcccaaagtctctttaaaaaacaaattttaagtcactccagtttgaagtttaggacacagagacaaactgtgactttcctcaaggtcagtcagaagtgattctgaaaccacctttcagtactttaaccctgtccaaaagcagccattttagtgcttttatcactagatgttcccatgcaggttgagagagattatttctgttctgttaggttatgcattgttgcagtgtcccaagagataaagtcccaagatattaatgtaagtattagcttctgtaagatgttaccccaatccatattaaccatgtctggctgaggcatgaaggatctattaaattatatccaggttcctattaaatcactacactggcagtaatacctgggctcaccttctccttaacccaaattaacacatgctgttagtggtctcaagtctaaggcaagttcctgagatgaacaagtgactgggaaaacaggagaggagaaaattaaaataaatgataggctgaccttctcacaccacttgtggtttctcaattaaccaaaagccagacagctccacgttgctgttctctcagtaataggtttcaccctcccatttaatgccagcccacacgggtgcacacacagacacacactttgctaatcagattggcagcaaatagaattaaaccattaaggcaattaagcaattcttagataacatttgatcagttcaatgaaaatgcaaattcattcttcttttggagaaataagttgatggaaagtcatttcgtgttctataatcataattaactcttttccaaataaagattgcaatgttttgggcttggagctacacagatggaaatgatttttttcattttttgcttcactctgttcatccttttgtaatgcaccatgtttttctgcctccagactctttgggacatttaggtcatcttacctacaatctcttccttgtgcctcaaggcaaactctgttatttactctcacacatgatgactcatgcattaaacacctccttagaccctgagttcggaatagatcctacagcattctggaatgattttggtcggatattcatgtgttgtagatgcactacttggctgcttctcatttctctctattccccacacttacggtttctcctctctcacaagctggtggggaagagaatgttgcacccaaaaataggtgcttgaaaatgagcgtgtggtgtctgcattttcatttctagattggtatcattgaagcctacgttccattctgccaccacagcctgaactttcagcaagaaaatgatgagcaccttgcagcccgtgcttccctcacctgccaaggtgcctttgtgctctagctcagggtttccaaacctggtacatcatcagctggggacatttggaaatatttatagtccacagggttttaatccagacctatagaatcggtatgtcccaggtttggcttagggattttcttttgcttttgtttttttcctttaaaaaaaaaaaaatctttctgtttgataatagggatcagccagtcttaagtctagatgccattttttttctacattggagaccataacatgtagtctgatgcatgatctgtcaatgacacagaaatcacttggatccaaagaattttatgatagccttgcttataaagaaaaataacaccttatgtggcaggtcattttatagatacacacatatgaatagtccactgcatcatgcgtgtgtatatgtgtatatcaagtgtctttagaggtaggtaaaacataagaggcagctgttatcacctagggcaggggtgtccaatcttttggcttccttgggctacattggaagaagaattgtcttaggccacgcataaaatacagtaacactaacgatagctgatgagctagaaaaataataataataatggcagaaacatctcaaaatgttttaacaaagtttacaaatttgttgggccacattcagagctgtcctgagccacgtgcgggctgcgggttccacaagcttggcctagctagatattatatttaatgtatctccttttcagtcttaataaagtattgcagccaactcccatccagcaggacacatggacttagtgtgcctacctgcaggtttttgagcatgaatgtaaatattaatagaaaaattgtgaatgcttctcaggaatgtcaccagtgatttttttcccccaaagaaacctttagttttgctaatccctttactagtacatgtttgtagaacacatctttttgagaattttttggggatactgatcagctactattaaagccatcaagccagcggtgccaccagtgtcacaaggaagaacgatgttttgggaagggattgagctcagcattccaggaaatattttttacctattcattactgcatgcataggcttacattttctcaatttaaaaatacttctaaagggtgggcttttgggatgtagacacataatgttctcagcaatactgtaaagcctcattaatttgctaaacaaataagtgagatggtaaaggatattgcatagattgtaagggcacatttaatcatctgaggtttaactggctctaaaggcaacaccttttcaagctcttaagagtctatatttacatggatagtaggtcttcttccttcattaaacttgccctctaagaccttttagctgttagttagaattacattttgaacttcaggataattctatatttctttcttaaaataaattctttatatgagcatttagaccataattcaaactgaggtttcctataagttctgtgttatattttatttgcgtgcatagtgatattcataccacatctgttaaagtatgaagggaggaaaatgtcagcaagtgtattgtgtctctgctcacaataattttccaatgaaagttcacttaaatgagggattcatatatattaaggactgttgttggtgattagtacataaaaatgtgggtttttctcataagtggttttaaaacttcagactgagtacctcttttgtttaatttttgcacttcttggaggcataaggtattttagtatgtgtggatcttttttattgagtttgcatagtttaggagttttttggcttaaaataaaatagggaaaaaaagctctcttaaaatagtatcctttcttgaacccataaagtagggctttgaagacgtgcaacatttgtgaggttctaaagaggggattttgtggtgttctttccagtgcttccttccttccgtcctcaccaccctgctgtaatctgataacaaataactttccagtcagtcaatttaaattatatgtaggctgcaattttttaaaatttcataatggatgctatttaaacacaaacatacatttaaaaaaaatgccatactaaagtccaaaaggaatggtgacagacattttatttatttagagacaagttctcgccctgtcacccaggatacagtggtgtgatcttggctcactgcaacttctgcctcccaggctcaagcaatcctcccacctcagcctcccaagtagctgggaccacaagtgtgcaccacgatgcctgtgttttgttttttgtggtttttttttttggtattttttgtagaggcgcattctcgccatattgcccaggcttatctggaactcctgagctcaagctgtctgcccaccgcacccagctgacattttaaatatttatttatagagcttcattatttgtacagtgcccttaaagccaaaggcattgattaggcttatagaaattgcaattaggccatgcacagtggctcatgcttgtaatcccagcactttgggaggccaacgtgggaggatcgcttgagctgaggagttcgagactagcctgggcaacatagcaagaccttgtctctagtaaaaattcagtttaaaaaagtgggcatggtggtgcaggctggtattcccaggaggctagggtgagaggattgcttaagctggggagattgaggctgcagtgagctatgattgtgccactgcacttctgcctaggtgacagcaagaccttgtctcaaaaaaaaaacaatgtagtgagtcatagttatactaaatgggcttgaatactataactagttttagtgttatagtcattaaaaaacaccataattccaaatggatataccaattactgcttgcttatcttatgcatccttttcctctcctctctatcccccaaaaccactcttgaaatcttcctgtccttttgctcttatcctacctggccatctatccaccatttatctagtataatttccataataaaaccaccagcttgcattagtgtgttggttacttcaaaggtggctaaattagagactttggttaaggacaccaaattcttaccaatttgatggtcttgaggggcaggctgtctggctcatctcttttctatctgctgcccaccttttactgcctgccccactaagcacttctcatcatgtccgaggagagagtaagtgggtgcgtgcatgcgtgctgcaagtatctgcatggcattctttttcctgaaagatcttctttttttttttttttttggccatcatttccattctgtcctaatatatcctttctctttaaaaaccagcatctagccaaggcattgatgaaaagttttctttgagctcccttgtggctgtgcagaagagtttattcctgaggttgctctcatttagggttggaatctttgaagataaaatacttcttcctacctctcacttgagatcaaggaaacctacataagactcccagagcaaaaggaccctgtaacacttgtgccttggcattgccatatgctctgttgcgcaggaatggggaggaacggccatccacatgccacccccacttccactcggaaataatagggggtgacaaatggctgctgcattctattctgttttaccaggctgtttctttcctgccctcaagaggtttctgactttctgacagcagggagctgaggttgatctagcaactgggaggattgcacctggatttgcagaaatacacatgcacatgtgtgcacgcacacacacacgcgcgcgcgcgcacatacacacacacacacacacacacacacacacacacagtgctgctgcaactcccagagtatcacataatcactcttctggctttagtggttttcctttggccacactctgctcttgtttggcttgctagcacagtaatcagaggaaagacagagactctttgcactctaatccccttgtgggttacagtagtttcagatagaagacactccagagggtgctatacaatttggaggtttataaaggccatcttctggcccccatttccctttaagaaatgagcccctcaatctgcattatacatgttcccttactgctagaagggttttactggtgccctgacactcttctcttcctcacccctcccagagcaagaactacaaaaacatagtttttttctcattttcttttagatgtatctgctgccatttattttctctctggtgattgtgtgatataggaaggggaagcatcaatggcttctttatatcctaaccacattccttgactgggccctgtttcacatctctgactcctctagagattactcagccaacatgctgcccctcctcagcgcatcaccttcttgggtctcagggcttggcattttcattcagccttgcagttccatgctcatcaccaacactgcagacatctgctgccactttcctgcctaaagcaagggaattcctgtgattcacaccgtgagcagaagcaggggtcctcttctactcagcattatcccagtttgtctcactcctttagccaatatcatgaaactctgaaactttatagcaggatgaaaacttaagcctgtagtctaaagacccagaattatgagtgaggaaactgaggccaggagagccatgaatgatagtgtttacttgattgctgtttcagatttcaccagcttttattgatacttcagcattttacttagtcgatatatctcttcgtgtgactcaaagtatcccagtggagcacagttaactgccctggatccgaattgccactggaggccgtggcagtgtcggcatcaatagggatcacccatgaccttttatttgggatgtagtagggggtctgaagttgggaaagtctgaggtggtactcagttctgggttgaatgtcttgtgaaaatcctgtgaatacatcttgcggagaaacacagaggggaaaacttcctgttgtgagagcagggctggttcccttttaaaaaggtataggatgaatattccatatttgaaatacttgagaccagaagtgttttggatttttaacttttttttttttttttttttttggaaatgctctggtgaacatttccttagagtgtcatgtgacactcaaatagtttcagattttggagcatttcggatttgggatgctcaacctataatacccaaaggctctatttcagtagaatttattggtttgctgattatagcagtgacatagttgcattctagagaccttagaaaatgcagaaaatttcaagaaaaacatttaaattgtgctcatagtgaaactgagaggtgaccactcttaatattttgtggcataagcattccagtcttttatctttctcaaagtttcacataaactttctcaaaggccattaaatacttttccatagcctgattttttgtgaccacatagtatcctattatattgataataccataatttacctaacccatttttatatatttggattttttccaattcatcattattatgaataatggtgtatctcagtggttattactttgcactgcatttcttatgaaagtattgagtaaaaggaagtaaagccctctcagagtgttttgtaggctgtcacatttcactccataatgtcctagtgtttgttgccaccagtgatatatgaaggtacccactgaaatgtcacacctttttggttttcctttttaaaataaaaaataaaaaagacatttaaccatataatattgttcttatatatgatttattataatgtagattcacatctttgagttcataaaaatattgaatttggattctctccaatttcccttttagtagaaaggctaaagttcggtaagaaattctacttggaattttattgaattgagaaacatacttggatttctgtaactcatgacaagtaacaaataaacaattagccaattaattaaaatatctgttaaaaccttgagtaatgcagagatttagttaggcagtgtagtttaaaaaaatcaaacaaaccagacctatgctgatctccttggagatgaccatcaacaggaaagatagactttaaacagtgtatgttgacatagagcaagtttctaattttccatcatttcaaggtgctggaaattatatggacataaatgcctttataatatgtgtacatctggtgagtataaattctcagatttgaggacatttccaataaaagactcacatacaaagtataaaaccagtaagcaatggaatgctaatcaagtaatgaaggattcaggaaagaaaataaaattatgccaaaccatgtaggccaagaaatgcaagtgggaaaaaaaaaaacttaagctgatgtcaaagtcaaaataaaatgtagagacaaatctctaaatttaatgttttatttgggaatcatagaatcacatttggggcatgcaaacagactgggtggtcttcagcatgtccaaagaacaaaggaaagattgggggttttattagaaagggaaatgttacttacagttttgaaagaaagctcattgaccctagagaagcttgtgggagctgcccgggtctgattggtgagtgatggtagtagataaaactagtcttaaagtcatagcaggttgtttcagcagctgctaagtaaaactggtcttatggttacagcaggctgtttcaacagctgggcttggagaaaactcaattcttggagcatgtgctgtgtcttgagtactttttcccgctgctctgtcaactcttctttagttgggcatgacaagaatgatgcaatttgcataatcaactttcacactgagtttcctgtagcctatacaaaacataaatattagtgtttttttacctttttacagtttttattgtattgtctattgaagtgaaacattaaagttatcagaatagagaaacatttgcctatcactacacattgagaagatactgtaaagagacttgaacaaacactgggcagtatgatgcgtagaactttcagtctagtttttacaagaaaaagaaaagaactgtgctaaccattttgttcatcaatataaactcaagtaatgaggttaaattgtagttctttgcagagtgcctggccaccaggtccgtaatcgctggaggtttgattagatattgagaaagaaatctgcaaaccttggcaaaatttgctgcataattccaagactgctggttcttaaatttatctccatcaaaacacagatgtcctgtgagctggactaagccatctcactatctataatcaaattattgctttcttttttttcccactgaaagatcgaaaaagaaaaaatgggtaaaaattcttagataactgtttttgtaatgtgtatttttgttgaaccttgcctcattgtataatcaagtaacaaatatgaatagaaaatactattgactatggatggtacttagctcaacagcttattttgaagaggaaaccatcatgtttttaaatatgaaacataatcatgtactttacgaataaaattcttcctatttcttacaacaaaattgaacatttcaggatttaatggtgttccatagccactagcacgcagtagctcataatttcaaggtgtttgaccacatcggtcagtttgaaaatcatacctgaccatcactattgaacacctgaagtgcaagcatccatgatggagactggagctgtccattggctactgcctttcagactaggggtggcaaacctgaccctttgttataaaaatgaaagccctcaaacgtgttcttgtcctcacgaagatttttgtctctactgaaatgcctgtaggccatttttggaaattatagctagtgtgctcactaaagtttttcttatgtgccagacacatgctctagctttacatacaatagctgtaaacctcacacaaccttgtaaggtagagagcattattatctgtattttattggtagggaaactgagaggctaagtgccttggccaagatcaccaagttatgaaatcacacgaaaggagagcctagatccctctaccagcactccttcctctatatgcactgccttgcagtaatcaagacttcactaaaagcaatttcagatctctgcaaatgtttgaacaagagctctgttgaaatgccataaaatataggatataaccttagctttgaaacattttgaggggagttaccaacttaaaaaaaaaaatgtttacctttgagcataaccacatccgaaagagtcacagagctagtcacagaatgtacccctcgataagtaaacaacataacctgttgaataagtaagtagtttagtcttctctgcctgcatgttgctaaaaataacttttgctttggtatagaagttttgaaagttgtgtagttcaatgaatatttgttgacagtgattgaaacttacattgtttctctcatgctaatcttgccaagctttggtggtcttcaagtatttgaaacaagaaagggccaggccagagccctcgttttcagatatgggacaacaaccaggctttctccatttgaaggaagaggaaagagataagggaattgttgcagtgaatcctgtgggccccaggagttataacaattgttttctaggacatacccatttcactcttcttaattttctgccatcagcatttctggggatgtactaggaaaatggaaggaacatacccagcttccagggtttcagtagtaaagtatagactagtttaagagcaaattgattagatcacttctactcctatgatgtccatttctcatataaagataagctgagaaaggtttattttaaaattaaagctagttgtttaaaagtgcggctgaagttaactcatggattgccctaaagtattgagctgtgattataaaaaaatgtttaccaaatattgtcactatggctcttatgtagtgaagagaagaatttagccttaaattagttaaaatgtgcaaaccgtttagaacagtgcttaacatatagtaagtgctccataggtattacctatgctttagaacagtagttctcaactggtgtaccacacggcacaagtatatctttatcctttctcagacatgtgccgaaacatctatacacatattaatttttttttgtatagccaaatatgtaggtgaagtgcacactgatgtttcacttggctgaataaaataagaggtgagagacacagtgtaatgtcaagtctttgcttaccagagtgaaatggggcatcgcctttcgggtctataggggtgcactgagcagtcccgttaaaaaggcacatgttcaaaaagactaaccaggtgagcagcatgttaattaccactgcttttaagaacactggaaaggcaagtggttgtatggtagtagcaattacattgtaattactgtgacttagttagaagtttttgaaccccttttgtatttcaaattgccctgtacatacaaagtgggtcagaaccatcagttaagaattagtggggtcagttcctgtctgtagctattaaagtgatttatttattgtcttataacattatactatattaatttacacatagccttggaaaaactctttctcagacttctaggccagagtctaaatacatttatgaaacttctcaggaccaggttttgatagtgcggagatcagggagagcctaaaatcataagacttctctaatagagttaggtcattaaagaatatgaatatatgaagagtagggcattagagacaacattctatacctaacattttggtccaaatcctataaaggtttctcacatagaaagctgcctttttgcatgtactacagcttgtgtctctaatatcctttctgtaccaatacacaccacatatctgattattgttcaaatactcctcttaacttaccaatgaaagcttcagatcacttaaagagattgcagatactatagtgaacatagtagaaaatcattattctattgtatagtaaaacccatgagttacatctaaaatgttactactgtttttatgtagtctttaaaaaaagagattatgaaggtttacaattatagtaaaacttattaagtagatgcatcaataggaaaagaaaccattatcctttcaacccagtcctatttcataaatagcacatcagcgcttcagtgattaagaaacatggctcatctttgcagcatgttgcttttattactttttgcccacggacctaagaggggagaggtaaagtgatagaggaaaaagctccaaggcaaatcaagttcacatatttttatttaaggattctaggaactcgaagactgaatcaaacttgttacttagtttttcactggaataatggctctatttctatagtagagtgagtagaaggttaatggtatctgccattgatggtttactaactggttaaataactgattgaaatgtggtaaagggagatgaaaacaaactaaatctttttttttttttttggcccagattttcacgtttagatgccatgaagcttttgattgtgggtctaaagacaaactgtgacagtgattggaggcttcttttaggggtcgggagatatatggaaggacaaggaggacagaggaattcaatctcctatgcagtctctgcacctgttcactaagaaataagtcagctgaggccggacgcggtggctcacgcctgtaatcccagcactttgggaggccaaggtgggcggatcatgaggtcaggaaatcgcgaccatcctggctaacatggtgaaaccccgtctctactaaaaaaatacaaaaaaattagctgggcgtggtggtgggcgcctgtagtcccagctacttgggaggctgaggcaggagaatggcgtgaacccaggaggcggagcttgcagtgagcagaggtcgagccactgcactccagcctgggcgactgagcgagactctgtcttaaaaaaaaaaaaaagaaagaagtcagctcagtccaggcagtagactttggggtgggccttgatggaccataagacctttgctgccctgtgacttctcccttagttctcagtctgttcagaaaacaatttgcaacaacatcagagagaaatagaatgcaaaacacagctcccttttgatgaattggctcctggctcggcctgcaaaagataacatggtttttcccttagaatacttgtcatgccaaaatgatggtatcgtcctactggggtttttaaatgttaatacaagtaaaataagatggatttttttaaaaaatggcaagcgtttcttagtttggctctcttggcttttgtttaaaactgaagatcactaagcctagatttttgtgtctccagtttaaaaaaaagtaaatttcaaaagcagttcctagaactctccctctccataggcctgttgtgagatgcctatgtccctataagtgtgcttcaatctaccagctttcctaaaacaggttgatggcttagtggataaagatgggacttacaaagcctattgattctcttattgtactcatctgtagaatgggaatagcaatggtacatgctgatcttacatgatgtgaggatgtgatgaaataatacatggaaggtattgagactactgtctgggtcatagcaagcagttttgccattattatatttgtcatgacagttttgccattattattaacccaataataatgtcgtgtcccctttctccattcttgtctcccaaagatgtcacacattcattattgccaaaaaacatttttaaagctttctgtttttctggtacttgcagtgtggctgacgccagtagggtataactcctctgagaatgggtgctgaattctgttcccaaggcctatggggaaatctctttttgttgttgttttttgttttgttttgttttgttttgttttttgttacagtctcgttctgtcacccggggtggagtgcagtgatgcaatcttggctcactgcaacctctgcctcccgcattcaagcgattcttgtgcctcagcctccctaatagctgggattacaggtgcccgccaccacacttagcgaatttttttttttgagacggagtctcgctctgttgcccaggctggagtgcagtggcgccatctctgctcactgcaagctccgcctcccgggttcacactgttctcgtgcctcagcttcccaagtagctgggactacagcacccaccaccacgcctggctaatttttgtatttttagtagagacggggtttcaccgtgttagccaggatggtcttgatctcttgacctcgtgatccgcccgccttggcctcccaaagtgctgagattataggcatgagccaccgcgcccggccacacttggccgatttttgtatttttaatagagatgaagtttcaccacattggctaggctggtcttgaactcctgacttcaggtgatccacctgcctcagcctcccacagtgctgggattacaagcgtgagccaccacaccccgctgggaaatatcttaaaagaatcaaaataagaaagttactctacttaaatcgtgtgctttttctgtgtgtgatttatggtaatcttaccatggggtatctgattactttagaaagatccatttagcttatttttttcttctttgggttatttttttcttccttccatttgcacagcctccccccaaataaaaaataaagatataaagtctatcttctccctcttgtcagtttaagtaaaaagaacttttgcttccattttaataatagaatttgtgtgtatataatataggcagtgatttggcctcaagctgagtttagatttgaaaagatgagaatattaaagcttgtcagccagcccacaaaccacttaagtatttctgatctgacaggatgtggggtggagttctttttcttttctccaccaacacccctcacaattaaaataaatcagataaaatagacactgtgaaggtgggactgaaagtaggtgataggaaagggtggccccacaccaggaccagtacatatgcagaaattccgtccaaagtacttcaagggtctaggacagtgctgtccagtacaactttctgtcacattgaaaatgttctgcatggcccaacagagtagccacaagtcacacggggctgaaggcagatagtgtaactaggatttgaatttttaattttatgtcattttaatttaaatagccacaggtagctaatgtcttgaacagtgtaggactagaaaaaatagattttgacacacattctcatgtatgaaaaactgccaaagagcatcagattgctctagttgtggaagattgatttgggagtaaaagaacgtctaaactgctatcctgtggaagagaaatagatttctattttgttgttccatagggaagaaacaggactacttgggagaaactgcagagcaacacatttaggctcaggctaaaaaaacttcctcagaattagtcatacaaaattctactcagatctcttcgagtttaaggacgacccccaattctgagagtactcagggttagacttgatggcagtttgacgaggacctgcagttccccatttataacacttgtcccacacagagtcactagttgtgctaagtattagctgaaacattgttttcataagtgctctgaagctaccaagaccattggtatcattttattagacatgactattatttagctaaagacaatgtactttgagtcactgtaaggccatttgttctaaaagaaacaaaaagattctccttgggatcccaagcggaaccctgttgttctaacagtaaacatgctccccatgactacgataggtggcactggtcattcagttgttaatcttaaacttttcagtgattatttcacctggaggggatgctgacattggcacaatagcctttccaaatacccagaaaatttctgataataagcaaatggatgaactcacagtagttcagctgtggtagatgctctcgttgctggttagtacttgtagcatccatcagccacggacccgccggttcctactgttggatgtaacagattcatggaaaagaagccttgtaggtaatgtcacagcagtggtcttaaattgcaaagaatttctaccagcctcacgaaccagggcatggcatggaattcattggccctgcttatccccccgtggagacgtgggaatggcaggactgtgaatgtggagctcagttacccagcagaggggtaacgctctcataaagaactcccacagaattaattagccgcattttagcactggagactgcacctcttacatagtaggagcgatggttcagaaagataatgaaggcccttaggttattattgatagaccctgccttctttttaagcaggaggacatttcctcgttctttctcttgttaaaatgataagtgcagagcactctcattaggatgtagccccttggctcccaaggacacagtgagatttcctttccttccgtgcatgttgtctctctctctttccctgccatctcattctgacatttcaagtaaacaggcatacatttacctgttggtaggtgattacatactaataaaaactacaagtaaggaacactaggcagcccccattttacaaattggcatttagtccctctataatctcttctctggagaggagtaatatccacctggatgtaaggctgggtggaattataatgcagccctgttacacagatggctgtcttcgtctgtgacatgtgtgcacacgtagacattcttgcatgtgcttttctgtcagcccagattgatgtgtgcataggttaaattgctagagaaatcagctttctacaccagttgcatctgatacaaatttctacctctggctgggccctggtgccaagtgtttgctcattttgacagtcctcaaatttgttgctttagatttttttcctctcatcttaaaccctctagtccagactttcgtatcacactttattatgtgtagatagctctaccaagaatatcaagggtatctagtaaaatcaccctcaacttccatctccgccatttaacatgaaaacattgttattcatgtttatgtcactccctctggagaaaaacatgttcttcattcccaaggtcaaagccatgttcttcaaccaacgcttacagtctcctccatggttttgtcacatcagtcattcctttccctttgccttgtacctgctgtctttttcaccacttccctctcagctcatgaactctagcgagtttcctccaatctttaaaaatctaaaggagaaaccacctccatcttgtgtgtctccatccctcaaggtcaaagaacttttatgcttgctgtcacccttcataacccgtggatgaatagttactgtatcctattgtgctaataaaatagtttcttaatacccaccaatgactttctaataaaatagcttcttaatgcccaccagtgaccgcattctgcctagttgacaagctgttccactttggatctctctcatcccatggactgcctgactttgccactccttgttcccatccttttctgtatctttgtcaggctctcttctctttctccttaaatattcgtcagtatcccaaagtttatagagaatgttacttaacagcatggatatgaggaacaggtaggcctgaattcaaatccttgctccactacttatatggctatggaaacttgagtaaattagtttttctgagtatgttttctcatactgacttcagatggttgtgaggatgaaattagcaaatacatgccatgtgcttagcagagtgccttaggtcactgcccctggcctgtctttcccctcttcccactgttcatgctcttacctgccattgttattctttctgttcctggcctccttcgggaacccaaaagccacattgtcaaccacctgccagacacctttctcaaatagaaataactatccctttttcccaaagtaaatttctccttccccaacttggcttgatagtctctctcaagtaggaagcacagatgtccatttgacctcctccctctctcttaccctcatatccggtcgacaatccatgtctatcctagcccctggattcttgagtctagacctttctttgattcttaataccaccatcttggctaaggcttctcctacctccagcttagattattgttctggcatcccaagtcgttccccatctctattctattgtaagcattctccctgaaattgtacatatattatttagttgccttctcaagttgttctcctttgtactttccaatcccttattaacttttggctgaaggtttcatagccaatctgtagctcaggggtagaaaggcaaaaatggttgatgccctgcatagagttagaactcattaaatgctgaattaatgcagtataaaataaagcaaaataggaagtgtagtaagtcataatgtaataagaagtggggataagtggttgattaaccaaaagttagctttccattgataaatactacagaattagttgtagaaaaaagagatttataacttgatcttcatttctcacctgagcctatgacaagagggtaatggattggacaaacaagtggaaaatctcagctggcatcaatgggctgtcttctgctcccacccagtgggtgtgaagtcactctctggctctctgtatacctctccttccagccattgctgatggagccaggtctctattttttttttttttttttttttttgagacagagtcactctgttgcccaggctggagtgcaatggcatgatctcagctcactgcaacacccaccttccagattcaagcgactctcctgcctcagccacccgagcagctgggattacccgccaccacatctggttaaattttttgtatttttagtagagctgagttttgctgtgttggccaggctggtctcgaactcctggcctcaagtgatccacccaccttggcctcccaaagtgcttggattacaggtgtgagccaccacacccagcctggatctccattcttgatataggtgttttgatcctaaggagacaatcgttggtgaatttgaaacagattcttcaggaaatatagtgcaagaccaaaattgggtcccaggaaaaatcatgtgatacttcgtaatgcaggtctcttgtagacacaagaaggcacacttgctcgtttccctgggtttggtttttgttttgttttcttccccctatgtctcacatcctctcctgcaaccccaaccctccgtaccgcaggcaagaaaacattgatgtttctgcatctggcagcatgtctctgggagaagaggccggcggaagggagtttgatgtgtgagtgacagatccccaggtaacaccactggggaacacttgatctgacctgtttgaaggtgaaaactcaccaggtcacactggaaacagttgctgctgggcatggctttgatccttgtttatctttttctcttttttttaaccttcttgaaaaaaatgttttgtacaaatggatactttttcctgtgtatattttgtctgctggagcatttgtatattttgtgtgtgtgttccttgtcactgcagggcggggttttgtaaccttttgatgcagattgtgaatcttaatgaatttgtcatttgccatggaaagatgtttgttcaaatagagcagagacattttcgtccaacaatattacaggaatattgtgtagaaaataatgactaatactttgagcattccatgttggctcccattttaaacacttcatgtattaacttgtttaatcttcagaagaattcatttttcctggttttcctgttgacatttgatgaaactaaagcagagggaagttaagtagtttgcctgaggtcacacatttagtaagtgagagacccaggactcaaactcaggcaggggttctagtaccagcagtgtttatcaactgctttccaaccctgacaagcatgagtgggcacaagcatggagcactagggcttacaaaaagctccctcaggctggcacattgcctgacttaaaggtaccgaaggcatggccctgccttcaaggtcattattgcatgctggttagaggagaaatctgtctgtctcatttgcggacgtgtctccgttgctaagtagtgtcaggcatgtaggagatgcttagtacaatctttttggattgtatcaatgtaggttttgaaaggttattagagcttgtgaatcatcaaggttgaaccataatcaattaacaagaaaggggaatctgagacttctaaaatgtaatggtcatgacttgctacctttagaaacaccagcgaaaaaaacctgtggtgtcggttggatcatggctcttattcactgcggcgtttttaaagctttttcaaggattatgtggggatcccaggctcctttatgatttataaatctattatgcatgtcacgtagagattttcatgacagaatcgtcagatgaactcattcagggtataatattgtaggagaagggttggcgaggttgagggggatgccataagaaaatgcctaattcataggtagagtgtaggacagaaatggatggggactggaggccagttaggacgacactgtagaggccagtgtgaggagcaaggacgtgggctagaggaggaggagatgagcatggggaggaaagtccagggagagttaacaggacctaccgactagacaagaggatccagggaaagagaatgaagcattgttaggaaagtttcacagtatagcggcccaccgataaccttaagaacctacaaacctaacagttttaaaacgatgagcttgaggctcagaaggaaaggcatgttaagctgtcatatcaggttgattgaatagattgggtaagtctttcagacatcctaccaccaccttctgccccatgctgttaattctttaagcattgggaccatgagttctgtctagcagtgtgggtgttgagaccacatgaatcaaggaagagggcttctagaggcccaagggctgtttgctgtagaggaggcagaggagggttccaagaatttcagaaggcactgtatagctctgccaggaagtgtttagagaactgaggtgcagcccccacttctcattacaacattttactaccatcaacctctcagcagaactgctgcattaggtacctagtgtttgatttgaactttgtatttattctccatgaaaaggcaccgtgcccattgatgtcactttggtgctgctgagacagaaagtgagtattttatgtgctgtctcttttcaagcaagatggaagggtcttgtaaaagtggtttctaaggaataacctaacattttaaagatttatagaacaagcatccacttaccagttcatttaagttttacaaaacatctctgcttctgccttgccatgtcagcaaaagattctgacatttaaataaataaaatatggtgggatataataaagtgcaaaaaaaatgatgcatcaagttactactgaaaggaatattgaggcctgagtcatctccctgctgctgtctcccaaacagaagatagctttaatcttcaggctctgtgttatttaaataagctgagggatttgcgagttgggggatgctgccaaatgtatccactgaagataatgatcccatttcagatctgcaggtctattttaatgaaaggagacaggtgagggtgcagaacagaaatgttcatagcacctgaccctccttctttccttaggagtttctcaacccagcgaaattggtgagatttttaaaaataaatactttggagtatatcatgaggtaggattactgtagtgagacagggagcagtaatggcagtcaggaaaacctgtgtatgttaaaaagtgtttgctaagtctctcctgtgtgtttagtgttgtgggggttttagtcgaaacaaattagggtctcagccaacctcaaagggtgtattttctcagtctttattgattcctcttggtttcctcagggctcagaacatccaacaccttaggagcaaatgtcctttgaatgaataggtttgggatgaggttctggaagacactaacacaaacaaccttgataaattacatggtagtgacttcatcacattcttccatctagtcggagtagctggcctttgaaaattacccttatgaagcttacattttactggagaagccagacaaaagaatacgtaaatgaatgaatgaatgagtgaatgaacaaaacaaaattatctctcgttcatagatcaaattgtcctaaacttgctcattaagacttacttagctatgcattttataccactgtccctgagcactttaatcatttattaattattcaacctctacattgctttaggtgaactggaggcatgagacaagtttgggatgcagactttttctttttattgtccttaagaactataatatatgcagttagttagaaaccctgtcctattggtacttttgtttcagtgaacttgagtttaaactttaaggcacagaggttattacagtatcatcttcaggaagctactggtactgaaaagagcattcttcatgccaccccagtatcatctttgtactcttacctttgtgttgagaagggatacatgtcacttataaaacctgggtatgactacgcaagccaccttcacatttgggatagaagattctacaaaagtaaaattcacaatctttgtacatacacagaagccagacttaccagcatgtattaaatctgtctttattttggatcatggcatttatggagatcactaagcaggcagctcatttgaagtgagattcagaacacttacttattttatccatttagcaaacatttacttaactcctactgtgtgtactacatcactggggaagacaattaggacccagtccttgttttcaaggagtaagtactctagtccaacatgaaacaactaatgaaactgagcagggataggcaaggcagaggtaagtgtgccttggaagaaaaggggaagaagaaatggtggatgttgaccaaggctggcactaggtaggctccaggttcccctgggatgctagttttagaggtggaagggcagttttgaagtctcatttcaggagcagggagaggctgtgcgttgatggttccagtaggatggggaaaggaggaggagtcagtgcagttggaccaggctcttgtctgtccatctcatctctccccagggataggatgacaaggaccccagaaatcaacagtgacaccagctgagtgaccacaggcagtaaacaccttacaatagctgctttgatttgtatccttgctggcgtatcttaacaacatgacgacatttaccaaatgaatgactgcttaccaagcaccagtctaagtgcttcacccatgttatcatgtttaatcttcccaattttgtgagataggtagtattattcccatttgaaaggttggaaatctgaggagtgaagaggtcacccagctagtaaaaggtagagatgatgcaacagacatacatgtccatgcttgtttgactgtaacacgtttactcttaacctctaagcaatggtgctttccttaatatagaatgtccttcgaaacatcccaatgccaaaattcagcatattttcatattagaatagctttgcgttaggtctctttttccctgaacatttcttttctctgttttgcagaatcttgttggcctcctttaaatatcattataaatgttggcagtgttgttttaaataattgtgaacagaaagtaaggaagcatatgcactctgatctttttaaagcgatttcattattgtaaaaaattctggttacaactcactaaattggtagtttggagcacctttgggtgtactcccagatactctctactcccctctcctccctcccacaaaaaaacagcatttctaaccacagtgactaagtcatgcacttctaagttagaaaatttatagatgggggaaaaatgtagttgaccagataaatatgcagatagttgggacatgtctaaagtgaaacactggtttcctgacacatattcattaaacatacagtcatgtcacaaaaagagattatggtcaggtgaatttattattatatgtccctcccgccccgagaatagtaccctatagtttatgaagcatgttgataatgaagttatctgtttcatatactctttatgaaaataatattttcccaagaagcctgaaaaacttacttggtcagtccaagtgagaaaaaattgaattattttgtatttagcattttaatccccaagttagaagggacatttaacaactgtactaaattcaaaaggttacttagagacagaattcctctttagatctaatatgattgtctggttttaacagtttggctttacaggaagacttggaagaccagcaaaactgccctttatttgtataaactctgcttgcatttgtgactttttttaaagggaaaaaataaaattctttataggcataatttttataaattaaaatacattatagtatatttatgtgggtgaagcttaggaaattctttataaaatgaactgtattttgaattggtcaactgctacattgtccaaaaatgggaatggtgattctgtggatgaagtggaagaacaaggctattctttactgtcaaaaagggcctttatgctatggtttaaaatctttctgcaaagcccttggatgttataccacacatcctgtagctcctacatgccaaactcccagctttttttatgtggagccccaggaaaaggtgatcacttacctgttagcctcatgcctggtggtgataagaaagatggctttggtgatactaactgaatgcctactagaagtcaaatgtgttgttgtttcaattttatggcctctctgctggtgagtatttaaaatgagaatcgagcaagtgaaagtgtgtcatagttttttgtttgtttgttttttaattaagaggaccaaaccaaagaaataggcccattttgttgagagaggcagtccaacacagtggctcaaagttccagagcttgcctgcaagctcaggcagatgctggtaccaggaatgccctgtacggataccaattcattcgtgggagatagtacaggggcaggtaatgctgaatcccagctccacttatgtccagagcacaagtgatggcacaaagccctagctctcttcatccttccactctcagcactttacatgtgttgccttcctctgatttgattccaagctcaggccccagatgggggcctcccagcaacatgtccctctccctttcctggcttaaaccaattagagtgggttctgaaactggagctggagtttatcccacagaaattgaaagtacagcagggatatttcccaaaggaaagttaggatactattttactaagaagattgagaggaggaggtgacaaaaacaacagatgtctgtacatatgtgagggtggagctgaaattgcttggtttctacagttagcattcgctcaaaacaggcagacctaagtttgcaggtgaggccagtccacaacccaactcagaggctgagacaagcaaagtaagtggaaaggagacggatggtagaaagaaataatatctattgggtgtctgttctgtgccaggatctttatgtttgtggcccagtgtacgccttgtcaccctcatgaagtggtattggaaggtttaaagggtttggagataagggtaaagatagatgtagagtcagggtcagccactgtagccaagagctttgggtagttccagggcaaactgaggaagcagacctcttagagggtaaaatgggttatgattttctaaagaggaaattcttctgtttgacctagatgtgaactgaataatcacttctgttgtttggaaagccataaagccagccaaccatgccacaatcctgatctcgcaactcacatatcttatttttcaacaaggaaaatcctttcaaagagataaatgtgaattctgtgtgccatgtatatatttgtaccacatttaatttcattagctataatatcatgtagctgtgcttatttaactgcttagcccagatggtaatgccttctgaagaaaaatggctacacagtgtaattgaacatgtcctattgacagagttacaacaacccattttccccattaaatataggtgattcaataaaatgaacacagagtctattactctgccaccatttctagctgaaaatgcaaggaggaaatgttctacaaggtgaagaaatggcacagttatgttgcatgcagtgggaggacaggcgtaaaggcaggcctcctcctcccgccttggacaaaagaggagctatttgttgacactcagatttggttgggaaccaaggggagaaccttggcgtcatcagctaagacctgtctgaaagtgatgatgatagcagatgtgaacatgaaaactaggccgtacattttggaaaatgatgtaaaaggatttggcttctaaatggaatcaagtggtagaaacagttgtgttggctctcagcagatgagggtcttgggtcttatgaatgttgtcaatcactagtataaaaatattctggccaaattagtatatgagaacaactatctgatgaagctatcactgcaaatatttttgtattcattgaaaaaaaattgccaaggcagaaggattgcttgagcccaggagttcaagaccagcctgggcaacatagcaagaccctatctctacaaaaaattttaaaattgactgggtggggtgatggtgtgcatctgtggtcccaaccactcgggaggctgaggtgggaggattgcttgagcctagcggttcaaggctacagtaaactgtgaccataccactgcactccagcctgggcaacagagcaagaccctgtctcaaaaaaaataataattacagggttggcctccctgatcctgtatatattgtctatgaaattgacaggtttggtgtggtctaagaaagtaagtcatactcgacactgaaactttcctaggaagagcactagagatgatgtgagaagatgttattgaggaaaagtttgggaatggcaccttgccatgtggcgggacttattgcagttgctatgtgtatattttttcttagttttcttcatgttttatgagtaaagacttacagtcgttctctgtctttgcttatggggaagttgagaattttagagtcaaaaagacccaaaagcccactctggcttaccctctcattttcctgaagaggaaagtgaggcccagtgaaaacccacacaactcaggagagatgagccagggtccaattgtcccttctctcattactgcattttgcccttattccagtgctaagggacttttggggatgaaaggagagaagtgggaggctggaaggagtgaggtttcttgtcctcacagctagtcacccagagaagcttaagaaatcattacaggcattgtggctcacacctgtaatcccagctctttgagagactgaggcgggagcatcgcttgagaacaggagtttgaggctgcagggagctgtgatggtaccacttcactccagccggagtgacagagcaagcccctgtctctcaaacaaatataaaaataaaactgaaaaaaagaaattacttaaaatatttttcttatgtaaagaagtacaaaatttgaaacccactctcctaaacaataggaattcgtacgaagagtgatgggcatatattatgcctccctcttcttcactcctgtccagtgtgtcctagatatgggcgtcacaatggctagtatatacctaaatgaaatgacaaaaagtgaagctgaaccttgtcttcttatggagaatatattcagaaggtagaataaaaagatattttagggtgattgagtttaaacaagtagaacctggtcactccaaccccacccccgatcagattctcaaaaattagacttagaaatcatagtcctggatgttagtcaccctttctgcaagggaattgctatctgaccttgcatattgcatgtggacaagttcagagccatcagatccacctgagaaaggaggcaggaaaagagggcaagccttatcaagctgctgtggggatgaatccagtccggtggaagaaactatcccacctctgagccctgccagcacaagccatctgtctgcatctaacaacaccatgggcctcagctctgaagcccctcccttggtgactcagcaatcaaactgttcattttgcacatgttttgtgtttgattcatttagtcactgagtcttcagtttctctgcctgctttttgccctgctgatggggaccagcctccaggtcagcacagcaggttgagcctagagaggcaatcacagtcccaggatgaacttttttttttgtccctgaaaggggcctttccaggagactccccaggggctgctgatatgctcttccaaggctttcctgattgtctgtccacccatacccaaggggaactgatgtttctatcctctcccataggccttttctaggctttttacccacttccagcctgtctcctaggggcctgattggccctctccacttctcccaaggcagcctttcttcacttgcctcagccacctaatctctgtcccaccagttttggggttttccttactccatgcgtttacctttccacacttgcacatgcacacagcaccgcatgaaaactcctaggaatctctccttcaacatggcttaatagtccttcttacctaatttcccagtgacctctgactcacagttacacaaaggaaatggacgtacacctggagcccagctgacttgggctaaggttggtcatggctctaggtttggtttaccttattggctagaagacagtagaggcccaggcactgtgtgctttatggatcgtctttctaatttacttgaacctgggatccatggtcacttctaagagatcaagtctattttactctaagtagtttctttgagtaaggttggacatttatttcccttgacataaggtaaacaagtgtgcctatgagtgtggcaacaatgaggagacattgaatcctcaagtcacattggcatgcttgttgaggcttttaaacgatctcagtatcacagttcttggtaataactgtaaaaacataatcacaggtggcacttggcatgaaaggtatgcttggttcttttttttttttttttttgtgacggaatttcgctctgtcgcccaggctggagagcagtggcatgatcttggctcactgcaacctccaccttctgggttcaagtgattctcctgcctcagcctcccaggtagctgggattacaggtgcctgccactgcgcctggctaatttttatatttttagtagagacagcattttgccatgtttgccaggctggtctcaaactcctgacctcaggtgatctgcccgccttggcatcccaaagtgctgggattacaggtgtaagccaccgcgcccggccgctcagttcttacataatgagggcatccatggatttttaaatggaggtctttatgtttccagttccgtgtcttcccaccttcagaaagcactattttgctgaatttgtctaaagggcagtagcttctagagtaaccccaggagcaggtcttctcaaaatgcctatttatcagcctttgcatgagttttgtgggagctggatagaatggaaaaagaaatgaggaatgttcttcagatatgacattgtacagatctattcttccaaagaaatttgccttgagaatagtactccagacatggaaggggctctaggtatttaggctatggcagaaggtaacttgtaacatcttttcagaatttttgcaacctctgattctttatttgacatttttctttcttaataagatgcacagctagtacagcagcatcctgtaatccatggatttggatgttctgggcgtaatcatccctcaaaatgcaatacaggtgtggttagtctaagccatcttcctgcaaaaactttctattcctcatcccctccttagactccctgtttttgtaatatgttgtcaactgaaccacatttatcataaaatttatcattttctttgtatttctactgagatctagatagtcatcaacatgggacatctttccagcttgaagcaaaaattcttggtacttaggtatctcctgtagccttggtagaggcatgtgtggttaggcctttctgaatattgaaaagagctcccttatcccccagttggatccatggaactcctggtcccaaccactgaattcagcactgccttgtttttgcctcaataccacaatgatggagagaagctctactttaggattcttatctgacaaattagacagcaggaccccttctaccttctaatatattagatttaataaaataggcatatactctctactccagagaaccaaatgcctttcagcttgggaaactaaaatacaggggtgtttgatttgtgtgtggttttgcttgtttgttttgagactgagtctaggtttgtctcccaggctggagtatggtggaatgatcatagctcactgtagccttgaactcccaggctcaagcagtcttcccacctcagcctccctagcagctgggactacagatatgcaacaccacacctggtttattattttttttttaatagagacaaggtcttgctttgttgcctaggctggtcttgaacccctgacctcaaatgatcttcccacctttgtctcccaaaatgctgagagtgcaggtgtaagccgccatgcccagcagagtgagttgttttttaagatcacactgcaagtttatgtaagaatcacttgaataactttttgttcctgttgggttaagctggtgggctagatgcttggaagttgtagaccttactctcaagaagtttctgtgcaagagagcaaataagcaataagtaaaattaaccacattcagcagtaaagaatgattttaagccaacagtttatgatgcaagatttaagagaatggaaaagaagttatttcttttaaaaaaatcgtttgagatgaaattcacgtaatataaaattaacaattttaaagtgaacagttcagtaggatttagtatatccacagtgttttacaaccactgcttctatcttgttcccaaatattttcatcactccagagtaaaaccccttacccattaagtagtctgtacctatcccttcctccccattgcccttagtccccagtaaacctctgatctgtgttctgcctcttcagatttatctattttggaatcatacactctgtgaccttttttgtctggcttctttcacttagcataatgttttggaggttcagccatgtatgtgtgtataattactccactcctttttatagctgaataatactccagtatttgtatataacatgatttgtttatctgtacatgcactgatggatgtttgggctgtttataccttttggctattgtgaacagtactgccatgaacatgtgtcacatatacttgtttatgtacctcgttttggttcttctgcatatatacctaggagtggcattgcaggacgatatgatacttctacattaaactttttgaagattgccgaactattttctagaatggctgaaccatttcaagttcctaccagcaatatatgagggttccagtgactccacatcacttccaacacttgatattttcctttttcttaaaatagccactcttatgggtatgaagtggtacctcattgtaaatttgatatgcattttcttgaccaatgatgttgagcatcttttcatgttttttggccatttttatatttttttttagagaaatgtctactcaggttttttgctcatttttcaatttggttatttgtctttttgtcattgaattgtaagcattctttatgtattctggatactagatacatatgatttgcaaatattttcactctctaggttgtcttttcactttcttgataataaatgccttttgatgcacaaggtttttaatttgatgaagtcttagcctgtttattctgttgtaacaaactacttgacactagagaatttataaacaaaggaaatttatttcttacagttatggaggctgggaaatccaagaccaagatgccagtagatttgctgttgggtgtggggtgctcgctctgtttcaagattacaccttgttgctgtgtccaagtggtggaaaagcaaaaatgccaaactctgtgtgaagcctcttgtataaaggccttagtcccattcaagaggaaggagccctcatgacccagcctcctcctgaaggcctcacctttaaaactattgcattggagattaaatttcaacatgaattttgagaaacatattgagaacatagcaaagtccagtttatctgttttttcttttgttgttaatgcatttgatatcacatctaggaatttatggccaaatccaagatcatgaagatttaccactttactttcttctaagagttttatggctttagtttttatatttaggctgttgatccacgttgaattaatttttgtacatggtatgaggtaggggtccaatttcattgttttgtatgtggatatccagttgtctcagcatcatctgttgaaaagattattcttttcctgttaaatagcttaggcatcttgttgaaaataagttggccataggcatatgggtttatttctcaactctcaattctatttcattggtctgcgtgtctatccttatgccagtagtacactggtttgattactataggtttgtaattaagttttgaaatcaggaagtataagtcttccaacttttttctccttttacaagactattttggcgattgagggtccattgcaattccatacaaatctgtggatcagcttttgcatttctgcaaaaagatcactagaattttgatagagattgcattggatctgtacattaccttgggtagtactgacatcttaacaatactgtctcccaacccatgaacacagggtgtccgtctatttattcaagtcttttaaaatttcttttagtaatgtttattttataattttcagcatataagtctttcacctttttggtgaaattgtttcctagatatttcattctttttggatactagtgtaattgtattattttcttaatttcctttttagattgttcattgctgatgtgtagaaaaacagctggttgagaatttttgcatcaatgttcatcgcagatattggcctgaaattttctttttttgttgtgtctctgccaggttttggtatcaggatgatgctggccttataaaatgagttagggaggagtccctttttttctattgtttgtaatagtttcagaagagatggtaccagctcctctttgtacctctggtagaattcagctgtgaatccgtctggtcctgggctttttttggttgttaggctattaattgctgcttcaatttcagaatttgttattggtctattcaggaatttgacttcttcctggtttagtcttaggagggtgtatgtgtccagaatttatccatttcttctagattttctagtttatttgcatagaggtatttatagcattctctgatggtagtttttattactgtgggttcagtggtgatatcccctttatcattttttattgtgtccatttaattcttctctcttttcttatttattagtctggctagtggtctatctatttttgttaatcttttcaaaaaaactagctcctggactcattgattttttttttttttgaagggtttttcatgtctctatctccttcagttctgttctgatctatactggcaaaccaaatccagcagcacataaaaagcttatccaccataatcaagtcggcttcatccctgggatgcaaggctggttcaacatatgcaaatcaataaacataatcgatcatataaacagaacaaatgacaaaaaccacatgattatctcaatagatgcagaaaaggccttcgataaaattcgacaccccttcatgctgaaaactctcaataaactaggtattgatttaacgtatattgaaataataaaagctatttatgacagacccacagacatactgaatgggcaaaagctgaaagcattccctttgaaaactggcacaagataaggatgccctctctcaccactcctattccacacagtattggaagttctggctaggcagtcaggcaagagaaagaaataaaggcattcaaataggaagagaggaagtcaaattgtctctttttgcagatgacatgattgtatatttagaaaaccccattgtctcagcccaaaatctccttaagcagataagcaacttcagcaaaatcccaggatacaaaatcaatgtgcaaaaaccacaagcattcctatacaccaataatagacaaacagagagccaaatcatgagtgaactcccattcacaattgctacaaagagaataaaatacctaggaatacagcttacaagggatgtgaaggacctcttcaaggagaactacaaaccactgttcatagaaataagagaggacacaaacagatggaaaaatagtccatgctcatggataggaagaatcaatatcatgaaaatggccatactgcccaaagtaatttatagattcaatgttatccctatcaagctaccattgactttcttcacagaattagaaaaaactactttaaatttcatatggaaccaaaaaagagcctgtatagccaagacaatcataaggaaaaagaacaaagctggaggcgtcatgctacctgacttcaaactatactacaaggctacagtaaccacaacagcatggtactggtaccaaaacgtagatatagaccaatggaacagaacggtggcctcagaaataacaccacacaactacaaccatctgatctttgacaaacctgacaaaaacaagcaatgagagaaaagattccctacttaataaatggtgttgggaagacctgctagccatatgcagaaaactgaaactggaccccttccttatactttatacaaaaattaactcaggatggattaaagacttaaacataagacctagaaccataaaaagtctagaagaaaacctaagcaataccattcaggacatagacatgggcaaagacttcatgactaaaacaccaaaagcaatggcaacaaaagccaaaattgacaaatgggatctaattaactaaagagcttccgcacagcaaaagaaactatcattagagtgaacaggcaacctacagaatgggagaaaatttttgcaatctatccatctgacaaagagctactatccagaatctacaaagaacttaaacaaatttacaagaaagaaacaaccccgtcaaaaagtgggcgaaggatctgaacagacacttctcaaaagaagacatttatgcggccaagaaacatgaaaaaaactcatcatcactggtcattagagaaatgcaaatcaaaactgcaatgagatacgatttcatgccatttagaatggcaatcattaaaaagtcaggaaacaacagatgctggagaggatgtggagaaataggaatgcttttacactgttggtgggagtgtaacttagttcaaccattgtggaagacagtgtggtgattcctcaaggatctagaaccagaaatagcatttgacccagcaatcttattaccggatatatacctaaaggattataaatccttctactataaagacacatgcacacatatgtttattgcagcactgttcacaatagcaaagacttggaaccaacccaaatgcccatcaatgctagactggataaagaaaatgtggcatatatataccacagaatactatgcagccataaaaagggatgagttcatgtcctctacggagacatggatgaagctggaaaccatcattctcagcaaactaacacaagaacagaaaaccaaacaccgcatgttctcactcctaagtgggagatgaacaatgagaacacatggacacagggaggggaacatcacacaccagggcctgttggggggtggagggctaggggagggatagcattagcagaaataccttatgtagatgatgggttgatgggtgcagcaaactaccatggcatgtgtatacttatgtaacaaacctgcaggttctgcaaatgtatcccagaatttaaagtgtaataataataaaaaaagaaatacagctgatttttgtgtgttgatcttgcaattttgctgaattaattttattagctttggattttctgtacatagaataatgtctgcaaatagagaggccatttctttctttttcttgtctaattgccctgggtagaacttccagtgcaatgttgaatagctatagataaaagcaggcatcttcatcttgttcatgatcttaggaagaaaagctttgtctttttccactgagtacaatgttagctgcaggtttttcataaatattctttatcatgttgaggcaattcccttctatttctagttttgtgagtatttccagcatgaatgggtgttgaattttgtcaaaggctttcttgcatcatttgagatggtcctgtggtaagtaaaatcttaaagagtaggactgataacagatacagagaaatgcgattctggagaagtaagtaactaacttacagtggtaggtgcatgactagtatctgcagagattagtgcacaatctaaatcactgtgtagagtattgggggcagaggactgaatgcagtacaggcaagggcagattctgagtagatcagggaggacttgattgacagattgccttcatcttgtctccattctggagatccttatggtttctgagcccagtcaaactaggaattgtacgccttgctcattgttctctccttctgtgtcttcacttctcttccttctattgactttcatgtccctctaacaatctttcctttttaattttggtagaaaagtgtcatgtaaaacaaagaaaaaatggagttttttggtactgtgtgataaatcttatgattttttagaatttaggagtacacataaaattgagaggtgagccaacttttttgttggtttatttctagttatgtatggagatagacctgctaaccagccaacagctagtgtcagggctgtaaattagactggaggaaagaatgaactgcacatttctagctcctgggccaaggttcctgagatttttgccagccctcttctagacagcagcttggtacctcagctgtccttctcatcagggagacagatggaacctctgaggtttcctgttgaggcgtctcagaattcaaagttgttatgatgtgtgggctttgaaaatgccacacgtcagggaagctgagtttttgtttctcaggctttcttatattgagcatgtgttcctttctgtctttgtggcattaagtttcattatgtgtgtccccaagccttttcctggaatctcaacagaggatgggttttagctctgttggaagttacattccattaagtgtgctcaaagatctgctttactacacactctctcctgcccaattcttaggccagccccttttcctctccctactcttgtctaattagtcctctccttcaaaaggcagccctttcatgggattctgctccccgaagtagtgggccctgacttaagggccagcccatctttgtccatggccatacttatcagggatgtgactatttagctctttaaccaggagtctgtcctttctagagaccttccagcatactattaacctaagtgcataggcagaggagaccaggagcacttggtacaaatgttaatggctttttcattagcgtacttcatcacagaattccagctgttggtggcaggaggtgacagtgaggcgtctcttggataagaaggacgtggagatctacggagatgaaaactgaaaagatgcatatgattagtcatcagaaagatgtttgacttctaagttttttccaacagcaggtatggctgcatggaaaatgcatacatccattgttgcaaggcctttatttccttatcaccatcatcaagcagtattaatgaagaagccaattgtgcatgacatagtgcaggtctctgtatgtagttatggaaaacgcttccacagttaaattgagtatggatatgtaaagtgattaaccaagacttgacagctcacacaattctttaattgcagcaagcatctcaagtaaatacataacttttaagaaaatccagaactataaagtcttaatttttgaaacaaatcatgatctttcacgttacaaacagatctttctttctaaaaagatgattcacaatcttttatgctggaacatcaaacatagattttactttacttctttttaaaataattggtttgttaacagttaggaaagccatacgtgttatttgttaaaaaaataaaaataaaatggaacaataaagaaaatgtatccaaactataaaaagcaaaagtcaccaacttgtcccagctgcaccccctccaccccacccatgtttctgttcccacaggacaaccattgctagcatttctctctgtagttcatctcttttgaaagtacatatgtaagtgtgtgttaaatgattatttcagaatttatattgataaatgcctatgttttctattatttcaatttgcccacatggagggtgattgttttttagtgtgttcccttagcttctggaatacaaaagctgatgcctgtataccttgactttgctgacggcagtggtagtgagtttagtgctttctacttttagctttatgttttgcactatttttgaattatatcaattagctatgatgtatacacattcaggattctttaattttgggtaaaaataattcttcactctgtgcctacttagctaagaatatctttaacagaggcagagctgtgaaaccaccgagcaccaacactgcctctctggcttttgcagggacgcttgggtttcaggctgtaactcttagttgcattagcctctgataacttttttgttaattgataagtatgtgtatgactcatcaagatgctggttgctcagtaagataaaattatattctctaacactacttctcctttagaagcttacttacctgccttggtgtcttctgtctcggtcttactttgttttttagtttgtagtttgttcttcagcttactaaacctctttcattgactgtggtattggctaccgatttaaaaatccttgaagacttaaaactcagcagacacgtacagggtggacccctgctttttctcaagtctcccttcatctccaggaactgaatttttcatgcagtaattaaaatttgtaggtcaagcctcccatggcaccgtttgctgctaatatgggaaagcagtgatcagattcgcttatgctgctcttcactgagctgagacttaaaggatgaagggtgacattttcccccattttgtaaattaatgccattgatctgcctaacaagaacaaagttaggcttcaaaataccaaatgataaagagattaagactttaaatggctttccaaaaggcaacctctattgtaaggctccgagctgactattgaactttcaattagaatttctaataggctattgacttaaatggacaaaatgttacaagtgatagctttcaagatgacaaagattgcttcttacgttctggaatattactttatgtagcgtgcactgttctggagggtgaataataataaactgccctccccctgtagagtgtcttctgcatctgtgctatagttttctcaaaggtgaataaatgcattttttaaaggcatttttgaaatacttgctttttcatgtgtttgctgaacacaggttttatgaaacctttcatggcagggaagtcccattagtctttagcactgtggcactattcttcttttatgaaaaatagcccatgtggtatgtatttctctgcacacatgtgtgttcatgcatgttaacatgtgtgttcacagttgggacaccagcagatctgttgtctatcattgccatgaggatcagtccctgaggccttgctctctgcctcagtttactgttgttggaagctatgattcttttccacaatgggcttgcagtgtagtgtgactcaatttaggccttgttgtgaaacactagctctaatacatttttaaatactaattttacaaagaccagctacctcttctaggataaagggttaatattatgcttatgttacagtgcattaaaaactctaattaaaacagcattacattcccatctgccaatctccagtaatcttctttaattgcagtaattaaactatatttacatgttcagaatacttgtaatttagcaaattgcactctctgctctacatttaatcaaacaaccagttccagtatatttagtgtggaaagaagtaatttcaatgttttgattactatagcagatttgacagagtaagtgcccctctagtagagggcttgaaagggaaggcaaacatgaaatatagtcatggttttgattgtcatgtgaatgcctaattacatgttggaggattaactattaaagggtatcatggttgcagttgatgtttagaaacagccggtattacagatagcatagactgtcttttaggaaaatttcacaagaagttttctctttaaaggttgtgagatcataggaaaatttagtgaaaagatcgcctacattgtataattgttattatgtcttctacctgtgatcccaaagcctgctatacaagatggttattttagtcttcccagttaaagcccagaagaaattcaatgataaacaaccaagagaaattgcaatgattatatcaattcagggatgagtattccctcatttcggtatcttttggcaagtctggttgactctggagaggacatgtggtttcctggaaaggactcatcagtagaagtcaggctttttttattttaccttttgctgctgttgttgttttaaaccatgactctctactaggctgttccacctaacccatctccagcctcatctcttatttatttatttatttatttatttatttatttatttatttattttgagacagagtctcactctgttgcccaggctggagtgcagtggcgtgatctcggctcactgcaagctccgcctcccgggttcacgccattctcctgcctcagcctcccaagtagctaggactacaggcgcccgccagcacgcccagctaattttttttgtatttttagtagagacaggtttcaccatgttggccaggatggtttcgatctcctgacctcgtgatccgcccgcctcagcctcccaaagtgctgggattacaggggtgagccaccgcgcccggcctggcctcatctctttttttcttggttttctcattttaaaaacaagtaacagtgttgtgaatattgattagattcaaaggaacaatgtcttagtcatctcaaagctatttttaaaattcttattgttattatctctttgcaccagtatgaaagtttctgtttctttatctagataaatttgactgggatattgggtattgccatcaaatctctgttatccaaaacaacgtgctaatttattcaacacagaaatataagtaatactctctttttcagtagcttctttttaattatttgatgttaacagtatttctgagaatttttctctctctccacttcggggtcatctattgtattaataaggattatgaattaatgaaaacaaaaagctagtctagcgtacctgtttaaaccaatgtgaaaccttgcttcttgaccatatgaaagagcaaagctactgaattgttaaaatgatatgcaggagtgaggatccaagattttcttcatgggtcagctagtaacttactgtgatactgagagcaacatgtttgactgatttaagtctcagattgttcaaggtggggtagagaatagggcctggatttttttggttcatgaagagtcttgacataaagtaagtattagactttagactgtcacaggaataaccattcagttcaaatctacactcatttctgtgttagattagtgagaatttaacttctgaaaaaagttcaggcaaaataccgctgatgtactgcactaaggagatttgagagtgccagagatactttgaaaggaaaagagatgtaatttgaagtggaggacagggctagccagggttaaaattgcagctcttttacttagctatttaataccaagcaaattaccttatcctctgaggtcttgtctgtaaaaatggggataataatacatacatagtactacactattagtttttctctcctatgacttgccatctgtgtccatgtatggagagaaacacacacacacacacacacacacacacacaccccgtaataagttaagagtctttggaatggtaaatgatttgaacataaataccagtacacattttttttaataatgcagcataaatgtcaagatatatatgcataagggatgaggtgtgcctagaagctgtaatatctagaattttcgcaaaccttatttataaccatttgtttctgaaccctaacaattcttttctgaaactgttaactgaaagatctgaatctcactatttatttcacactcttcacatagaggtgctaatgagcagcagaataaccccaaaaatggtccttaatccaaacaccgagaagtcaagttataagtaattaagaatacactggatggaacatacctacatggcagctagcatctgtgctttccagaggttgctggggacggttagttcagttctcatttttgatcctctttggaaactcaggagttaaggtcagcatcctcagtacaaaggtacttgaacatgtatgaatctttgccttcttgaaaactttttatcttgggaataaggaacctgatacaaagagaatctctagtatttcattccatcgagagaagttttgacatttacaattctgctaatttcacacatcatttcgcagcatgcaggattttggcgcctgccaaggggactgcaaattctttttggaaaaagtacttttttgggtgttggaagagttttgagttacagacacatttctttaatagtgttcttgaaatgtccatgtggtcttaatatgtaaatcatatgaaactcaaaacccactcctgaacttactcttccaagaaagctttaaaacagccctcattctaatagtaaggctgttttcctcttttccaatgtttatgtatactgtataatgtttactgtataatgagtttattgtataataagggactctgatttattagctcttcattattctcattctgtcagcttcccaataaatgctacaacccttggcagagacatgagtctcaatcaggtgatatcattgctttttaatgaactcttcttaccggagtaacagcattacatgtgaaataccttatcctgcattattaacggaccgcagcataaaaggcacaaaggcactgagaaggttgcactgaaaaatggggcagaattcattaccaattcgatatactgtcagctaacagtctttgattatcatatttacccttctgaaactgtgaaaaatcatgggcggagccgctgtgaacaatagcatgtgtaggcattttgtaaatgttgccttagttgtttaatgcccaggctgactgctggaatttaacacagtgacaactttctcagatggggcatgaaaaaaactgtgatattttactacctgagaagttaagcactgagatagttaggacccagctctcattagctgaatggtagatttttctaattagttctttctagtgcaattagcacgaaaagagtctaatcacctcatgtgaaaccaatctaatgctcagaaaagaattcccttggcctctctttcagattggatcttaggattttcagtctgcctccttaaagaatggaatctgttagtgactgattatttgaacggtaaggacagatctgtagaaaaggcaagaaatggacaacttattgacttgcagtgcaagtttggctggagaaggtgtttagaaatattcattaattggcagttatcacttcaactataggttctggttttcttgatttctttcattttgaaatgggagacttgggcccgggacagctatagttcagcatggctgcctctctggagggcatgaaacatactgcacattagaatcaaatgcattcggggcctgggactactgggcttgctttcttagcctctgcagtgcccagattcccccatcagtttttgctaatctgtgtgttcagggctttgcctgtcctctctctctccctgccttgcagtcatctgtaggcaccacattcatttttgaactgttctctaatttctagtgcccatccatcacttcacatttcttaagtaagccaactctgggcatctcagttgatattgttcatttttaactggaaaggaaactataatgacagcatttctggcacataattttttctttttttttttttgcgggggggaagtcgcttgccagaagatcgatgagaaaatgctgagtatgtgtgtatttattatcaactatgcagaaaatgggcatccttgctcatcaggctacagagggtgacaatattgaatttccattgttcatcccatcactgcccagtagaacttcccatgatgttggaagtgttctgtacctgcactgtccaatacaggaggcactagcgacatgtggctgttgagcacttgaaatgtggctagtgagactaaggagctaaattttaaaatttcatttaattttaatgagtttaaatttaaatagacccatgtggctaatggctaccatactgaacagggcagatgtagatctcttccacctcctaaccactgtaccccaccttacacatagctgcatccttaacagagaatacactgccctccgcagcctcttgctatccattctcttcagctttgccttaaaagcaatcagactttttccagtgctgtctggagtttgacacaaggcattcccttggcttgtgctatctgtagatcattctgtatttcaccgtggcagtgttttgttctaaagttggaaaagaccttgtagttttttaaagagccaaaatacaggattgtttctaagaaaggaggtggccagaatcagtaaatttaagctcatttgtggaagcttccaaatctcaaacctagggcagtattgaacacctctccaaaaagtcagattaagtatttgcaaatggcttcaacaaactccctctctatgaaattttaattatagttgattaaatattcactttaatcatcttaattaatgatatttgacaaatattttagctttgcttatgatattcacttgctctgtcagaactctccagttcacactgaaagggtaaagttaacaacctggacagacaggcccatcatgtgtgttatgacctatctggtttcctactcgcatggttagaaggctcattttattgctttgaactctggaattaatcctgcttaaaggagaatagtaagaatactgtggttttctgctcaacagaatgcatgttcatttattccacagacactaattgaaggcccattgtgtgctagtaattgtggtagtcactgagaacgcatggatggaaagacactatctatcccactggattgtaacctcaagccactggaacataaacagttaaaagtactatatgataaatcttctggaagacgggtgatggaatgtaagggaagaaacactaagtggtggtttcaaaacagaaagacttttaagatgtaacatgtaagggaaattttatggatataagggaatacaagggagagtcttaaggggattacaggattttgcccgggataaagagaaggtggggcatttgtgaaggggattatgttttcctaattaactgtattcttgaatgtctttgaagaaaggagtctctcctttcttcattttgtaaagcaacagtgtgtgttagaggaattgctgttaggaaaggaatgaggatatttggtgtgtaactgtgagtgctgggaaatgaaacaaaaggcagccctacctcaggtcctggaaaggcacatagtggtgtgagtgttgcagcccattgaagctacatcctcaattctggaaactaacaagaacagcattagggtgaggccagagatccacctaaggtgcaaaatgtaagggggcactcactttgagggtcgtgcaggttcaggatcagtactgacacaaccctgagaatgagtgtctcctaaaattgtgtgccctagacaccttacttacgccctgaaacatcccagccctgggtttttgtgcagtgaatgggcttgaaaagcaagtagataagaatctgaaccatggaaatatggcagacatggcagaatagaaatcaatgagacctatttgcaaggtaaagtcaagagaacctagggcagaaaaaaatacgaggcatgagagaggggaccctaattgtcctgtcactgaattctggggatcttttctattgcctgatactgacttttctccaatttctcatattcctcagctcctgccctgtcctgaaggtcatgcccagttcaaattcagcccttacctctttgctaagtcccatgccctcaaccttgttttcagagaaggccatgagaactggagtttttaaaatgtccaactctagatagatctgctttactgagtggtcttaacacattcagagaactgcattcttcttggctctctaaattcagtgaccttattttaaaagatgatcaacatgggttagaaccttttgaggattaggagacattttagcaagtttatcaagaataagcaaagatgacatttggctagcagtatgtctcccccaccccatcctgcaaaaccattttttttggagtgaagcttttccatttgacaagtttagaattaccaatactgcttgcaactccttccttactccaaactctgggatgttttcaggagggactcttttcttcaaaggcatccaagaatatagttaattaggaaaacatgcaagaaaagacatcttggctcctctggccgcctgttgtactcttccagcatatgctattacttgtctcagataagtagacaggtggctgtttgcaaagcagggtccaatgtgcctttgactcagagaagtttggaaacaaagccctctgtataataagcttctcactgtatgctgacgtcttctgatcttgcctattccccattacctacagtctgaaagaattttgtagggagtgtgtggtattctgcagaaggctattgtagcataacttagacttagccggcatttattgggcttagaatcacaaaatctcaagattgggtgactactggatggttatctaatccaacttccctccagaaagtctcccatacagtttttcccgcaaagtggccctcgagccataacttcctatgacagagtgcttactgcctctttgttcaacgctggtgaaacctcagtgatacttataagttaactttcattccttcagcattcttctctttagtgttaatttctttgatggtggtaccactttccaacttttatatgtggcctcttaaaatcagcttacccagagaaacttcctgcctagctcctgatttatgtagcttctcaccaccatgccctttctcccttcttataggggcagtttcacaattttgaagctccttgattcccttgagccattgtcctttccaaaacttgtcactatgaaaagtagactatgttttagcctttgaactataaaatctgcctttcagtaagcttagctccatattttgaggtctctagatccccccttagtatgcatcatgagacttgtattactcgccaagactctcatgactttcttcaagcattcagttttgtctaagaagccatcgtttgatccagaatggagtagacctaattatatctcctgtttttttggacttgaaatttacttcaagcctgatgataacctgttggtcagatgctctgccattaactaaatgacaccatcagcaaatatccagatagttgaggtcccagtgtcctgaatctgtggttttataatctatgtcagaagtctatcattttttttttcacctggctgtcatctggtatattctcaaaaggatatcacttttcttcttatccaggtacgtgccagtgtgcttcatctctcatgctcatggatctccatgcaaattgatctgcttttccaaaaactatttattaagcattattatgtgtctggtactatgtcaggtggtagagctacagtggtgagcaatggaaatctacgtgttttttgacatatgacactgcttttccacaatacctttcccaccttaaatcctatcccatgagcctgggtgatactcaggagattatttttatcatgtctctaaaaatctctgcttattttataactgatgatacatagacatctaaagagatgagggcctcacacagggattggccatgagagaagctttcagtgctgcgatctgaggccagtctgatctgacaccctcttaaaggctttcaagtataggccactgggttccacatcccatacctcttacctccattgtggctagtttctcatttgcggaggaggttagagatgttactctcttcccctccaccttcagtgtaaatttctcttaatcaggtcagctcacctccccaggcaagcaaacacatgtctctctgtcttcctgagctacccccgggaaagtctgcattattttagtaccatagacacagtctagaaatctgattcctatgggttgacaacatcctcatgacaaacccttcacctaccacatcatcttatttttataatcaccgaactttgttaggatgaagaactagagcactcaccaggcacccaactctgcgccaggctccatggtccccaaatgaagcttcctaggtctcttgtgtccaagccattcccctcacgtgaaacaacatgaataggtagagataagtggctttgtgacttggaacagacagtagcccaagaagaccacatgcctcccttctggccacgtgaactacatgaagcagtctcctttctgttcagccaagagtccgtgccatctcagtgcttgttttccttcctgtccctttatctggctctgtgcatgactgtttgagcagcctgtgtcttctccttccagccacacagagtactggtaacttctcacaggatattgcggtgtgcctccgtttacactgtctcttcttcctggatgctttcctctatcccctgcaatcacttcttacttacctgaaacttacttcttgtattactgcttaatgacagcttaacttccatgatacctccccacctccttctgctcaattctaggtttgagtatgtgccttcactaagtcctcccataatacctaagcaggtctctatcacagtccatacattgtttcctgtgtgtgtctgtttcttccattagactataatttccttgaggactgctcttgtgcctcactcatctttgtgagtacagtgccaagcatacagtagatgctatttaatgaaggtgggcatgtatgggtgaatattcccagtgtttcaggatgttttttctttctcctctggcttttctattctctgctcacctggaatgagagcggataaaataatacagacaggaaaccaggaagcagaagagaaccccagccacctacctacacttccccctcttagatgccctgcaacagagatctgtcctggggactccacctcatctttgccagcggtgtgcagctggcttcctaaaatccacccagagtaggggttagcttgtcagaaaaatacaaattggatgtcttctgcagggctttgcacagtcccctcagcacccacacttctgtgtcagggaggggatgcagggacacatctccttctaccctctgggagacttgtagtctacggctccaggagatgactccctggcctagaggactgtatccttaaaccactctctgctctgctggcttatgtcatcctcctgctcctttgggtagaagttctagagtcttatccacaaattgtcaccagttataggcttgagtaggcactaaatatgaaacatgaataatgacatgagccagcagagcagagagtggtttaagagtggtttaagggtcagagggaagggaaatgaaagccttggaggatttcagattcactcactcttctttaccttatagcctgtgctgcaaagtcagagtaaagaaacttctgttctgcctcattgcatccccaccacaacaggctgtaagcaggagctactccatgttttaatataaggaaactgaggccccaaaaattaaaaataactttatagtaccagctagccattggcaaaacacgattatacattcagatttgtccaattgtttccccatgtaaatgagaccacagattaaaattattattgtcaattaagaaaaaataaaagaaacccctgaaaagaggatctgatatgtgtctaactacctttaaatctccttgagataaattataaggtgttgtttctattgagccacccccatcaccagtttctcacaattcagtgctcagcaggcagtggctactcaagaattccagctggctgggcacggtggctcacgcctgtaatcccagcactttgggaggccgaggcgggtggatcacaaggtcaggagatcgagaccatcctggctaacacggtgaaaccccgtctctactaaaaaatacaaaaaaaaaaattagccaggcgaggtggcgggcgcctgtagtcccagctgctagggaggctgaggcaggagaatggcgtgaaccccgggaggcgttgcttgcagtgagccgagatcatgccactgcactccagcctgggcgacagagcgagactccgtctcaaaaaaacaaaaaacaaaaaaagaattccagctaagtggcagtgaactaatgagatttcatcacagagcatggtgaacgcttttctaaggtctaaatatgtgctctatagttgtcatggagggccaaagaaatgaagaaaataaagaacaatattagtcttaagaacttttttaaataacaaaaatgactgagttactaaggtcaggaactattctaatgcttttatactcatctcatctaattgctccaaaccccatatgaagtagacactactactactatcatgacccattttacaaatgaacaaactgagtcttgaagaagctaagtaacttgccaaagcacatcccagacttacaggcagtctggctcagagacctctgctcacagacactcctcttcctgggtctaattcaagaggggtgacgtgcgacttagagcagcctgtgggcttagtgattctgctgcttggtgcacagcaagacagaccataatcagcactagaataatagaatttttataagtgattaaagtaaaaccaggatttagagattgagagttgattgttaaaggataaatgatatttggaacatcttactggatttgattaaagtgaaattcaaaaaccatcacaaagagaatgattatttaccagtggtacttgaaggactttttttgtggcttaagtcattggcactccaatgcttaaaatctctgtgctcaaaaccagaatgtaattgatccttagaaaatcagaggttagcgccttctttggcaagctacttctgagctttgttacactgtaacataatcatcctttgaagactgagatctggttttccaggcttttttttttttcttcacatggtgcctggtatcttctcttgaacataatagatactttgagatgggtggacaaaccgaagtcattttatattgctttaggggctctgaatttaagaaagagttgatttctgaaagaaacataatagcaaagattacttaaacacaaaaatctcatttctgttcttaatcagctggacgtcaatacccaggttccagtccaagtgtcacactgtgcctctataagttaatcttttctggaagggaaaccaaatatgaaatagtatcaagaactgggacagtgttggaacaccctgcatgtcctctgttggccactacaaaaggttaaacaacaggagaggctggattagggtttgtgtttggaagtgcatttgaggcaagcttgacagttaagctcatggccagtactacatgccacagcaagaggacaataggagatttaaaagtgtgagcaggctgtggccaaatgctggaattcatgggctaagtagatgaagagtggatggagttaactagtaaacaagtttcatggtccttgaagagacctatttttttttatggtatgaatttaagatgtacaacataatgttttgatatacatacaattagtgaaatagcgataatttgatatttcatatatataccaaaatgattactctgggtgtattatttccttctcatgctgctaataaacaaatacctgagactgggtaatttataaagaaaaagaggtttaatggactcagttgcacatggctggggaggcctcacaatcatggcacaaggtgcgaaggaggtgcaaaagtacgtcttacatggtggcaggcaagggaccatgtgcagagtttataaaaccatcagctctcctgagacttattcactatcacgagagcagcacaggaaaaacccaccctcatgattcagttacctcccacctggtccctcccatgacacatgggagctacaattcaagatgagatttgggtggggacacagccaaaccatatcaacagggaagcaatttaacatatctgtcaccttccatatttaccctttttatgtggcaagaccacctaaaatttactctcctggcaaattttcagtctacaatattattaactagagtcctcctgccctacattagatctctagacttaactgcaagtttctgctctttgacctatatctgcccatttcctcctcctccctacccctggtaaccgccattgtgttttttgtttctatgtctttgactgttgttttttagatgccatatatgagtgagatcatgcagtactttttttttctgtgtctggcttatttcacttatcatcgtgttctccatgttgttgcaaatgacaggattttgtcttcttctttttttttttttttttagatggagtctcgctctgtcacccaggctggagtgcaatggcacaatctcggctcactgcaacctccgccttccaggctcaagcgattctccttcctcagcctcccgaatagctgggattacaggcgtgcgccaatacgcctggctaatttttgtattttttttagtagagatggggtttcaccatgtaggccaggctggtctcgaactcctgacctctggcgatccacccgcctcagcctcccaaagtgtctggattataggcgtgaggcaccgcgcccagccgatttccttcttttttaaggagatgtatatgtgtacacacacactacagcacattatcacattttctttatctattcatccattgatggacacttggttgatttcctatcttggttattgtgaatagtgctgcagtgaacatgggggtgcaggtatctcttcaagatgttaatttcattttctttggagggattgctgtgttgtatggtattctatttttaaattttggtggggtcttcatactggttttcacaatagctataccaacttacattcctcctaacagtatacaagtacctttttctccacaaccttaccacataagtgttgactttttctttttcttttttcttttttttcttttttgatacgaagtcttgctctgttgcccaggctggcgtgcagtggtgtgatctcggcttactgcaaactccgcctcccaggttcaggtgattcttgtgcctcagcctcccacgtagctgggattacaggtgcctgctagcacacccaactaatttttgtatttttagtagagacagtggtttcaccatgttagccaggctggtctcgaactcctgacctcaggtgatccacctgtttcggcctcccaaaatgctgggattacaggcatgagctaccaggcccagccttgaccattatttttaatagctaacaattattgagggcttaccatttctatgagtctaagcactttacaaatatttaatcttcataacaatctctgacatagatactactgttaatcccatcacacatactaaaaaactgaggcacaaggagtttaaggaactcgctcaaaatgtcacaattagtaagtcatgaagccagccagaacgcatgctcttaacccctgcactgttctgccaactctttggagtggtttgtttcagttgtcagtttttgtttgctgtctctgaaaatccttgctcttacagtgtcagccagagtcctgcattgatcacatggcctaacttgcctctctcagtacagtgactttttaatcttcggctgcaatcctttttttcctagactgtaaactccctgagggtagaaagtctgtctcattcatttgtgcccattttaatgaatgttgaaagggagcgtcaggaggggttatctagatgcctgtggatctagattattcatcatccactgggatctttattggtgttccttgtccccaaggagggagtcagcagcaacagaaggcagcagagatctcatcagtgttcatcaaacacatgttgagtgcctactacgaggtaaacagaacagacgttatcttctgtgccctctcagaacttaaggtacagcaaagaaacaaatgagataagcacaggtgtgataaatgcttgtttaaaaaacattttaaatgaaatgcttcgtttaaaaaaagcgaagaggctgaggtagagaataatggaggttgggtggggtaggacctactttaggtaggtaggcatgggaaattcctcatcgaagaagtgacattctaagcgaagatttaaccaacaagaatgacatagctaagaatgagaagactgctggggaagctccttgttggcaaagaaaacagcatctgcagaggctctgaggttggaaaggctttgtttcatctgtttaatagtggaattcagtgacactcattagttacctcttcacacattcccgccaaacacttgtccctgagtctgttctttttcattagtggttcctaatccagttttcaaaactgctcaatatttggagaggttttgaccagttgctctggaaacagaggcggttccaccatagccaacagagttcagaacataaattgtccatttatatccccatttgtatcttaagcttagcttgcataggactcagcaaagcaatatgtcaaattccttatatttgttatatctcttttttcactgactcaaagcatgaaaaatttgaaattaataaaacaattttttagatgatcagagattcttttttctaaaattttctaaatactatggttgtgtcccttaaccacaggcatggtggtttcactgcattttactcaagagaagattgcttacaaatatcacacaggagacctttctagtctcctgcaggagggtggctgacccagggaacctccaggcaagcaggacatatgccaagtatcctacatgtggacagtgtctaacttgatccgatctttctccttccccatgttttagttaagtcccctgaaagcccccattacccactgttcataaagggtctgtaaattatttaagagaaggaaacacagcctttatcccatcggatttttcctctcaatcacttgagtcttttctctgagcacacacacatggcccagactcactgtcaggggagatgtaatgccagcatctggtgttaatatctattgttgacattttgggaatgagaacatgagctgttagggaagatgtttgcttgtacctaattaatgtcccattgtatcctctcttgttgtcagctctgcctcaccatcctgccttggcattttcttttactggctaactttaaaagttaattatttctctgttgaatgttaaatgccaccggtttttaatgccgttccttggtgtgagttattagttatcaaaaatcaaaatgatctgtgcaattatcagctctttacctaaagccactgttcttgctaatcgcgtaaagtgtgatagcatttgctgatgtctggcaacatggatctttctagcagatttaagtttctcactcagtacattcctgtccctgtctggctttccttgtggagatcagatacaaagtcctggtacatcatctaatggaaacaattactgacagggccaagtcttcaaggcccattttgcttgaatctcaaatcactgttaaaattcatttggcaactccaataagtacagagagtaatgaggaacttcaaatagaatatttcctaatagctttcgtaaaacatgtcttggtaggagatcacaactctttctttacttgagattggtttataaaaataatagtacaagttccaactaacagctactaagtgcatactctgtgccaggctttgtcattagcttttcgcatggattatcttaatcctctcaacaatcctgtgaggtaaagtcttattattattcccaacttaaagatgagcaatttgaagactaaagacttgagtaattaatgcagcatcacatggctggtaagtcatgggccaggatccccagccagcagtcactgcagagctgcactgtcccaggcagtgactgtgactcacacgtggctactgagcacttgaaatggggtgagtccaaatgagatgggccataagtgtaaaacctacgccctgttcctaagctttagtcaataaaatagcgtaaaatgtctcgttaagaatgtgttcataccaattacatgttgaagtgataatattttggatgcattgagttacaggaaatatgttattaaaattaactttttgtttctttttcacttctttaatgtggctactagaaaattttaaatttcctgtactgcttgccttatatttctattagaaagggctgctgtgtgtgtgtgtgtgtgtatgtatgggtgtgtgtgtgtatgggtgtgtgtgtatgtatgtgtgtgtgtatgggtgtgtgtgtatgtatgtgtgtgtgtgtatgtatgggtgtgtgtgtatatatgtgtgcgtgtgtgtgtatgtatgggtgtgtgtgtgtgtgtgtgtatatatacggagagagatttctggagtttttcttgtcttaacgagtttccgatcctaaactattgaggaataggcacaaatttctgacccttcctcccctttctggttgtttcacttccagaaatccgacagaaagtacaaatttttacatctgagtctctaccaagagcccatctgttggctcttctcaagtatggaaagatgaaacactgacatgccaggcattaacgagatcaaaagcagggctaatgacagaaatgtggctgctgttaaagtgtctccagaggattatcggggaggactttttgttctccttacggcgaccccctcaaatgtcttccagagagtgcctctcagttccagttcctgaagtcctcctttgccttcctttccaatccttgtccaccactttcctggtccacctccctctctctcctggacgcccatctctggggtgtctgtgcagctgaggcggcccctctgttaagcacttctgacacgaggcaggtcttttttccctgccagtgagagcagagtgtataatggtgttgccctccaccggggatctttgagaagctttatggctctagcagacatgggggaaccaatcacaggcactgcagctgatatatgacactaatatagggttcacttttattctcaacctaaaaaaagatagattgttccaagtttagacaggctgtaaaatcatgtgcttctggaaccatgctgccttacccctgggaccactgtaattgctttacatctgtacaaaggttccttgtaatcgggctttctgccttcatttgtcttcttttcagcctcttagtaaagaccttaattggtcttagtggggcttttttcagttagtgcaactgtacctttagggctgaacaagtaccagacactacctgcggggagaagtgaggagatgggaaagacatcaatactcctttacctttaacagtttaattaatgtgctcagaacaaggagcagtttgaagaaattttggctcctctgggaccctgctacagatcagacataactagggttaggtggaattttctagatttctttcctgcttcagtctctgtgaacactcattagcctcataattgtctcacagtaaactgctgtatcaagtttcagtctgtctctttggaggatcaagttgctttatatcaatagactgaagtactaggggatgtgtgtgaagggaagtagcctctaatttcttctgtttcttagctactaattatttaataatacattttattgcctattaaaatgtggcataacttgcttgtcagcaaaactagatggaacctaatcatttgaggagaaggataattggcacttgtacagatggcttttattgccagttgggtttgttattgcagatagaattccttgccaggtttcttggttctgtttgtgggctggtcagtgttgtgagggggttacttactgtattacaacccaggcggttaaatgtggtattattgcaaatgcagtgtgtactcagttatagatcataaaggcttctgctgtgtaggtactttttttcttctcctccccccacctccccacccctggttttaaaggaccctagtgagttttgtaccacactgaaaattaccttatgtgctggaaaatgcatcagtggagactttgtttaaacaaagggcgtttttatgatggatagaagtggccaaaacttctggatttccatctagtaaaaatttgtgtaggaaaattggaccagtcccagttccttagtagaatttcacgaaggttttcctgttgcttcaaaatgaccccttgaggaatgttgtataaattccagaaaattgctcccaatgtttcctggagcacattaaaaaatgaaggagacacattgtgtgtgggatagtttggtaacagaattagttcactgggtagaacagaggggatcccaggtagttgggctctaagtgggaagcgttggccaacatttgtaactggaggcagatttggcaggcacttgggtaaggaacattttggtggtaatgaagtaggcaggaacaaaccgcgcaggggaagaatgcttcacactgccaggctttgtggcccagagcctagcattctcatccccaggtgcccagctcctctgccttcccaaggtgctcaagtttgctttctactcagatatggcccagtttcactggcaaccacctcccttatttgttgaaagtatggcttgtgttctgacccaagagagccatttaaaacctataatgatgtccatctttgtacgttttctgggtccc

SEQ ID NO: 239 - DNA, 3411 bp, Homo sapiens
atgattgccgtcatttaaagtgtttaaccccttgataccattctacagaagttactgaactaaaagcccagcacttgacccttgcaaaaattttgatgccttttccacttaatacactgaagttttggtttcaaagggtggtcttaagaatttcagctgatacagcttacatttacagcagtctttttaaaaggagcccaagaataacttaagcactttgtattgaaacataaataatgtgtaagattaagaacaataactatttgcttatttgttctgaaagaaagggtttattgcagagaattgactttcaggctggtctgtattccaggctatcttgtaaacagggtaagttttttttttacattaatttatttatctatttttgaaatttcagcttttattttagattcatggggtatgtgcaggtttgttacatgggaatactgtgtgatgctgaggtttggggtgcaattgatcccatcacttaggcagtgaccatagtactcaacaggtagtttttcaactcttcccctcaacaattagttccccatgtctattgttcccatctttatgtccaagtgcatccaatgtttagctcccacttataagtgaaaagtatgtggtatttagttctctgtttctgtattaattcacttaggataatggcctccaactacatccatgttactgcaaaggatatggttttgttcttgtacatggctgcatagtactccatggtgtatatgtaccacattttctttatgcagtccaccactgatgggcatctgggttgatttcacgtctttgctattgtgagtactgctgcaatgaacattcgagtgaacatatctttttggttggagaatttagtttcctttgggtgtatacccagtaatgggattactaggtcgaatgatagtcctacttttagttctttgagatatctccaaactgctctccactaatagtgatttaaaaaaaaaaaaaaaaaaaaccattgaattatctcacatttccgttgagattttttacctggtagaaagctgaatatggtggttggtgtttaatgggagattgtagtagatggaagtttattatgattcacggtagagtcacagagaagaagataaagttatgaaatgttgtgatttcatacattagactacttgaaattaagtgcctccatttcttccttcctcctttccttcttttctttccttttccccattctgcttattagtcataggataagactagtgtgactttttgagttagagcctctggtgctttttgtactttatcttcatcaaagctacaataaagtaaactccccacacacagacacttacagagtttcagatgacttcatttcaaaagggtctcctttctcagggctgtgctcttgtagtggtgtgtgtgcagtgcagaacagtcagcctccgtcagaacaatcaagcagcatagagtggtgtaagggaaggagtccatggcagctggctaaggtggcaggaagtatgagtgcatggggcatgtggctcaccatacaagttgcttggactgctgatacaatgggattgcaataaatctggggatctttgtttagtggaccacagtttgaacccatggacttgtcagcaaatttttggaatgtgtcattgctttggaggccagggcctttgctcagattctttaagatgtctatggcacccccaaaataccccacatatatttttgtcattatgatgtcacttcttaaaaagtatgtaggagaaggatctcatgacattgttatatcatgttattgtctcatgatactgtcatatagtctgatgcaaagttgtgcagtgaatgcttctctcaacagctttctttataatgggatttgaggctaggaacctcagtccctgtccttgagaagcatgactcctgacccactgtcatttctcctgaaagaacatcaggaaaaccagcctgaaagcatgccccacgtatgaggagcatcacagcaagtgaaagtagctgcattttgttgatggaagggtgcagacacagcatggggaagcaaacaaaagtggaattcttgccacatttgctttgctattggtgttctcccttaacatgcatattatggaataatttttatatttttaaattttcttttatgtggagaccaacagtttaaaagatggaaaatagattttagcaatcatcagaaagacagagaaatttatattcagattagtgaacactgaatctcatctatgtggtctcgggactgtggcacaataaaattcaagttggcatgtgagcttaagcaagtcatttaatctctctacaccctggctgcctcctgtgcaaaacagaaattggacaattgggcttaaaattacttcatcactaaggtattataattttacagtttctaaaattactagttcattataaataatctgctaacttgtattttaaaaattctactgaatcaggcataactattttatagagctctaattttatttaaaaagtgttgaaataactcagctctatagagtacaagcataaaagcagtgtgagaattttgtgatctagtttaataaaaatgaatgagtaacttgcatttcttcttgaaaaaaaaaaaaaacttcggtgcttttgtgacaatactgttttccatatcacagaataatatctggaggggacccaaggattatgatagtccaatttcctatcttagagatagaaagtctgagagagaaagagatcaagtaagtaaattactgtgagaaagaaaaatttagtcttcaggaaatcctggctaatctcactcctgatcctatgacctcaaataacttctgttcaattttgttttgttttattttgagagagtctctgtctgtcacccaagttggagtgcaatgatgtgatctttgctcactgcagcctccgcttcctgggctcaagtgattctcctgcctcagcctcccaagcactttttctacaggtgcgcaccaccacgcctggctaattttttgtatttttagtagagatgaggtttcaccaagttggccaggctggtctggaactcctggcctcatgtgatctgcctgtctcgtctgttcaatatgttttaaaagactaagataaatcatgaaagcactgctaaaagaaattcttacattacattttagtaaacacagctaagggttaaaacaatgtatttttaaggtagctactgaagaaataaatctactttatatcatctcttgtcagttcaatcttatcacttctctcctacatttctgtgatatgctccaacaaaacctggctactctcagttctctaagtaagccatgcccttttctgcttctgcactttgctttactcttagcctaaaaattagctcacccc

SEQ ID NO: 240 - DNA, 16192 bp, Homo sapiens
acaacccattagcctagaatttcatctcttcatctatcatttcaattatcccctgatttctctggggcatttgataaatgggagaccatttacatttggtgcattaatgaccttggtacattttgaaaatgtgtcccctgcccccattatatatgtatgttttttaaagctacctactaggtcttcaagcatgctaagggacagaatgacatccatgtaactccattacttggacatcattaaaaaataaaattctgaaaatgtggtgtttccatgatgatatgatgttattacatctataaaaataagtaactatttaagggttaaaagatacctatagaaaaagaagcagaaggatattgttccaaataaatgtggacattttggttttcttccacttttgagtctactgcccaaagcattttatattagagttcgttacaaaacaaggtgtttttgttttagtggtgatttttttaatctatttttttttaccatggtgagaaatttgtttttctaaaatcctttgttggcttgcccccaaatgtacaacaaccaaaagccacattatatataagatatatagtaaatatattgtttatataaaatataaagtatatataaactatatatttatatataatatattaaatattttatattatataatacttaatgttaaatgtttacatatgttatatattgtgtgtatgtttctttcagggaggggagggtggtgtggtagaggggcacaccagtaggctgtgctctaccattactctagcagcctcagatgaagcagagatgctccaaatgaagctgtcacccggttttcttgaatataatttggtcatcaagatatttgaattggaaacactctggaagaaataagtgtctactatgaaggagctattgggcatttctactgcctttgagctcccaaagtttaaattttgtgagcaatagttaacagtctagttctttaagaatactatctctctacagaatactatctaactagtgtgagaccctggctttcaattttttttatattatttgaaacacaccaattatcttcattgaaaagaaatttatatttcttcaatgaacttatatcaaatatgaagaatcatttatgcttttgtctcttttcctggttttttgtctttgatttcctggttaattttgtgatgttgcttgccacatctttgataaaataaaattctgtaaaataagaataaacatatttttgttaaaggtgctttgaaattattaaataagagatttgagttgaacactttagagaattggtaaatcaacaacatttctgagaaacaaaagctattgatatttttctttgaatgtaatatttaagttcgtatctcaatgcaagcgaataattttagggctaaaatagtagcttacaggtcagttaattcaccatcttcactcccttgtagaaactgagatatttgaggtaagactgtgggataatatttattactagacaaaagtttctttataactttgtcaaaatccagaaggtaatggttggatttgacttgaggagaactcctgagtttcagctctgtttcccagctcttcaaggttacagtctagtctgttttgacagatggctcctttatgtccagggcctctgagcggacatgtgcaaacctggaatgcactagaaaaggtcaagtgttcattgcgatatagccctcaattgttatcttttcggatgacaaggatatattctatttatctatatatcttctggcacctaacacaatgtttagcacatacaaggcacttcataatttttgatgagtgaataaatgagtgaaagaatggctgaatgaatgaacactttgtttacttagaggttactagagccatttacaaatcatatgggaaatactcaggatgcagatagtaaagaaaaaaaaaaagactcaatgccagtgagccacagaaattaaagtcaagagagaaaattggaaatcatgagatttatttatgtgggaaattttaatttctgttcaggtaactcagatttacttctttggcttttctcttttgggacaggcgtcaccggagcaccagccaaatgtcgaagttgggaactgggttctttattgttaggcgtagactggtacaagcattttctgccagaagtatcagttgaaatctgggcccaaggggccagcctaggaaaagagaaaaggtgaggttcagctaccagaaaggagctgaacaaggagccaaaagagagaatccaggtcaagaacacaaaactaagattttaagttctgttagacacagggatcacagtaaagcagactgttaacaagcaaggaggaggaaaaggtaaagagtcctgaacagttgcctcaaatttcaacctattattttgtctcaattttctgaactcaccgatgaggtatgtggaaagatcaagcagagttgacaaatgttttcagacttgctactccactgatgagcagccttgaatttccaattgcatgctggactttctcccgagtgtttctttggcactgcatatttaacatatctaaaatgaaaaataacttcccttgtattttattgtcagaaaaaatagtccaagattggaaatgggtgaaaaagattatagggtgtctatcctttcagtggagcgctaagcatttctgaaagcttagaagttaagttgttagaaaactgatagccatgcaaatgattcctcttttgtcccattgagacagaattgatttctcctctatggaaaagatgatccaaatcactgtattgccttttacatgatatgaatcagcttggcatatattaggaaattatttcaggattcctgattatctatgtgtgtgtgtgtgtgtgtgtgtgtgtgtgtgtgtgtgtgtgtgtgtgttttactggtttgttaataagttgaataaaatctttaacatattcaatttgcaggagagtcatgtttttaactttttgaaaattatattaacatccttattaactattaatgtttccaccatcctaaacgcttggtaccattgaactttctacttctctggatctccattatataatcagtttccaagttaaatgctcttcacttcaatccctttttcactgttaatgagtcagtttgagtccctgctattttgcactaaggctgatccaatgatccaatactctccaaagtgatcttccaaatctgtctcccacaccattacactccaaactgaaaagccaaatctttccatttaaacctaggtcattgggacttttttggctcaaaaatctcatttgacttcctattaactaacaaatccagtccccaaatgccagcttcttaatagagatcccagttaccttcctaggcctatattcacttggattagtgagctagaggtgccgtaacaaactaacacagatggagtgtcttaaacaacagaaatttatttccttatgatctggaggctagaagtccaagatcaaactgctgggaggattgatttcttccaagggcctctctccttggcccatagatggtcatctctgtcagtgtcttcataggttcctccctctctgtctgtctgtctgtgtcatattctccctttctcataaggataccagtgaaattgggttaggacccacccatatcatctaattttgttttaattatctctttaaaggccgtatttctaaatacagtcatgttctaaaatactggggttaggacttcaaaatgtgaattttggaggaaaaaatttagcccataaaactcctaaagaaagaaaataaaaatacatgtttgttgaatgcataccatgagtcaagcactgcattttatactttcacataagttaaaaaatgattgattcatttttcctgaattatcccaatccagattttacttgtaatatatcacctcagctaagattccttccttgttaagaatcctggtgtcctcctctgagaggacacatttttcccttttacactactttcacattcttcctggtttgatgattattttgtactttattttttccaacaatgcattattaattccttgaagtcaaggccattaatgactcttagaatgcctgtgaagtatatgacctgttgttcagaatataaatatttgttaaataaagaactcaaaggaagaagggaaaagtttataaaagaaagaagggagtatgaccaaggttttttggcaaggggtggatgaggcaagggaaagaatcatgaaagatgttcgagaagaaccaaaattataaggctattaagtcagaggttagtaatatatcacatttggaacctagaggttctaagactctagactttttatcttttaattgatggtgttcttagtaaattatattccatttaaatagcttcacaccataaagataaatgttttaattctgacatcaaattattttagtattggtcctcatttccattctatcaccttgttttgaagatctgctttcagttagatcctttgtctttcacaatcagctggggtgtggcttaggaggacaacttaaatgtgttctgcaatttgccgatttggtctggtttttgaagcatgaaaagatttgaaggccccagctaatgtgtattacacatgccacaccccctcaactatgtctcagatttgtgagggtgtgatctataactccatctactgttggagtgctgggaagggaagagcatggtccctttaaataatatggaaggctggaagggaagtgctggggagaggaggacgtggtccctggttagggctccaaccccatgggcctaggtgaagacaggcacttctgccttccaacccaaatgttgcattttcccagagcaccctgacccgccaagcccccctcctgtgcctataaaaacctgagaccctagcaaggcagacagaagctgctggactgtgagagggacacattggcggaagaagacaagcggctggacattgagaggatgttgaggggagcacatagacagaagagcacactgaccaaccaacacaggcactctgccaggccatcaaggtgctggaagaggcagagtttggccaggagagctggggctgccgagtggcccaactccaggtgaagatcccctcccttctggctccccatcaggctgagagctacttccactcaataaaactttgcactcattctccaagcctatgtgtgatccaattcttctggtaaaccaaggcaagaaactccgggatacagaatccctctgtccttgtgataaggaaggggttctaattgagctggttaacacaagctgcctatagatggccaactaaaagagcaccctgtaacacacgcccactggggcttcagctgcaaacattcactcctagacactgctgtggggtggaagccccatgacctgcccgtatgtatgcttccctagaggtttgagcagcctggcactgaagaagcaagccactcccccatcgcacgccctgccagggggacaagggaacctttcccatttcactgtcaccagactgtgatattttttgctgtgaaaattcccaagacaaatttgtttctgtggcacatttaccattgtaacatggagctatagatatgatggcttcagacatatcagccttagcactttattatttttttcaagtcttaggctgctgtgaaatttttagaagtttctgtttccctggattatttttaaaaacatcaaatcattcctttaatagagtatattattattcagatcttttctgaaggaaagtttcatctgatttctaaatttaacggtatgcccttatctcaaaatttcagtcaccatccacttaccatgtacttttttcgttattgaagcattccagatgcttcctttttgaaaaagaaaaaaggactaaatttaacggtatgtacagagactattgtgtgtgtgtcttgggaggagtataaatatgagctcccattaaagtaagatcttctaaattgagaattgtaagttgtttttatgcttccgttcgtgtggctctgtgctgtgtctgaggaacataggaatgaagaagacattgtgttggctcacaggacgtctatagtcacctgaggaaagatacaaataaccaagtatgagttaactagtggtttccaacaaggaacgactgtacccccaggagacatttgccagtcgagatggggatttacagcaggaagttagatatataaatataaagattagcagagcactgggctaaagatatatatatatatggtagtaataacacaatagttcttgaaatcaaaagactgataaaattatccagcaagagtgtgtgggtgatgaggacactagatgagggacacctgcaatcaaaaggatggacacaaaggaataccaaagataactgaataaaataataataatattgaacattttgtagaacccatactatttttaaaaagttctcctaagcacttatatgaatgctcataattagcctgttattgtcagcgtttttgtataatgattgaagcaggaatcaacagtatcaaatgcaacagagacatcattacaatgagtactaaaagtgtccatagatctggcaattaggaggtcattggaagccagagcccagtgggtagaaaagtaaaatgttgatgggcaagtagagaagtttaagccaaaaaagtttggattaaaaggaaaggaaaagaaaataaatgaccatgttataatgggaacaaactaaaaagaggtcatgtttttcatggtggaagacatggaagaatgtaagaggagcagccatcgtttatacacctcgaggaaaccgaagaagatgccttatcaactctgagaggactgggaagtttgacaaaccaggacaggcaaagagacataagaggtcatgcttgggcctcaactgaaattggacactacttgctctgtccgtcagtccaacaactcctttttgaaatctctctcctgataagttggacttatctgaactatgctttcaggaggacttttgcctgtctcatcttcctcacttatcaggacaacattctacaaaaccaaatcacagaaacagtaatactattatctgcctcctttactcctaaaacccagggaattcaatgaccagtgaaaaactgcacactgtgggacacacacaggctatcctgagacatgagggttccccaaatgagtgttacagaatttgctaattctttgtggttgttttagcagagcatgtaaatgcatattgaacacttttttccattaatgcaatgcttatatggaagaatatttttccttcgctgaacattttcctacttctgtatcttagtctgataaaaatatgttttccatattatttctagtctctatcatttattcaactacaaatactgaatatctactatatactaggtgctggtttgtcagatgcacacacgctgtgacactagaagagctcacagtctataggtaaaacagatagattaatagctatttaaaatggaaaagtataagtgatttaatagatatagtaaatgattgtgtaagctaatgcagtaagtaactataccctccctcccccataaaataagttttcttctcaaatactgactcactttcattttttcaaatggattgtcaagaatagaaacaccccattctctttgcttgatgaattttttttcctgtttctttctctcttttctctttggttctcaccctgccaattctctgcaggtgctccttttatattctgaaatcccagttaagggactttctcactgattataatgacataggtctgttttcacagctgtaattttaaagtttcttaataatgcaatgttttaaacattattctgaaatgctagaaggtttcagggtgctcaaaaagtaaacaggctcgtataaaaagaagggaacagttataataaaaaattcaacaatttgtatcagatcattggcacttcattgaaaatctcaagctcttgagacaacaaaattttcccccaaggggaactaattcactagacatgtgtatacattagaaccagatgaaggtgatgcagtgaaattggaaagacaattcctgggcttattagaagctggagaccaagtatttgtatgtctactgacttctttggccttggcaagaatcgttttcccaggagagcagatttggggaatttgcatttatgttcatgatcacctttgacatctgaaactctgaggacttgacaccgagtattactattattataaacagagctcccaagctgttaagctcaaactgctactttggtgttaacaagaatgggtgccacatggtgtgcatatgctgtttgtgaaagtaaatgatgctttaagagtgttttactctcaaaaggaagtctactaggcagatagcttgtattgaaactctgtatatgttctcatttgaccatcataaacaatgtttaaagagccaaggttgttacttgagaataaatcagggagctctggaacatttgggtggatatattcactacaaagcattagagacatttccccctatgtttatccttttaaaaatgtatgtatttcacttcaggtctcgatagatctttcagattgtatcttaatagagcttcctcagcacagaagtgatttatttctttcaatggaggatttacttgaatctactatttaggaatttagcataactgggtatagaattcctttaccttggatagactaaaaaactcccaagactgatttaaaacaatttaaatgttgaataatgctatttccctatgcgtttgctttgtgagttaaactgatgaagatttaatcttctttttcacagtttcttttgtctataaaactaaagatccatttttataaaagatttttctttactttgttttagaaagagatttgatatctgaatggtagtggtaatgaaattctctgtgggttaggctttgaggaagaaatactaacgtgaaattaatgaaatattaacaaataaattgagttcataatggtaaccatttccctatgttatatgtgataacatataacttatgtatacgtagttttgagctttgcatctgatcactcttagccaacaaatcttttctaaaaataaggcaactggggaaacctataataaataacttagcaaaatgaggcgatgaacttttcagctaccataagccttttctccccctttaagtaatgtattttatcaggactgaaattctaatgtatgataacctgaaatttgagtttaaaaatgaacacaactgaaatataataaggcatttttcatctcttttaatattttatatattctcattcttcatgagaaatggctgcagcacgcaagctgccaggttaatcttgcttaaatttggcaatcaacaagtaactttgtgcacaaactgttggagtaccatgcaaggcaagcaaaggagtttagatttgatgcaataatagagggagagctatcgacagagcaagagaataataagatgcaaatgccttttaaggacaattagtctggaaaccaagaaaaaaatgggcttggcggaatgaaaacatacagacaaagagacagcatttgtatcatgtgaagaatctggcatcaactcagaagccttctttttcacctggcgtgattcaaagtaaattacagtgaagaaaaggccattaggctcacaataaggagacttggtaacttgaagaatgtatttttaaaagtatggaaatagctgtcaacatgaggggactttgaaaaggaagttactggggatataaatagatgtaatgggtataaggaatgaagcctgaggcaggaaacagaaaaataatttttaaaaagttgccagaggaagaagcaacattatttccagtttttagaaaagacatgagcaattcactacaagagttatacacaatgaagatgagtatgtttcaataattaaattagtgactttggggaaaaattcaaattgctgagtagagatcctaaaaagtccattccctaaccagttaacttctaagcctagataattcactattaaatatttaggcatatcttatattttgggattcagcaaatggttcgatttcctatgataaattttgtaaatgtgtttactttcccaagtgacagatatttcacaagggccataagagaggtaaatggggagattctttggtttccctttttaaaggcaggaagcagccagttcttggtttgcataaagaaactggaagaaaagcacagagataaaatagaaatgttcactaatattttcatgagtcaagttttatagccacagctgtctccagcaggaatggaatttacagtgtcaatgggtattagaaagagatgggctggaggaagaagattggaaggatgggcacttagcatgtatgcagaagtgaactaatctgcctacatagcaggagctgaattttataccaaaactttctctgcaattataaaaggctttagatgtttagtttcaaagacatgcaggttgaccagcagtttaaagagttgtgagctactggataatgatctcaatccaactactttcctttgcccaaatagaattcttcaaccatcagcagtaattagttggcttttagcttttgggcaccagacaatggatcgtgatccatagtggctatcatgtgggagatgaggctgcaggtgaaaggtgaaaggaacttttcacttcccaagcttccaaaaagcaagtgtcttctcctatttttagcctgctatattaatactatatgtgtgtgtttatatgtgtaggtgtatgttctaagtcacatttctcttggttacttgctcctttttactgaagatcatttacatttggatctatcatatgccaattctagttaattatgtttatgaaagatcctggtcttagttaatgaaagattaagaacagtgtctattttttccttttattatggatctttactcttactgaaattttctgttttaaaagtcaaaataaaatttagcttataaacagtttagaaagtttatttttctagtcttttctagttatggaaaatgtaatatttgaaagacaagtatctataacaaatcaaattgatgtttaaacacaaaagatacatttgccaaattgcttctcctccctgatgctactttagggacatataaaacaagaaatggaaattaatttttatcatgtgcatgtcggtttccctttctctgaaattcactgatttctttcaaatttgaacactccagcttttatctcttctggtcttcagtgctagactcccccagcttttctccagttctattgttgtgacagtatcacaatttactttcttcattttgaggatttgtttgtgttgttattcctattttttgtgaaaggaaaataaatcttggggccccaaaatcactaagctaaagggaaagtcaagctgggaactgcttagggtaaacctgcctcctgatctattcagagtcacacctctgctaactgagataaatgcatagctaattgcctctttggagaggctaatcagaaactcaaaagaatgcaactatttgtctcttacctatgtatgacctggaagccccctccccacttttagttgttccaccttggcttggagttgtcctgcctttctggactgaactaatgttcatcttacatatgatgattaatgtctcatgtctccctaaaatgtataaaaccaaactgtgctctgaccaccgtgggcatatgtcagtcatcaggatctcctgatgctgagtcacgggcacacatcctcaaccttggcaaaataaagtttctaaattaactgagacctgtctcagatcctcagggttcacactgccctgtactttatgggaagcaagccagcaagtccccttagtagttgatcgtaaccttggcctgcaatatcatgatcagcaaatgatgcatcattaggtgtcttcgactgagagaggagcaattaccccatgacagcaggatcagagaaatcagactgatcaggataaagaacataacaaacagttgggagaacatgaaagaatatatacatacacagcataaaaaatgtaagtgcagttaaaatatcattacactaagaatctaaagaattactgggtttcagctctgccatttctgcttaccaattcagtgaccatgagcaaatgacaacttcactgagctacattttccattttgaaacatgtagaccctaaagtctgccaggattatggtaaagaaagcatgagtccttatgcaaagcatgtgttgaatactattcactcttaaaaccatattatgctggaactgtgaaagagaactaaagctggctgaaggagggccatagggaatctgattttgtttccttcctccctgtatagttcaggctttgcaaagtagtttggtttaaaatctaggtgctattttctagacagagtaacaatttctgtttactgcttttattggccaggccttgcctcccaatccagacacccagttctcattcgctctttaaataacagattatttcaggaaacaaagttatttttctctaccttggaggtggtcatggtggtgttcttgcccttgctcatcttctaagttaaatacagttacccagcccaacacatcctcctgatgacctcatgctgaacctacttttgagcattgttctctgggctagcaatcatctccagccttctcaaagtgtcaaggcagcgaaacttggggttcaagaaggttctcaagttattgaaagaatgttcttcacatgtaatgggttggttctgaaggtggcatagtaggttttgccccatttttctttcatgtatgccatatttctgcagctaaaggtgagagtattgaaaaacattaacataaaactgagagctttgatttttatcttcatgtttaaacatctaagggataacagtaaagtaagtatggattactatagaagactcttgtacatttcagttgccatttctgcacaataatttataccaactcttaaactacaaaacttgtttgttcctttattaatttatcagctagcaaaatatgtacttgctgtgacactagttaaattattcacagaggcacatgttctattaggccctttttttctggggcccattctggtgattttaagaagccaagataggtggcttgaagattttgacttttgcataaacattgtaagagctcattcattctcagtgctgttcctgaaacttcatcatttctccctttgtgaatattatttgatatctgatcgtctttgaaaaaacagttttctttgggccccttagctcaccagtgtcctctgaaacaacctggtttccttggcatctccccctcaccctaatttctctctacttgttgcctcgtatccagcaacctccaacttattgatttggcttgatttaattgggagcgccccatacccaggacaggttttcccagtggcagctgggagtatgaatctaataggcctggtttggttctgtgaccctctgtcgcccctttctggccatagcctgtcactgaagtttaccctctggacttgataatacagacagcagccgtagtacagaacagtttgcaaactatcagcctgtgtgccaaatcagcccaaagaatgctttgtttggttcgtataaattatgccaacatttaaaaattagcagacatattagtccattttatgttgctgtaaaggaatacctgaggctgggtaatttataaagaagaggtttattttggctcacagctctgcaggcgatacaagaagcgtggtgccagcgtgtgtttctggtgaaagcctcaggaagcttacaatcactgcagaaggccaaagggagcaagcatatcacatggtgagagaaggagcaagagagagaagggagggatcccagattcttttaaacaaccagctctcacatgaactgccagagcaagaactcactcattaccaacgagatgccaccaagccattcataatggatctaccctcatgacccagacaccacccactaggcccatatccaacattggaggtcacattgcaacatgagaattggagggtatacacatccaaattatatctagagatttcagggccaggtgtggtggctcacgcctgtaatcctagccctttgagaggctgagacaggaggattacttgaggccaggagttcaagtccagcctgggcaacatagcaagaacttatcttcacttaaaaaaaaagtcagatgtggtggtgcttctgtagtcccacctattcaggaggctgaggtgggggaactgcttgagctctggagatgaggctgcagtgagccatgattgtgccactgcactccaggctgggcaacagagcaaggtcctgtttttttaaaaaaaagagattttatataaaatttacagcttctcttaacatagcagaagatctgacaatcttaggccagctttcttcttgtggacaatcttactcttgcccaccactcatggtgtagactggtcatttgcatctagtgcctgcttcactcatttctgttgactgccttgtcccaacaggcatttggactcccaggtcaagtacaaaagtttattcaaatagatgtggtttatttgtgtgtcttggggaggaagaatgatatctaatttcttttatgaatatgctcacaaaaaggaattagaaatcagattgagattctttagtacatgaaggtgaaaattgggtatgttttcttcccatttacaatatatttgtaccaagattcactttttatcaaagagaaacttttctgcagtttaaattgtaggatgatggagttctgaatatcttaggtaacattattatatggatgaatatatttgcattctatcaggttgaatatagaaaaatcattatatacagatgttaaagaaactatacaaagtactaatgtataaggagtgtgtgtgtgtgtaaccgtctaatgattcatgttttttctcttttttattatacttaagtggagtttccagggcaaacacaggtatacagtcataatgataaattatgtagtttaattcagcttcaccaatgataactcagatgccattttcaaatgcattgtgagaacggttttttcacgtttgcttctaattccagcaaaaacacctaattatagaacaacagtagcaaaaaataaattttgctcagggaaaaaggttttatgagtaatcagtgcaaagcagaaatctcttgctgcgaataatgtgggccagctaaggtttctgtgaggttttttgctttggcgtggtttggctttgtactgcctgggtgacctcttcttctcatccatcacttcatcagaaaatcaaaagacagcaagctcctagccagactcttgttcaagataaactctatgacctcctaacaggttactagatcttttatgggagttcagctgaccacatgacttcttatatttgagaacttattcatgagccagcaaagctctggctaatgtcacagaacttgacagcactagtgctgttcatggcttcatctttagacatagctattctatcctgttccctttcagaaactcaaatgaagggccgcgtcttataatcaaacatttcagataaaacagcttatttttccctgagagcatatgtgtcttctattaatcctaatcaactagggacagactgaaaagaacactctaataaggtaatagtactgagtattttgctgtgacatcccacaaaaatgagttttctgtgggatttggggaggaggtaaaaaaatgaccaagaaaaaaaagaccttcaagaattaaatggcttagagataaagcatataaaataggaatgcttttattgcttttgtattttctgaggacaattctgccagtgaatccacaaaattgtataaatacaaatatatcacatttgcctgctgtgattaaatttctctgattacacaactatacttgatacacgggaccaatgcatcattttttttttccttttgtaatcattgttatatccacgcttataatcaacattcatcacagctaattagagtttctttgtctgttgtttctga

SEQ ID NO: 241 - DNA, 62528 bp, Homo sapiens
gaagacttcgttaaacatagacacctcaactttattagtagaatcactggctttagagcatctttgaagatcaaaaagtgagaatctagagaggtgaaatcaagagactctgaccagtgacacaccttctcagatgctctggggcttatggaggtatgcatggaagttaccagcatatgttttaaagaaagtgatttgaataaagcattacatgagtgtgttgggaggtagtcatgctgaggtcagaattagccagattctttccatgtcatctgcaatcctttcatctaacttccaaaagagtggttgctggaaaacctaaagaaatgtttaattttaatttttttaatttttttttatttagagacaaggtctctcactgtcccccagcctggagtgcagggggcaatcatcactcactgcagcctggccctcctaggctcaaacaatcctcctacctcagcctcgagtagctggactacaagtgcatgccaccatgcccagctagttttttaaaaactttgtaaaaatggggtctcactatattgcccaagctggtctcacactactggcctcaactgcttctcctgccttggcctcccaaactgctggaattacaggcatgagacactgtgcccagcgctaaggaaaaatgtaatatggcatcttttaggaaaaaagtattctggacttaagcttgaaatttgtgctgctgattttaataaaataacatttagctgcctccagtgtaaacctttcacagattctaaaagaggtgttttttgtgttttttttcttgcaatttcagaaatgtaaattggctattatagtttacaaggtaggtacatgttttgttatataaataactcagaaatatctctctggctcttcatacaatacaatctttgcaaagtagaaatatatcatgaagactaagtgaaataaatataatcatagccaagttttgattttttaaaaaaagaatattcaatgtttttattagactcaaaggtctttacaccccctccaggccccaggctttattaaggtataattgataaattaaaattgtgtatttttacagtgtacaatgtggttttgatacatgtatattttgtggaattattaaatcaagctaattaacataactatcacctcaaatatttatctttttttgtgatgagaacatttatgatctattcacttagcaatttttaaaatttacaatatattattattgactgtagtcaacataactctccagaaattatttatcctttctaacagaaatattgtatcttcaaccaacatctcatttctcccttacctcccttcccaggccctggaaaccaccattctgctctctgcttatacaaattcaaattttttaattccacatataagtaagataatacagtatttctgaacctgacgttcacttagtataatgtcccccaagttcatccgtgttgctgctcatgacgggattttcttcttttaaaagactgaatagtattctgttgtgggtgtcttttttctttattcatttctttatgcattcatctgtcaatgggcacttacattgaacatgggagtacagtaatctcttcaacatactgatttaattgtccttgaatatataccctgaagtgtgaataatggatcataaataaattccttttttaaaaataaatcactcagtttcaggtactctgttataagcaaggaaaatgaactaagacagatattaaccttttatcataagtataatttgcaaatattttctctcattccataagttgtcttttcgttctgttcattggtgttttttttgttttgttttgttttgttgttgttgttgttgttgtgttgttgtttctgtgcaggaggtttttagtttgactcagtcctgtttgtgtatttttgcttttttggccggtgcttttgaggacgtattcaaaaaataattgttcagaccaatgtcaagaagcttttcctctatgtttatttgaatagttttacagttcaggtcgtatacttaaacctttaattcattctggtttgattttgtatatggggtaagataagggttcaatttcattcgtacacatgtggatagttattgaagatactgtctattctctattaggtgttcttgacatttttgtcaaggatcaattaaccataaatttgtggattagtttattggttttctttctgtcccattggtctatttgtgtattttatgccagtaccatgttgttttgattagtgtagatttgtagtatttttgaaatcaattagtgtgatatatccagctttattccttttgatcaaaattgctttggctattgaaggtcttctgtggttctctatgaatcttaggatttctttctatgtccatggtatgtatacatttacctatgtaacgaacctgcacttcctacacatgtgtccttgagcttaaaataaaagttggaaataaaaaaattaaaaatgtgggaaatattttaaaatgcaatgagaattttgataggaaccacattgaatctgtagatttctttgggtagtaggggcatttcagtagtattaattcttttaatccatgaacaccggatatctttctatttgtttgtgttgtcttcagtttctttcatcaatgttctatagttttcagtggacagacctttcacctccttggttacatttcttgccaagtatttcatttttattgatgctattatatgtggaattgctagattgatttattttttgaataatttgctgttggagtataaaaatgcaactgatgttttgtgctgattttgcatcctgcaattttatttaatttgttttttagttctagcagtttctggtagagtctgcaggatttcctatatataagaacttgtcatctgcaaatagagacaattttatttcttcctttatattttggatatcttttctttctttctttttttttttttttttgcctaatttatctgtctaggaattccagcactatattgaatagatgtggtgaaagtgaacatctttatcatgtttttgatcttagaggaaaagcctttagcttttcattggttagtttgatgttagctgtgggctggttgtatatagcctgtacttagtcaagatacatttcttctacacataatttgttggaagttttttcatgaaaggatattgaattttttcagatgtttttacttcatccaatgaggtgaccatatgggttttatccttcactgtgttaatgtggtatatctcatttgttaatttgtatatattaaacaattattgcattccaaggataaatcctacttgaccatggtgtatgatcctttttttttttttttttttttgctattcctatttttttttattatactttaagttctagggtacatgtgcacaacatgcaggtttgttacatatgtatacatgttccatgttggtgtgctgcacccattaactggtcatttacattaggtatatctcctaatggtatccctccccatccccccaccccccaatgggctccagtgtgtgatgtttcccttcctgtgtccatgtgttctcattgttcaattcccacctatgagtgagaatatgctgtgtttggctttttgtccttgcgatactttgctgagagttatggtttccagcttcatccatgtccctacaaaggacacgaactcatccttttttacggctgcatagtattccgtggtgtgtatgtgccacattttcttaatctagtctatcattgatggacatttgggttggttccaagtctttgctattgtgaatagtgccacaataaacatacgtgtgcatgtgtctttatagcagctatgatttataatcctgtgggtatatacctagtaatggaatggctaggtcaaatggtacttccagttctagatccttgaggaatggccacactgtttccacaatggttgaactagtttacagtcccaccaacagtgtaaaagtgttcctatttctccacatcttctccagcacctcttgtttcctgattttttaatgatcaccattctaactggtgtgagatggtatctcattgtggttttgatttgcgtttctctgatggccagtgatgatgagcattttttcatgtgtcttttggctgcataaatgtcttcttttgagaagtgtctgttacgaaatgaaggcggaaataaagatgttctttgaaaccaatgagaacaaagacacaacatactagaatctctgggacacatttaaagcggtgtatagagggaaatttatagcactaaatgcccacaagagaaagcaggacagatctaaaattgacaccctaacatcacaattaaaagaactagagaaggaagagcaaacacattcaaaagctagcagaacgcaagaaataactaagatcagagcagaactgacggagatagagacacaaaaaacccttcaaaaaatcagtgaatcaaggagctggttttttgaaaagatcaacaaaattgatagactgctagcaagactaataaaaagaaaaagagagaagaatcaaatagatgcaataaaaaatgataaaggggatatcacaaccgatcccacagaaatacaaactaccatcagagaatagtataaacacctctacacaaataaactagaaaatctagaagaaacggataaattcctcgacacataacaccctcccaagactaaaccaggaagaagttgaatccctgaatagaccaataacaagatctgaaactgaggcaataattaatatcctaccaaccaacaaaagtccaggaccagatggtttcacagccaaattctcccagaggtacaaggaggaactggtaccattccttctgaaactattacaatcaatagaaaaagagggaatcctccttaactcattttatgaggccagcttcatcctgataccaaagcctggcacagacacaacaaaaaaagagaattttagaccaatatgcctgatgaacatcgatgcaaaaatcctcaataaaatactggcaaaccaaatccagcagcacatcaaaaagcttatccaccatgatcaggtgggcttcatccctgggatacaaggctggttcaacatatgcaaatcaataaatgtgatccagcatataaacagaaccaaagacaaaaaccacatgatgatctcaatagatgcagaaaaggcatttgacaaaattcaacagcccttcacgctaaaaactctcaataaattaggtattgatgggacatatctcaaaataataggagctatttatgacaaacccacagccaatatcatactgaatgggcaaaaactggaagcattccctttgaaaactggcacaagacagggatgccctctctcaccactcctattcaacatagtgttggaagttctggccagggcaatcaggaaggagaaagaaataaagggtattcaattaggaaaagaggaagtcaaattgtccctgtttgcaggtgacatgattgtatatctagaaaaccccatcgtctcagcccaaaatctccttaagctgataagcaacttcagcaaagtctcaggatacaaaatcagtgtgcaaaaatcacaagcattcttatacaccaataacagacaaatggagagccaaatcatgagtgaactcccatttacaattgcttcaaagagaataaaatacctaggaatccaacttacaagggacatgaaggacctcttcaaggagaactacaaaccactgctcaaggaaataaaagaggatacaaacaaatggaagaacattccatgctcatgggtaggaagaatcaatatcgtgaaaatggccctactgcccaaggtaatttatagattcaatgccatccccatcaagctaccaatgactttctttacagaattggcatatgatccttttaatttgctattacgttttgtttgctagtgttatgttgaggaatttgcatctatgttcatcaagaatattagcctgtaatttttgtttgtttgtttgttttgtttgtttgtttggtgacacaaagtctctctgtctcccagactggagtgcagtgccgtgatctcagctcactgcaatctctgcctcccaggttcaagtgattctcctgcctcagcctccccagtagctgggattacaggtgtgagcccttatgccctgtaattttctttcttgaagtgtccttgtctgacttttctatcaggatgatgttggctttataaaatgagtttggaagtgtttcttcctcttcacctttttggaagcatttgagaggaataggtgccagtttttaaaatatttaataaaatataccaatgaaaccatcaaatatgggacttttcttttttggaaagtttctatttactgattcaatctccttccctgtattggtgtgttcagatcttctatttctgagatgatccagtcttgatagattttgtgtttctaggaatttatccatttcttctaggatgttgcattcattggagtataactcttcatagtagtgtctcatgatcctttatggtgctgttctataaattgtaatgtcgtctctttcatttataattttatgcacatattctttttttagtgtagctaaaggttcatcatcttatcaaaacagcaaatcttagttttattagctttttctattgttttcctagttttaattttatttatatctactctgatctttctcattttcctcctgctggtgaattagggcttactttgttgttctttttctagttcctcgatgtataaattagttttttttttttcttgagatcttttttctctctcaatgtacgtcttttttgctataaacatatctcttagcactgcttttgctgcatgccatatgttttggtaagttgtgtatccattttcatttatctcaagatattttttgatttcccttttcatttattcttgacccattgattgttgagataggtgttgtttaatttccacattttggtgaattttctaattttcttcctgttagtgttttcaagttttaaaacattatagtcaggaaagatactggatatgatttcagtcttcttaaatttcttaatacttgttttatgacctaatatgatctacttggacaatgttccatatgcacctgaaaagaatgtgtgttttgctgctgttggataaagtgttctgtatatgtctaataggtctatttgctctacagtattgttcaagcccactgttttcttattgactttctatctagatgatctatccattgttgaaagttggctattgaagtcttccattattgtattactgtctacttctcccagcagtcatgttagtatttgccctatacatttacatggtgcctttttgggtgcatatacacttataatcattctgtaatcttagtgagttgactctcgtgacctcctttgtatttcataatagtttttgtcttaacatctattttctctgatataaatagccacctttcctctcttttgtttacatagaatgtctttttccattccttcactttcagtacatgtgggttttaaaactcaagttaatctcttgtaggcagcacataatttaatcttatctttttatttatgtagacactttgtgtcttttgattggagaatttaatcaatttacatctaaagtaattattgataggtaaagacttactactgccattttgttaatattgtcctgactacttagttccattctgcctctattattgtctttctttgtgatatgtgattttctctagtggtattatttgtttcctttttcttaactttttgtgaattttgtacagttttttttcttgtagttaccatgaggcttatgtaaaacatctcatagctatatcagactattttaggctgataacaatttaatttcattggcattcaaaaactacactttaccttttcctcctgcatgttttatgttatttatgtctcaatttacattttttgtatttatcctgtccattaacaaattattgtaaatacagttattttaatactttttttgtatttataaaccaccaggtttatttacataccaccattacagtatcagagtagtctgaatttgaccatattcttaccttataatgagttatactttcatatttttcatgttgttggctgacatccttttgttttaacttggaaaattcactttagcatttcttgtaagacaattccagcggtaataatctcccatggcttttctttgtcttggaaagtccttacttatctctcattcatttctgaaaattagatttgctgggtatagtattctttgttgacaggcctttttgtctttctttctttcattttaacatattgaatatatcagcccactctctcctcacctgtaatgtttttgctgaaaaaactgctaataatcttatgaactttcccttgtatgtagcaagttgtctttctcttgttttctaacttctgtcttatgtttgacttttgaaaatttcattattatgtgtcttgatgaagatctctccatatttaatctatttgggttatttgggcttcatggatatggagattcattttcatctccagatatggggagtttttttaatcattatttcttctggcccctttatctttctctgccccttcttgaactaccatgatgcatacattgtttcacttgatcttttctcagaatttctgtaggctttctttacacctttttattctttttttcttttcatttccctgtctgggtaatttgaaatatgctttctttgagcttgctgattctttctttgcttgattgagtccactgttgaagctttgtataaaattttcagttcagtcattgatttgtagtgccacaacttttgtttggttattttttatagcatatctttgttctactttttattctgtacatgtattgttttcctaattttattttttttttatttatgttcttttgtagctaagtgggcttctttaaaattattttgaattctttgtcaggaagttcacagacctctattttttaaggaagggtcagttactggtgctttactttttttcctttggtggtattatgttttcctgatgtttatgattatgtggacataaattagtatgtgcacatatgaaaaagtaagcacctatttcagtctttacagacaggctttggaaagaaaagttccactagtcagtttatccaaagattcttggaagaccatcttgcagggttcatgggtagacttgctgctagagtcttggggcctggtgtagggtcagaagcttggcaggcttagcacctggttccacaggtgtaggcttagtgcctgggtccacagggttgagcccagagcctgagtccactctggagtctggagcttgaatctgctgcggtgggcttgaatcctgagtcactggggctcagcttgtggctgagatccactgcagtgcgcttgtttactgggtctgtgggagtggtcatattggagtttggatcctcaggggcaggcctggaagctatattcacaagtcctgaatttgtacggactatcctgaagctagagttactgggattatagcttggtacctaggcccataggggcaggcccagggcctgcttccatgggaacgggcctagagcctaagtccataggggctggcctagttctggatctagcctagagcctgagttcacaggggtagttctggagtctgggaatataggggccagcctggtgctaaggtctactggggtggacctgaaccctgatgtactatagccagaggcctgaagcctagattcattaatgctagtctgaggcctgagacaaccactggagctagcctggctctagggtaggcctgaaacctttggctgtggggtccagcctggagcctggggctgtagggtcctgcctggcattggagtgggcctgaaggctttacctgtacgtgctggtctggaacttggggctatggccgccaacctgatgccagggttcacaatctcaccagcatctgttattttttgactttttaataatagccattctgactgatgtgaatgttgcctcactgtggttttgatttgtatttctcttatgattagtgatattgaactttttttcatgtgctttttggccacgtgtatatcttttctcccattccataggttgtctctttgttctattcatagttttcttttgctgtgcagaagctctttagttgaaatagatcccatttgtcaattttggcttttcttgcaattgcttttggtgccttcatcatgaaaacctgttcctatgttcagaatggtattgccttggttgtcttccagggttcttatagttttgggttttacatataagtctttaatccatctcgagttgatttttgtatatagtgtaaagacaggatccattttcaatcttctacatgtggctagccagttatcccagcactatttattgaacagagggtcctttcccatggcttgtatttgtcaggttggtcgaagatcagatggttgtgggtgtgtggcctaatgtggtgcttttcttctcatgtttatcctccttgagttcattgaaattttgggatatgtggttttagttatcaaatttagaaaatgtttgatcatttttacaatttatttattattattatactttaagttttagggtacatgtgcacaatgtgcaagttagttacatatgtatacatgtgccatgctggtgcgctgcacccactaactcgtcatctagcattaggtatatctcccagtgctatccctcccccctccccccaccccacaacagtccccagagtgtgatgttccccttcctgtttccatgtgttctcattgttcaattcccacctatgagtgagaatatgaggtgtttggttttttgttcttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgacgcaataaacatacgtgtgcatgtgtctttatagcagcatgatttatagtcctttgagtatatactcagtaatgggttgcctgggtcaaatggtatttctagttctagatccctgaggaatcgccacactgacttccacaagggttgaactagtttacagtcccaccaacagtgtaaaagtgttcctatttctccacatcctctccagcacctgttgtttcccgactttttaatgattgccattctaagtggtgtgagatggtatctcattgtggttttgatttgcatttctctgatggccagtaatggtgagcattttttcatgtgttttttggctgcataaatgtcttcttttgagaagagtctgttcctgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttctcttgctgtgcagaagctctttagtttaattagatcccatttgtcaattttggatttattgccattgcttttggtgttttagacatggagtccttgcccatgcctacgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagaaccatttattaaatagggaatcctttccccattgctcatttttctcaggtttttcaaagatcagatagttgtagatatgcggcgttatttctgagggctctgttctgttccattgatctatatctctgttttggtaccagtaccatgctgttttggttactgtaggcttgtagtatagtttaaagtcaggtagtgtgattcctccagctttgttcttttggcttaggattgacttggcaatgcgggctcttttttggttccatatgaactttaaagtagttttttccaattctgtgaagacagtcattggtagcttgatggggatggcattgaatctgtaaattaccttgggcagtatggccattttcacgatattgattcttcctacccatgagcatggaatattcttccatttgtttgtatcctcttttatttccttgagcagttgtttgtagttctccttgaagagttccttcacatcccttgtaagttggattcctaggtattttattctctttgaagcaattgtgaatgggaattcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgtttccagtttttgcccattcagtatgatattggctgtgggtttgtcatagatagctcttattattttgaaatacatcccatcaatacctaatttattgagtgtttttagcatgaagcattgttgaattttgtcacatgccttttctgcatctattgagatcatcatgtggtttttgtctttggttctgtttatatgctggattacatgtattgatttgcatatattgaaccagccttgtatcccagggatgaagcccacttgatcatggtagataagctttttgatgtgctgctggatttggtttgccagtattttattgaggatttttgcattgatgttcatcagggatattggtctaaaattctctttttttgttttgtctgtgccaggctttggtatcagaatgatgctggcctcataaaatgagttggggaggattccctctttttctattgattggaatagtttcagaaggaatggtaccagttcctccttgtacctctggtagaatttggctgtgaatccatctggtcctggactctttttggttggtaagctattgattattgccacaatttcagatgctgttattggtctattcagagattcaacttcttcctggtttagtcttgggagagtgtatgtgtcgaggaatttatccatttcttctagattttctagtatatttgtgtagaggtgtttgtaatattctctgatggtagtttgtatttctgtgggatcggtggtgatatcccctttatcattttttattgtgtctatttgattcttccctccttttttcttagtcttgctagcggtttatccattttgttgatcctttcaaaaaaccagctcctggattcattaatttttgaagggtttttatgtctctgtttccttcatttctgctctgattttagttgtttcttgcattctgctagcttttgaatgtgtttgctcttgcttttctagttcttttaattgtgatgttagggtgtcaattttggatctttcctgctttctcttgtgggcattcagtgctataaattgccctctacacactgctttgaacacgtcccagagattctggcatgtagtgtctttgttctcgttggtttcaaagaacatctttatttctgccttcatttcgttatgtacccagtagtcattcaggagcaggttgttcagtttccatgtagttgagcggtttttagtgagtttcttacccctgagttctagtttgattgcactgtggtctgagagatagtttgttataatttctattcttttacatttgctgaggagagctttacttccaagtatgtggtcaattttggaataggtgtggtgtggtgctgaaaaaaatgtatattctgttgatttggggtggagatttctgtagatgtctattaggtccacttggtgcagagctgagttcaattcctgggtatccttgttgactttctgtctcgttgatctgtctaatattgacagtggggtgttaaagtctcccattattaatgtgtgggagtctaagtctcattgtaggtcactcaggacttgctttatgaatcttggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtgtcttttaattggagcatttagtccatttacattgaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatacgaaattctgggttgaaaattcttttctttaagaatgttgaatattggcccccactctcttctggcttgtagagtttctgccgagagatccactgttagtctgatgggcttccctttgagggtaacccggcctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccgtcactttcaggtataccaatcagacgtagatttggtcttttcacatagtcccacatttcttggaggctttgttcatttctttttattcttttttctctaaacttcccttctcgcttcatttcattcatttcatcttccattgctgataccctttcttccagtttattgcatcggctcctgagtcttctgcattcttcacatagttcttgagccttggttttcagctccatcagctcctttaagcacttctctgtattggttattctagttatacattcttctaaatttttttcacagttttcaacttctttgcctttggtttgaatgtcctcccgtagctcggagtaatttgatcgtctgaagccttcttctctcagctcgtcaaagtcattctccgtccagctttgttccgttgctggtgaggaactgtgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaagagagaggaccctcagctgcaggtctgttggagtacccagccgtgtgaggtgtcagtctgccccttctggggggtgcctcccagttaggctgctcgggggtcaggggtcagggacccacataaggaggcagtctgcccgttctcagatctccagctgcttgctgggagaaccactgctctcttcaaagctgtcagacagggacatttaagtctgcagaggttactgctgtctttttgtttgtctgtgccctgcccccagaggtggagcctacagagtcaggcaggcctccttgagctgtggtgggctccacccagttcaagcttcccggctgctttgtttacctaagcaaacctgggcaatggtgggcgcccctcccccagcctccctgctgccttgcagtttgatctcagcctgctatgctagcaatcagcgagactccgtgggtgtaggaccctctgagccatgtgcgggatataatctcctggtgcactgtttttttgtgtgttttttttttgtatttattttattttatttttatttttatttttttattttattttttttattatactttaagttttagggtacatgtgcacattgtgcaggttagttacatatgtatacatgtgccatgctggtgcgctgcacccactaactcgtcatctagcattaggtatatctcccactgctatacctcccccctccccccaccccaccacagtccccagagtgtgatattccccttcctgtgtccatgtgatctcattgttcaattcccacctgtgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaacaacagtgtaagagtgttcctatttctccacatcctctccagcacctgttgtttcctgactttttaatgattgccattctaactggtgtgagatgatatctcatagtggttttgatttgcatttctctgatggccagtgatgatgtgcattttttcatgtattttttggctgcataaatgtcttcttttgagaagtgtctgttaatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctttgcagaagctctttagtttaattagatcccatttgtcaattttggcttttgttgccattgcttttggtgttttggacatgaagtccttgcccacgcctatgtcctgaatggtaatgcctaggttttcttgtagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggttactgtagccttgtagtatagtttgaagtcaggtagtgtgatgcctctggctttgttcttttggcttaagattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttaagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccccggccagaacttccaacactatgttgaataggagcagtgagagagggcatccctgtcttgtgccaattttcaaagggaatgcttccagtttttgcccattcagtatgatattggctgtgcgtttgtcatagatagcgctgttttttaagcccgtcagaaaagcgcagtattcgggtgggagtgacccgattttccaggtgctgtctgtcacccctttctttgactaggaaagggaactccctgaccccttgcacttcctgagtgaggcaatgcctcaccctgctttgactcgcacacggtgagagcacccactgaccttcacccactgtctggcactccctagtgagatgaacccggtacctcagatggaaatgcagaaatcacctgtcttctgtgtcgctcacgctgggagctgtagactggagctgttcctattcggccatcttggctcctcccctgaaaatgttcgatcattattcacacttttttctttctcttactctgtcttctctcctttagattttctagttatgtgacattttcttcttgctactttccactggtcactgaaggctctgattattttgtcttcattaaacttttgtgagataattttagatttgcatccagttgtaagaaataatatagagagagcctatgtatgatttacccaatcccctttaatgctaacatcctgcaaaattataatacaatataacaaacaggatgttgaaattggtgtaatcaagatacagaatatttcattcattgcaatggtctctcgtgttgccatttaatagccacagtcacttttctccatccctactccctccgtaaccccgaaagctactaatgtattccccatttatataatttttgtcatttcaagaatcttatataaatagaatcatgcaatatgtaacctacatggactggatttttttcatccagcataattccctgcagatttattaggtttttacatgtaacaatagttcatttttatggctgagtagtattccatgatatagatgtatcacagtttgtttaaacgtttttcatttggactgatatcagttgcagcagttatgaataaagctgcttttttctatgaaaagtttttaatacttttacatttaagttagtgatccatctttggttaatatttttggtaaagtatgagatgtattcttgctgatgcatttgttgaaaaggttatccttctttattgaattccttttgcacctttcccattaatcaagtgggaatatttctgtgaattctcttatgggctctccattttattccattgattgatgcatatatctcttcaccaatatgacatagacttgattagtcttgaaatcaagtaaatgatcttaccttactcatatttattataactgttttagctactgtactttttgccttttcatatattttttggaaaaacttggttatatacaaataatgttgcttggattttgataagaattgtattaatcctgtatatcaatttcaggaaaatactcatatttttattacactgagtcttccaagccacaaatacaatatatctctcaatttatctatctttaattttgtttatcagtattttatagattttagtatagaagatctataaatatcttgttagatttacatcttttctctttttgagctatggtaaatattattgccctttaattttactgtccatgtgtttgtcactaatatatagaatataactgattttttatgtttatcttttattctgctaacttgttgaactcgttttttagttttggagtttataaattccttaagatttcctgacaattatatgcaaattgaaaccatttcgttgcttttctgatctgttgttattttatttacttttcttgcctttatacactggctagaacttccaaccctacattgaatagagtcatgagagtaaacattcttgccttgctgtcagtcatagagggaaagaatctggtcttttaccattgaatatacagatggtccttcatatctgtggcattttatctgtggatttaatcaacaatggaacaaaaatttttaaagaaacttaatcgttgtgtctgtgctgaacatgtatacagaactttttcttgtcattattccctaagaatacagtataacaattatttacatagcatttacactgtactaggtattatcagtaatccagggatgatttaaagtatatgaaaaaatgtgcagaggctatatgcaaacactacatcattttatataaaggacttgggcatccatggatttttgtattcatgaggggtcctgggaccaatctcccatggatgttgaggaacaactgtaatgttagctttaggtttcttgaatatactgtttgtcaagttgaagaagttttcaatactctcattttttctgagattttaaaaaaagtatgaatgggtgttgaattatgccaaatggttttttctgcattgattgattatcatacgaattgtcttctttattctatgattatggtgaattagattgattgattttttaatattgacctgttttgcatggtacaataaattccatttgatcatgttgcatattttttgtacaaatatatatatatagtatatacatatatagtacatatatagtatatatatgtataaaagtttcattcgtattttgttaaggatttttgcatctttattcatgagtgacattggtgtattttgatgatacacaaatcatcataagaatttctttcttctttctttcttctctctctgtctgtccatctgtctgtctgtctgtcttttttcttttctttctttctctcttaatatctttgcctgatttcggtatcaggaaaatactagctacactgttttctggaagaaattgtagaattattgttatttgttctttaaacatttggtagaattattcggtgaaaccatctgggtctagatatttttcttttgagactatttaaatgatgaattatttgtttcatagttacagggctatacaaattatctatttcttatgagtgagttgtggtagcttgtgttttttgaggaattagcccactttgtctaagttgccaaatttatgtgtataattatttgtagtagttccttattatagttttattatcatcggtgtccgtagtaatatccttgttttattcctgatatgggtaatttgtgtcttctctttttttttcattgttaatcttttgttgtcaattttattgacaacattgcaataatgttctgtattgcttttctgttttcaattttattgatttcttgtattatctttattattttctttgttttgctttctttgggttgattttgctcttcttattttaaattcttaaagtagaagttaaaattattgatttaagacttttcctctttttcaatgcaaacatttaatgctgtacattttcctctcatcactgttttagctgtgagttcaaatttttgatattgtatttttatttttattcagctaagtgtatttattttcccttgacacttcctctttgacttatgaattacatagaagtctcctgcttagttatcatgtgtttggagcttttcctattatctctctgttattgatttgtcatttgattccattgtggtttgattttaattccattacattttttaggtttgttttatggttcaagatgtagtctatcttggtatatattctgtgagcatttgacaagaatgtgtattctgctatcactgggtagagtagttaatgtcaagtagatcctacggtcttacggtattgagttctttgttgatgctagttttgtgtctagttctatttttaattggtacaagagtgctgttgaagtccccaactataattgtgcattagtctatttctcctccatttctaacagcttttgcctcacatatttcactattttattttttggtgcacatacatttagggttgttatctctcattggttgattgactcctttattattataaaatgtcccttcctatttctggtatcttttttttttgctctaagatctaatttatctgatatagccacagatatagctgtgtccccatcaaaatctctcatcttgaattcccacatgttgtaggagggagctggtgggagataatttaatcatgggggaaagtctttcccatgctgttctcataatagtgaataagtctcacaagatctgatagttttataagggggagtttccctgcacaagctctctctttgcctgctgccatacatgtaacacgtgacttgctcctccttgccttctgccatgattgtgaggcttccccagccacatggaactgtaagtccattaaactctttttcctgtataaattgttcagtttcaggtatgtctttatcagcagcctgaaaatggactaatacagtaaattggtatgagtagtgggatgctgctaaaaagatacccaaaaatgtggaagccactttaaaactgggtaacgggcagagtttggaacagtttcgagggctcagaagaagacaggaaaatgtgggacagtttggaacttcctagagacttgtcgaatggctttgaccaaaatgctcataacgatatggacaatgaaatccaggctgaagtggtctcagatggagatgaggaacttgttgggaaccagagcaaaggtgactcttgttacgttttatcaaagagactggtggcattttgcccctgccctagagatttatggaactttgaacttgagaaagatgatttagggcatctggtggaagaaaattctaagcagcaaagcattcaagaggtgacttgggtgcagttaaaggcattcagttttataagggaagcagagcataaaagtttgaaaaatgtgcagcctgacaatgtgatagaaaagaaaatcccattttctgaaaagaaatccaagccggctgcagaaatttgcataagtaatgaggagccaaatgttaatctccaagacaatggggaaaatgtcttcaggccatgtcagaggtcttcatggcagcctctcctgttacaggcctggaagcctaggaggaaaaagtggtttcatggggtgggcccagggtcctcatgctgtgtgcagcctagggactttgtgccctgcatcccagctgctctagtgatggctgaaaggggccaaggtagagcctgtttaacctgttttgatttggagaagcacagaaaatgaggcacacagagattcacataaagatgccatgtatttgaggagcaatctgcctgtgtggcaatagagaaggagagagcttttagactatgaagcctggaagtttacaatggccccttaccctgaccagaacttcctgaaaaaaagttaacaaaggaaatagtaaataaagtaaatatatactagcaaataaaggctgctattaagtaaaggctaatattgaagaatctgaaaagcatcagcagaaatttattgtaagagaagagtatagaagtgggaaacaatatttaccatcaaataaaaagtaattgccaataggaaaatgttgcacagaacacattaaagaaaaccctttgaaaaattcaaactaaagagactttttataaagatcatatataaaaataaacaacaaaaagtgataattttgaaaaagagcaattaagggaaattagctctttcagatattaaaatattttataaagcctaatatttaaatttatgtgatattaggatataaatagtgagaaagaataaaggaataaaatagaaagtataaaaattaatatgaatatatatatatactttaacatatgataaagatgacatctcagttttcttgggaacttggatagccacttggaaaaacttaagttgaatctctactttatatcctaacaagatacatctaaaatggattatattttaatgttaaaaaataaataaatcttaaatgtactagaagaaaaattgaatacctcctataaaagctaaaagaaaagacagagcatttctcaacagcaaaatgtaccataagataatgtcaacagaacaagttaggaatacatttgcaatacaattcatatcaaaaagggctaatccctttaatacaaaaaatcagagaaaaagataatgtaatcaatcaaacaagatgcaaaagacaccaagaggcatacagtggaaataaaaataactattagatgtataagttctatgtcactctaaatatatgacttataagttggagctaccatgaaatatctttttatttattagatgtttaaaaccataaaattttaataacagaatctgtcaaaatgtgggaacacactcttactttgctaatggaaaggtcaatatgtacaattacaagcaagagaaattcaaactttcaaacatctaattacaaacatgtatttcctctgatgtttgacctagcaatttaatttatatatatttccatgtatgtaaaattacatctagacatatttattctttcaaccactgtttgtaatagcaaaagactgggaacaacccaaatatccattaaaaggtgaaggtttaaataaatgatgatatattcatacaacagaaggtaatacaaatctaaaaacagactaaaataaagtcttctttatgctctaaagtgaaaggatctccatgatatattatgtaaggaagcaaggagaaggatttaacagtttttaaatctctgctcttaatgctgcatataaggagcttggaagtcaccactccatccagttttctaacaagtaaaaaaacagaacagactgaaaaataacaaattttctaggattcatcagagaggtgaggatatagaacaaactgcttcccacaatattggagagataataagattaatacagggagtcatgggtttaccacagcagagacttacaagcaaaactgctgcaggaaccagtgccaggtataaaaacctgaactataattgataaattgctagagactcagagaggacaaatctgagacttgtatatcccaatggaatcctgccaagaagaggtggggtatgtgagtttaacctgcaagagtatgaccaggttctcatagtaaatactggaggaagacttcccttgtgtttcaagtacagggagaggaaatacaccagagtacactgctctttgacaaggcctgccctcaggagaagctattcaaacagagccttgtctgctgaggttttgtagcctaactgacatgtgggaagggaaatacccaaatctagccatcctatctcatggaaaaggaaggggggctgagaaattgagactattgggaggttcatagtccagagacacagtccagaggctcactgaaacactgagatctaatcataagactacagaatggtttccttccccccatcccttaacaagatattactaaaggcctattttcagcagttccatttacatggtaaatcatttctgactatgaagaaaaaattactaggaaaaaaaaaaaagaattagaagaaatagagtaagcatcaggaccaggtaaggcagggatattgaaatgatcaaacctgaaattttaaacaacaatgaaaaatacgctaagggctctaacagataaagtagacagcatgcaagaacagatgggcaaatgtaagcatagagatggaaatcctaggaaagaaacaaaaagaaatgctacagatcaaaaatactgttgagaggtgacagtgtgctggcagtcttcacagccctcgctcgctctcggggcctcctctgcctgggctcccactttggcggcacttgaggagcccttcagcccaccactgcaccatgggagcccctttctgggctggccaaggccagagctggctccctcagcttgtgggcaggtgtggagggagaggcgcgagcgggaaccggggctgcgtgggtgcttaagggccagcgtgagttccgggtgggtgtgggctcggcggacaccgtgctcggagtggcggccagccccaccagccccgggcagtgagggatttagcacctgggccagcagctgctgtgctcaatttctcgctgggccttagctgccttcccgtggggcagggctctggacctgcagccaccatgcctgagcctccccccgcaccccaccccccaccctccctgggctcctgtgctgcccgagcctcccaaggagcgcagctgcctgctccacagtgcccagtcctatcgacacccaagggttgaggagtgcgggcgcacagtgcgggactggcaggcagctccacctgcagccctggtgctggatccactgggtgaagccagctgggctcctgagtctggtggagacgtggagaacctttatgtctagctaagggattgtaaatacaccaatcggcactctgtatctagctcaaggtttgtaaacaccaatcagcaccctgtgtctagctcagggtttgtgaatgcaccaatcgacactctgtatctagctactctgttggggccttggagaacctttatgtctagctcagggattgtaaatacaccaattggcactctgtatctagcttaaggttagtaaacacaccaatcaccaccctgtgtctagctcagggtttgtgaatgcaccaatcgacactgtatctagctactctggtggggacttggagaacctttgtgtccacactccgtatctagctaatctggtggggacgtggagaacttttgtgtctagctcagggattgtaaacgcaccaatcagtgccctgtcaaaacagaccactaggctctaccaatcagcaggatgtgggtggggccagataagagaataaaagcaggctgcccaagccagcagtggcaacccgcccgggtccccttccacagtttggaagctttgttctttcgctctttgcagtaaatcttgctgctgctaactctttgggtccacactgcctttatgagccgtaacaccgcgaaggtctgcagtttcactcctgagccagtgagaccacaaaccgaccagaaggaagaaactccgaacacatccgaacgtcaggaggaacaaactccagatgcaccaccttaagagctgtaacactcaccccgagggtccgtggcttcattcttgaagtcagtgagaccaagaacccaccaattccagacacactgtgacagaagtgaagaattcctttgatgagcttattagtagactggacacagctgaggaaagaatctctgagcctgaggctataacaataaaaaccttcaaaacaacaagtaatgaagatgatacaatagctaaaaagaaattatttaggcagtgagggtaagtgtattagtcagagttctctagagggactgactaataggaaatatatatatgtatatatatatatgtatatatatgtgtatatatatgtgtgtatatatatgtgtgtgtatatatatgtgtatatatatatgtgtgtgtatatatatatgggagtttattaagtgatattaactcacaccatcaccaggtaccacaataggccatctgcaagttgaggagcaaggaagccagtctgagtcccaaagctgcagaacttggagtccgatgtttgagggcagaagcatgcagcacaggagaaagatgtaggctgggaggctaaaccagtctaggcttttcacatttttctacctgctttacattctggctgcgctggcagcagattacatggtgcccacccagattaagggtgggtctgcctttcctagcccactgactcaaatgttaatctctttggcaacaccaacaccctcacagacatacccagaatcaatactttgcatgcttcaatccaatcaagttgacactcagtattaaccatcacagtaagaaagtcctctgtaaggcttcccttttaacaaaaagcagcctcaaatcatttttgtttctagcaaaatgcagcctgaaaaatcaaactgcagatgtagaaaagcaagctagaagctttcacgggtaaatgccagcagctttgacaatagaaaaaggctacctggaggccaggcatgttcaacatgggactccatcttccctttcctttgtcaactgtgtgaactgtaaggaacagatgtaatggcacaggccaggtagagaactcatttgcatgataaaaagattagggtggggtagccagcttcttcatgtgctatgtaaatgacacacctggtccaaccaaccaatcttttgggccccatgtaaatcaggcaccgccttctcaagcttgtctattaaaacctgtgcatttcatcacaaaactggaggacccgcttgggagcccctctctctctgcaggagagagagctattctctttcttttgcctattaaacttccactgttaaactcacttcttgtcctagatttctctggcatgagacaacgaaccttaggtatttaccccagacaatgatgctgcttcaagaacaaccaaaaaatagaaaaaaaaaaaacaaaaaaaaacagaacagaatattcagggagtgtgtgacaactataaaaggtgtaacataaacagaaacagaacactagaaggagaaaaaaagtgaaataaacaggagaaatatttaaaacaataatgctttagaatttttcccaaattaatgtcagacaccaaatcacagatccagaaggctaagggaaaatgaagcaggataagtgctaaaatcaaatattaaaaaaaattctgaaagaagtaagaggaaaaaagcaccttatttttagaggaacaaagataagaattatatccaacttctcctctgaaaccaggcaagcaagaggagagtagggtaaaatttttaatgtcttgagtgggaaaaaaaaataatctcgccaacctagaattctgtactctgtgaaattacactacaaaagtgaaggagaaatacagattttctcagataaacaaaaattacagtggtttattgctactagacctgctttgcaagaaaaggatagggaaggaaaataatatagctcaaaaacttggatcatgataaagaaagaaataacactggaaaaaataactaacagtaaaataaaaacatttttcttcttcttaatctaaaagataatagtttgttcgaaataatagcaatagtgtatttgcttatgtattctaatatatatatagatttttatatgcttatgtgtaattggaatgaataatagcaatgatacaaagaatggaaaagaagtatcaagattattttgttattatagggtactcatactacctgtgaagcagaatagtgttatttgaaagtggacttggatttgatgtatattgcaaactagggcaaccactaaaaagtgtaaaaagaaagaagtataactgatgtgctcagaaagaagagaaaatggaatcgtaaaatgctcaatgaaaaccacaaaaggcaaagagcagaaaacaaacataggaacaaagaacaaacgcagcaaaaggaaacagcaacaaatatggcaaatattaattcaagtatacaaataatcactttgaatatccatagtctaacacaacttaatacatttacactgttggatagtaaaataacacatcttattagaacatgtgggatatagcaaaagcagtgctcagggagatatttacagcattgaatgcatatattagaaaaaaggaaagatctaaactcgaacatctaagttcccactttagaaaacttgaaaaagaagagcaaattaaatccaaagtaagcagaaaaatagaaataaaaaagttagaggagtcattaatgaaattcaagacataaaatcaatagaagaaaaaaatttaaccaaaagctggttcttgaaaagatcaataaaatcactaagctctagtcaagataactaaaaacaaagagagaagacatcaattactattatcaaaaaggaataggggatatcactatatattgcttgaatattaaaaggataactaaagaatactatgaacagaccaagcgcggtggctcacgcctgtaatcccagcactttgggaggccgaggagggtggctcacaaggtcaggagatcaagaccatcctggctaacaccgtgaaaccccatctctactaaaaacacacacacacacacacacacacacacacacacacaaattagctgggtgtggtggcgggcccctgtagtcccagctactcaggaggctgaggcagaagaacggcgtgaacccaggaggtggagcttgcagtgacccgagactgggccactgcactccagcctggatgacagagtgagactccatctcaaaaaaaaaaaaaaagaagagtactatgagcaactttatatgcacaaatttgctaacttagatgaaatgaaccaattccttgaaagacatagtttgccaaaactcacacaagaagaaatagataatctgaatagtcccaggtctagcaaaacattgaatcaattaataaccttccaaaacagaaagcagtaggccagatgggttcactagtgagttctaccaaacatttaaagaagaaattatacaaattatctttaatatttttcagaagatattagcagaaggaatacagcctaattcttccaataagaccatcattaccagataagattattacaagaaaagaaaactaaagaacagaccaatatctttcataaacataaatgcaaaaatcctcaaaatacattagcaaatagaatccaacaatgtataaaaaattacacaccacaatcaagtgggatttattgcatgcaggcaagactggttcaacatctgaaaataaattatgcaatccatcacattgacaggctaaaaaagaaaaattgcatgatcatatcaatagactgggggaaaagcatttgacaaaaccaatataataaaaattctcagtaaaatagaaataaagggaaactttgtcaacttgataaaaacaatctacaaaaatcctacagctaacatcatacttaatgataagaaactgtaaactttttcactaatatcaaaaacaaaccaaggatcctctctcaccacttctttgcaatattgtgctggaattcctagctaatgcaataaaacatgaaaagcagataaaaagtctacaaattggaaagtaagaaataaaattgtcttcattcacagatgacatgatcatcaatgttgaaaatgcaaaataagagtaaaaaactctcctggaactaataagtgattataccaagattgcagaatatgaagaataagcttagtaaattgttttcctatatatagcaatgaacaagtgaaattttaatttaaccatataataccaaatctacatgcagaaaactacaaaactgatgaacatcaaagaactaagtaattaaatattttatgttcatggatagaaaaactcaagattgtcaagatgttagttcttcccaatttgatgaagttccaatgcaatctcaataaaaattccaggaaattatttcatggatattgaaaaactaattctaaaatgtatatagagagggaaaagaccctaaatacccaatgtaatattgaaggagaaaaacaaaattggaggacgaagacaagacccaacttaaagacttacaataaagctgcagtattctagataacatggtattggtaaaagaatagatgaatagatcagtgaaacagagcagggagtccagacgtagacccacacaaagacatcaactgacctttgacaaatgagcaaaggcaatacaatgaaaaaaagatagtcttttcaacaaataatgctgaaacaactagacattcacatgcaaataataataaaagacagataaaataaaagatgtagaccttacactcttcacaaaaattaactcaaaatagatcatggatctaaatgtaaaatgcaaaactataaaactccttgaagaaaacataggagaaaatctaaattgccttggctttggcaatcactttttagatacaacaacaaaacatcttccatgagagaaataattgataagctagactgtatgaaaattgaaattttctgctctacaaaaggcaatgtcaagagaatgagaagataagctaatactaaaataaaatatttgcaaaagatgtatctgattaaaaaacttatctaaaatatacaaaggacacttgaaagtcatcaataagcaaataaacaacccaattaaaaatggtttaaatatcttaagaagcacctcaccaaagaagatatacagatgaaaaatgaacatataaaaagatgcttcacatcatatctttagggaaacacaaattaaaacaacaatgaaataccactacgcacttattagaatggccaaatttcaaaacagtgattatatcaatagctgatgaggatgtggagctactggaactcttattcattgctggtgggaatgcaaaataatataggcactttgaaaaacaatttggtggtttcttacaaaactaagcatattcttaccacatgatccagcaataatcatccagtaataatgctcctttatatccaatcaaaggagctgaaaacttacacccacagaagaatctgcacatagatgtttactgctgctttacttataattaccaaaacttggaagcaatcgagatgtccttcaataggtgattatatcaatgaaccgtggtacatccaaacaatggaatattatacagccctaaaaagaaacgagctgcaagctataaaaaacatggaggaatcttaaatgcatattactaagtgacagaagccaatctgaaaaggctacatatcacatgattccaactatattatattatggaaaaggcaaaactgtggagatagtaaaaagatcagtgattggaacagagaggcagaacagaggattttcagaatagtgaaaatactctgtatgatattatgatggtggatacattgcattatatatttatcccaacccaaagtatgttcaacaccaagagtgaaccttgatgtaaactaaggactttgggtgaccataatgcatcaatgtaggtttatcaattgtaacaaacgtaccatactgttgggtaatgttgataataaggaagattatgtatgtgtgtatgtatgtatgtgtgacagcagggggtatatgggaaatctctgtaccttcctcgcaattttgctacaaaactaaaagtgctctaaaaaaataacacctaagaaaagtaacttgcacattttaaaataagcaatgagtcaaagaagaaatcatgagaaaaattagacaacactttcagaagagtctaaataagacccaattcaccaaaacttatgaaatgtagctatacagtgataaagagaaattatagctgccaatgcctgtagtaaaaaagaaaaaggattctacatcaatcaattcacttcccaccctgaaacactggagaaacaagatcaaactaaacctagaactagtagaaggatagcaataataaagattagtatagatggataataataaagtaaaaaacagaaaaacaacagagaaaatcaatgatagcaaaattacattgtttgaaaagatcagtaaaatgcaaaacctcaagttagatgtgtgtttaaaaactgggaagattcaaattactgaaatcaaaaatgaaaggacctctctactgaccatacagaacaaaaaagaggaaaaaggaatcctttgagcaattgtaggttaacaaattagataacagatgaacaaattactagaatgacatgaattactggaactaccttctcaagaaatagaaaatctgagaaattagtttctcagattagacatatcataagtagagattgggttaattattttaaaacttctcacaaaggaaaaccccggcccaaattgttttagtgaattataccaaatatttaaaaattaatataaattattcacaaatttctccaaaatatagaagaagagagaccacttcctacctcattccattaggccaaagttgccatgatacaaaataatacaaagatatcacaagaaaaaaagctacagactaatattttttataagtatagatgtaaaaatcttctacaaaatactaggaaactaaatctaacaacatatgcaaaggattaattatacactatggtcaggtggattttatctcaggaaaacacgttcattcaacatctgaaaacaatgtaatacaccatgtcaatagaataaaggacaaaaaccatatgatcatctcaatagatacagaaaaaagcacttgacaaaatccaacaaagtttcgtgataagatcactgaaaaaactagaaatataaaagaacttcctcacctggtaagggaatctattaaaaacccacagctcacatcacacttaattgtgaaataatcaaagctttccccctaaaatcaagaataagacaggatgtctgttcacatcacttctattcaacatagtactggaggttccagacagagcaatgagataagaaaataaaaagcatgtggctgggcagggtggctcatggctgtaatcccagcaatctgggagaccaaagtgcgtggctcacttgagaccaggagttcgagaccagtctgggcaacatgaagaaatctcatctctacaaaaaatacaaaaattagctgggcatggtgacacatgtctgtagtcctagcttctcaggaggctgaggtgggaggattacttgagccctgaagatagaggctgtggtgagccatgatcacaccactgaatttcagcctgggcaacagagtgagaccctgtgtcaaaataaacaaataaataaataaactaacaaatagcaggcatcattattgaaagaaacataaaatatctgtttgcagatgacatgattttgtgtatagaaaattcttaaaaatatacttttaaaaactattagaactaataaaaattcaacaaatttgcatgatacaagatgaacacaaaaattatattttaatatactagcatagagcatgcagaagtgaaattaagaaacaattccatttaccacagcatcaaaaagaaaaaaatgcataagaacaaatttaataagtgcaaaagtgatatactgaaaactaggaaacatttctgaagtaagaatctaaacaaatggaacgatatctcatgttcatagatcagacatcctattgtttaaatggcaatactccccaaattaatctgcagattcaactcaatccctctctatcaaaaaaagcaaggagtagaacaatgtatattgttctgtattacttatatttccataaagaatgtctagaaacattcacaagaaactaatgaaagcatttatgtatcataatagttgggttgaaactggataaatgtggggcaggttgactatatatattgtttttctttttacaccctgcattattttttaaaagtatgggagaggagcaggattggaaattatcttgccccactctagcagtctgtaagatagacaagcctggattcatagaatcagactagaatgactgacaaataagcagtgtgtggaggtaatcctcataggatgtgtggccgcccattactttgaacttccagagaatattactaacatccattgaaacaggaacaagtaaaggggagaaaggctagcttacttaatccaatgggattttaacttctttatcactatccccacagcagctgtagcgagggccctcacacatctctccagtcttccttttcctcacactgtcacctcttatccaaagtcagaggaaacctagagaaggtagtagattttatctatgaatgatcctgctgtgcaaaggagaaaagatagggaaagactgggaaaaagagcagaggagtcagaaggagttcctgctgactctttacctaacttgggtaccacagggcaggagataaactttggagaagagtgcaattaagcaaacgccacttcagctttgatctacatttaatttgttcacatttgagggttcagatccaaaatgaaaaagggttttatggctgaatattatttcattatatatgtaaaccacatttcctttgtctttttatccactgatagacacttagtttgattccataccttggctgttgtgaatagtgctgtaataaaagtgggaatactggtacctcttcagcatactgatttcctttttatgagtatgtatacccagcagtgggattgctggatcatatggcagttccattttcagtttattgaggaacttctacactgttttctatagttactgtactactttagattcctcccaacagtgtactggcattcccctatctccacatcctcactagtatttgttactttttgtctttttgataacagccattctaactggggtaggtaatatctcctagtgattttcatttgtatttccctcacaatcagtgatattgaatagtttttcatatacttcttggccatttgtatatcttcttttgagaaatgtccattcagatcttttgcccatttttaattgcattgattttttgtttttttttgctattgatttgttagttccttacacatgctggttattaatctcttgtcagaccaatagattgtaagtattttctcacattctgtaggttgtcttttcactttattgattgttttctttgctgtgcaaaagctttttagcttattgtaattccatttgtctattgttgtgttgtctgtgcttttgagatcttaccccccaaaatctttgctcagaccaaagtcctgtagcattttcctagtgttttagtagtttcatagtttcaagtcttgtaatgaagtctttaacccattgttagttgatttttgcatgtggtggaagataaagatctagtttcatttttctgcatatgaatatccagtttatccagcaccatttattaaagagactgtcctttcccccatgcatgttcttgatatctttgtcaaaaaccaactgagtgtaagtgtatggatttacttctggattctctattctgttgcattcgtctaggtgtctgttttatgccaatatcatgctgtttgggttattatagctgtgtagtataatttgaaatcagagcttgtgatgcttctagctttcttctttttgctcaggatgattttagctattcagggacatttgtggttctatacatattttatattttttttatttctgtgaagaatgtcattggaatcaagcttgagcttgtatacagattttaacaatattaagtctctcaactcatgagcataaatttccaccttatcatttgcagcaggatgtgtagaactggaggtcattatgttaagtgaaataagccaggctcacaacaacagatatcacatgttctcattcttatgtgggagctataaaagggggtcttatggaggtagagggtagactgggaagggaagagggatggggagatgaagagaagttggttacggagtacaaagacatggttggatagaaggaatacgttctagtgtaaaagagtacagtaggcaaattatagttagcaataatttattgcatttttaaaaatagctagaagaaaagaactttaatattcccaaaacaaataaaatataaatgtttgaggtgagggatatcccaattaccctgatttggttattattcattgtatacagttttcaaaatatcacatgtacccccaaaatatgtaaaactgttatatacaaataaataacaaaactaaaaataacagctgtgcaaacatttttaaaaggcttgctttaaatgggtttcacatgaaagtaggaaaggactctctggagtctttaccatctttatgtgagaaacacattggtcccagtggtctctttacctttcttagtccatcctttcactctgtacatctttctgaactcaatgaattatacactattgctgcttaattgctttcagaaatggacccctgcacaggtgggaatggatgtgttcacatatgtcagagtgagaatggcacggccaggtgtgcctgtcatgcagggtaccagctgcctgaagataaaaacatttgtgaaggtaggagactgaaactgaaggattaattgtgtaattgtttgaaattttgtggtaattcagttttgaatagtcagaacagctaggagaaaaggtgttttcgtttattcttaaaaaggaacatttaaattcttatttgatcatttgaaagctatttttataccataaaacttcagtgaaattcttagtaacattttaaaaaatgacataggatagttccagacttaatacgttttgtttctcattctgaagtgaattccagaattaatatttcaaaatcttctatagccacacaggaagttttttattataggctacagaaggtggggataacctttgaaaagcaagtatatgtaaatgagtgttttcagaagtcaggaataattaaaacaaaaaagaaagaactctataaatacaaaatcacacatttatctttcctagaactagcaaaacagacatactttaattcaaagatgaaagtgacaaattcttccctcacaagaactgatacattaagtaatttctctggggcagtcttgtcaaaagtctcattttaataacttttgagaaatcactttttttatcatgatattttcatgaaatgagaaaccatttttatcatgatattttcatgaaatgagaaactatttatttggagtaactacaaaagtaattatgacttatgggactgataaaaattacgaaaaataattagtaatggaaatttgtgttttcatttttttctttaggttgaaattaagatgatattttctgtggattttttaaacacacttttctaacagagaacatttctgctttggtcctctgtttccacagcacctatctagctcagcacctggcacagaataggatcatcttaaataaatatttgaggaaaactgacaaatgtttgcagacatagatatagttatgtatatttatctgtctactgactttcacactcctattttaacatctgatacattatttatagaaaatctatcctcagaattactgcctgcctattctattacaaatacattagaagaatgagtatttctcttaagcaccctggtggggatgatatgtagtatggaggaagaaccagtttaaaaaaatgtgagacctatccccttaaagggaggaaggagagatcgcctgagccacacaactgaagttacacacactgaatagaattgactactgatatcaggagagagagggtatcagtgtctaagtggcattcccttgtgacaatcacatgtataacagaaaccatggattgctaaatatgaaggccccttatctgccttgcccgtggccacacatactaatgtaaatcaaagagatagtcctaaagacaaattacaatgacttcttccctgcattataaggaatagattaggcccatttttgtttcattttctctttttttcttattaatagatactattaggttctaatagaagtgtttgagagcataagaccaacactagtggtaatgtcataagcagtcagcttattcacaaatactcctttatataaagaatatggaacctatgtggtacttactgttacagtggatgttgggggtgggggtcaagtgggagcaggtgcattggtccattattgtagtttgtcaaaaagtcatcattatagctcctaagacatagctgttgtgtctgtcttcctgcagatataaatgagtgtgctgaaggtctttcttactgtggccactgctgtgtaaactctatgggatctttcacttgtgcctgccaaactggctttgagctgggagctgatagaaaacaatgttacagtaattggcaacagtcacagcccaggtaatgtgtggcattttacaggtattaaacatgagtaatacataagagaattacattgtgtgtcttgctaaagcaggagctcctgagaaggatgtggatggaggcttaaaaatccaacccctttattttataggtgagaaaacagaggcccagagtcaatggagaatggtttgcaaaataatctgtagtgtcattagcaaggattaagcctcaggttttctgacttggggctttgttgggttcatagatctttgtgaaaattctgccttcctttatcagttctgccatgcaatatttattgaacactaataactccattgtaaaactcaagagaaaggaaagagcaggagtgaaggaaccaccgtacaagaagcagctctaagctgcaataccatgcctcatgcattggatgttctaatgagaatcttccacattggccctccccctccctccctcatttcctttcattatgcctattgagcagctgcttcctgctttgtcttttcttccactgattcatttccctatcccttctcttcaaaacattcatgatccatatcatataaccttagcatcttcctccctaggctcagttatacaactaaatatatccctttttaggaacatattaaaatgttaatatgctgagcgattagctatagttgctattacaactatgttctcctcacacgtcatccccactggtccactacttaatctgtagatgagcacactttctactttactaagctttaatctatctgatacaaatttcctcaagttcaatgttttctacctcaacatttgccatcctcatccatctctacttctgtccttttctaaatggcagatttttttttcttatttttatggctgatttctccatctctgtctcagtacatcaagagacagaggtcttggtacatcaacaattcatttttcttcttcatcttcttcttcatcttcagactctatctttctctcagtgacttcttccttctttttccagttcacgactatactttaccaggtaaattttactatgttgaaaacataaccatgctaactggttttgctttaaattcaggatcataaatcttaaatgattaagcagcattggtggacaaacatactgtcagaatatgtctacttttaccctcatcaaaataagtgtttaacatctcttccaaaactttatatcaccctccttttgacctttgtcctcatctcatctcttaggtcatcaaataataaatgcaaactgtcatccaaggtaacaattaaaccaaagtctcccatagattcacatggaaaggcttcagtcctattaatatgaagcaggtagccctattactatcaaaggtcatcttctccatggagctttgggttccattctctcttcacatctgaagatctttgcttttgcaattatttccctcttttctgaattatcagttctttcttctgcatcattttcatcagcataacaacatggccaagtatcttctgtctttaaagtactttcacatgagtccatatttcataaaagctaatgtctgactctatagccaatgtctcctctttctcatcttgcattctctcatcagcccatactaatcaagttttcatctctactctgccacttgtcacccatgacctctatgctaccagattggatggtagcttcttcaattttatcctaattgacctctcagtagttttcaacacttctgactaccctcaagtcaggcaaagttcctgcctttatggaacttaaattcctacagaggagatagaaaacaggaaattaatcaaagaaatgtatactattatcttatatagtgttaatatgcaatgagaagatccaagaaaaaggagcagtaataactaagaccctaaggtagggctgagcttgatgtttcaggaaacagaaaaccagtgtgggctggaaaagaatgaacaaggtgtagagacagtcaatgagagcagtaggcagggaaagggaacaatcagattatactagacttggccatcgcaagcggtttgaattttattccaaatgtgacaagaaggcattgggtagttttgaacaaacaaaagagttcaagaagagcaaaagagttcttctcaaaacactcttcacttctgtgttactacatttttctagtatttctttccatctctggcccttctctcaatgtaaaatttatccaactgctctccttttaactacatatgaatataccaaactattccgcatcactacctgcatgactggtaggcatttcccacttggtagaaccaaaacagaaatgctgattttgagtccgagtcccaaagagccttttctcagttcttcacatattaatcaatcatccatttagtgacaaagtcaagaactcagtgacagaaaattaataagtgactgaactaggatttgacctagagtcttcctgcctcagatataatatcctttcagcttcatcatgtgtttatatacgttatgtctctttattagttttaatgaaggaacaaataaagatggtgatatataaaataaatatttaagctttcttacctgagctctttcatgaagagatattattagagtaactaaattcctcattcttccttccgacataaaattctatgtgtctttaattctacgctccttaaggtctgttggtatatttttattgcttaaagactacatttttgctacagtgatatttgccttttaaagagcaaactaaataagatgggagagaaatttgactactaattaagatacaacttcctctgaagtcaggcttttttttttaatgccctaaggagtcctttcaggccgagaaaagtgtggaaggatttttctttgccttaagtattttggctttaatgtgaccagaggtttaggggatgagtatattttacaagtgtatgaaattaaacctcttgtaatctgactggtgcttcctcagttatcaggaaagagggggtcattattgataagttaggaggtacatacaagttttctgtagaatttacttgggaaagaaatttgctctcaagttgaatacatttggtagaagtttatttttacatttattttccttctgtgaatatttggctaagctctttctgcagtcctcaccagacctatatttactaactgaaatacaaacctttcctagtgaaaactggtcttttgacttgtttcaaaacctatagatggaataagtccttttagaccatgatgtcatatatatatatatatatatatatatatatatatatatatatatatatttttttttttttttttttttgagacggagtctcccactgttgcccaggctggagtgtggtggtacaatctctgctcactgcaagctccgcctcccgggttcacgccattctcctgcctcagcctccagagtagctgggactacaggcacccaccaccacgcccggctaattatttgtatttttagaagagacggggttttactgtgttagccaggatggtctcgatctcctgaccttgtgatccacccgccttggcctcccaaagtgctgggattacagacgtgagccactgcgcccagccgagtatgatgatatttaacaatgaattatgtgcccatcatctaaagtacgttttgaaatgatgcttttttcttttttagagaacagtgttttatatttatgtagttttttctcaacaggtctcaaaacactttgcagtataaccattgaatcttcatagtgtactatgaattagctatcattgtcttataattagaaattggaaaatttgacatacagaacacttccttcaaattaccaagcaatatgtaatatagtttaactatttcacacatatttaatgtacatcttatctagcaagcaaacaatatatttgctacttataaaaatgttttaagtatgatttctaaagtactataataaaaacattttttatcatctgaatcaaagaatcaaaatctcagcttgcatctggtaggtagttatggatctgagtttgcactttttttagttccatatatctttaaagaagtgaccatggtatcatttatattcaaatccaattaccaccagcagtctaaagctgtattgatgcaatatcactggaaaagagcatgaataagagaagcctatgtaaaaattgtcaaatggatactttcacctctcttcccccctgaaaaaatcaattaatattagaaatttattatagttttcagtattttaaatataacctaatccagggatcaaaactctaacaccaacacaagacaggcaataaatataaatgtgtaagacaggctaagcataaaagataggaaattgtaaggactgttttgaactggagagggagttttgggcctagagaggacagctattgcttgattgcttgcctccagctaactgtcacctagagggagtgtgatgccagtgtactagacccactgatttattcaacaagtgcttactgaatacctaccatgtgctaggtgctgttcctaacactatagatacaatgataaacaagtcaggaaaagttcctgcctttatggaacttaaattcctatagaggagatagaaaacaggaaattaatcaaagaaatgtatactatcaccttatatagtgttaatatacaatgagaagatccaagaaaaaggagcagtaataactaagaccctaaggtagggctgagcttgatgttttaggaaacagaaaaccagtgtaggctggaaaagagtgaacaaggtgtagagacagtcaatgagagcagtaggcagggaaagggaagaatcagacttggccgtcgcaaggggtttggattttattccaaatgtgacgagaaggcattgggtagttttgaacaaacagtaatatcatatgattttcactgtttaaggactactgtggctactccctagggaatggacagtagggagtgtctgtaaaagcaagattagagtcattcaggtgagctgtggtggtggctttaattaagctagtagcagtagatttgagatttattttgtagacacagctgagatgaattcctaatgtggatgtgaggaaaagaaaaatcaagaataattcttggtttggggctttaggaaacaggtgaatccgaatgtcttttaccaaaatgtggagtccaatagaagaacaggtttggaggtgagatatagggtatgtttaaatcataacttctatttctgctgtgtgaagtttaaggagccaagtagaaataacatgtaggtagtttctatctatttcctaactaaatagaaaattctagaagtttatggtggtcagagcttgagtgagcagcttgtcaagatgtaaatgtcagtatttaagccatgagcaagaatggggtcacttacaaagggagggtgtctggaggagtaagcaggaggaaactgagactgtagactccaacattaagtaactaaaatgtgacacagagacaggaaagactgaagaagaatgtccagtaaggtttaaggacaacttggataatgtgattttctgaagaataaaataaaaaaaagttgggagaagtaaatggtcaatggtatcaagtgctgctaaggattaggcaatgtggcagtaaatggagaacaatgtggaatctagggagggttatcttgcctcttaatttattttttacttagacagtaaaattaacatgttcagtatataatcatatcaattttaattgtaaatatatagatttctgtaaccaccattggaatcatgattaagaatagttttgtcaaccccagaaaactccctggtgctacccttggcttgtcacttattccccgtctctaacctttgacatctacttgatgtgttctccctcactggaattttcttttcttgggaatgtcatataaatggaattaaactgtgtgtatccttttattcaacataatgccattaagattcagccaagttgttgctcatatgaagagttctattctttgatgagtatggatatactatagttggtttattattcaccctttgaaggacatttaagttgtttccaggttttggcaattatgaagagagctgctataaacatttgtatacaggtttttatatgaacatagttttaaaaaagatttttctcttcagtaaaaacctagggctggaatcacaaggtcatatgataggtgtatatttaagtttataagaaactcccaagctatcttttggaatggatgcaacatgggttattggctttaaaaaaaaaataggagacctttaatttgtgatgaaatggtggaaatcctaatattttcttaacttttgtaacaccttgataatcaaatcccatataactgcaggccactagtttccaaaccttagtgcaactcaatccctctgttaacagtgggaaaaatactgaggatcagagatttaaaataattgaagattacacagctgtaaagtgtcagatcttccaactttaaatgttgtgcctttttctattatgtcacactaacttttcttaggaaaaatattacaccacatttcagtgaaatagattacatgcttgtcaaattattttctctttttctttccttttttttttttttttttttttttgataggggcttgttctgtcacccaggctagagtgcaatggcaagatcacagcttactgtagccttgatctccccagctccagcaaccctcccacctctcagcttgctgagtagctgggactacaagaacgtgccaccacgcccaactaattttttatatttttttctagagacagggtttcactatattacccaagcttgtctcaaactcctgggctctagtgatctgcacaccttggcctcccaaagtgctgggattagaggtgtgagccaccaggcctagctattttctctttacaaatgatattatataggaaaacatctctgaattagaaagctttgattcttaccagccctgctaccttaggcaagtcttttatcttttctgaacctcagttttctgatcctaagcaaaaatcatgttacttttatgacttataatatttagattaataagcacatatgataccttgcataatatagactggcttttacaaccaacagtgccgtaaatgttattgaagtgatttcatgtcaattgaccttacttttctctctaagcaatgatggagattaatttgatagactctaagataccacatatggttcataaataggtaaaaatgtctctttataagaatggcaatagcaagcatatgtcagaaaaaaacttcaattctgtatcagaaagatctgtgtgtccctgtcaccacaaccagagacatcatttgaaataggtttctctgaagagtatatgttaatgtatcaagaaaaatatcagttcccttcactaatctttcctttagctttctaattttgcttagtcctaaactagctgtttctaaacccaaaggggttcttatttttaacaataaattgattagcataatccttcttttgtttattcaatcattggaaacctattttgaacatctgttatgagctggggagtgcaagatgatgatggcgcagtgggctgggcacaatgacagggatgtgccctgggtgcttgggagcatctgaggctgctctgtgccctggactggctgctggggagtaggccggatgatttctggaactgtagtggatgtctaggcagtttatatggtgacatatgctttcaaggagtgttacaatcccaaagactcttgtcttgtttttttttttttttttcctccagctttttttcttctaaatgattcataagttaagacttagaggaaatgaatcaatgtagacactctcagtaagagggggtgtgttcaaacaacataaataaagacccatagaccttctgtggtaaaaatggcattcagagtatctaaagtccatattttaacatggattctaaacatttttataattcttattttgtcacttagaaaatgagagactataatgcctgtgtgctcaggacaattggcattcatctgctgaggctcaggcccaccaatatgcctgaaattagtagcatgtaccagccaaattgattttcacagtaataatttgtttatgtaataagtgattctcgtataaatcaaagctcattagtgcatcaacatgaccctagttacatatgatcaactaaatcattgggtttatgtttacacctttgctccaaggttattttttaacagtattttcatgtgcttatagaccgtaaaaaggacgcataataacatactattagctcaagaacaggaatgtcagctagcaaacaacctatttgatttctgattattgatttaatatatatgtatatatattacatctattatatcctgaaaatactgagaattcccaaaacatgtttcctttaaggtaagtgtttaataaccagtggtgtattcatcattacctttctgtatcactcaacattatttatatgtttattagtatataatgtggtatataggcatttacaatgcttaataaccctcagacttttacttttatgtgtatagagtgttgatggatttctaataaagtttgtcatcctctcaacagagagaatgtgtccgttactgacatatattcaggtttgtctgttatgctaataatcctcttttgctcattttggaaagggattgaattggaaattgtcaatagctgtgaaaagaacaatagtgtttgttcccatcaccgtgaacatgaaattggtgctccccgttgttcctgtaaccatggacaccagcttgattctgatgagaaaacatgcataggtaatgtttggtaaatgccatttcattcaaaagttgctctggattcatttagccctttaatctgtagtacttacggctgtactgtgagccacatctctcaaactgtaaagacaaataaattgaagagtgtctctggctactgaataaatgtaaaagaagggttacctgtcagaagacaacattacatttagatatttaccttgaagttaaaggagatttaaaacactttaatgaaatatatgcccttaatagatttatttcaggaaaatattccatgatctatccaactatgtgatgtaatgtgtaattccaacaacaaatgctgtcacatacctcagttctctacctcaagcagaaacgaaattatttgcactggttttcaacttgataatgtttgggatgtatgttcaactttgatatgacaagtagctatattctaaaagacaacttaaaaaaattcattctttggaattcccagctcaaatccatttttaattgctaattttctcaacatattattggagtttatatcatttgagacaatgaagaaactaaaattccaccctagttttgcttcataatgaaacattcctgagaaaaaggagtatctactataaataggaatagcaagtatcaaactacattactatgtgccctggttctgagaacacttccaagtccctaaggcagtgatttgtcatcattcaagaattatgacaccttatttgcttgttttcttttgttatgcttaatatttcctccgttaaaaattacaatacaaaatcttttgaccatttcatactactcaatatggttagatagagacaatttgaagtatgaaaaactcaatggtttaaatatttaggacattttactttggcagtatgatgacacagaatgaaactcaagaaattttgcagtattctggttttataaattcaaaacaatgccattgtatttatttatgcaacattgctttcaatattgttctcagaatctacagtgggtaacatattgaagccagttgctttcctcacctcttattatttaatgaaaaatatgcttacttttatttcctaccttgataagatttgtaaccatagaaaaaattaagggctttcttccttgattgcttcttttttccctccctcttttccttccttctatctctctgtttgttcctcttttgagtattgataagagaaactggaattttgccaaactgtttctttgcgacttaaatttggtgttttctttattttttgaaaaataccattcagtaaagttcttatttacagctagaaaaaaatagcatctgccagggtcaaaatgtagaaaagtgcatatttatgaaatttcagccgtcagtatgacaatgttatattgtttatggttcaagttaatttcatttttccgacaagaaaaagaaaatgcaagccaagcactgagtctcatgcctgtaatcctggcacttttgggggctgaagtgggaggattgcttgagtccaggagtttgggaccagcctgagcaacttcaagagactccatctctataaaatatttaaaaaataaccaggcatggtggtgcactcccagctacttgggagactgaagtgagaggatcgctctagcccaggatattgaggctgcagtgagctatgattgtaccactgcactccagcctggatgacagggcaagaccctgtctcaaaaataagtaaataaataattcaatttcatttcatctaaaacattattttttaggctttttaaaagtttttcagatttttaaaaagtcttctcagataccaccaaagacttcgagcatatcggtctcaagatgccctgttctcaaatagcaaggagcaacattgcattacacaattggaaaacaagtccctcagtctatcatttagtgatccattttggattctttttctattaacattcctctggggctatttctagtttgtcccatgtataccatcctcatttggaactcatctgaaaccccgttcttcctacatcacaagcctttcttaaaatgtcttgccacttcaactgttaaatcacctgttttctaaatttcttttcaaattttattttgttagatctttgcttgctactgtaaataggaatagcaagtattaaactacgttactatgtgtcctgattctgaaaatacttccaagttcctaaagcagtgatttgtcatcattcaggaattatgataccttatttgcttgtttttgttatgcttaatatttcctcaatattctttaatatttccttttcttttgttatgcttaattttcccttttaattgtcctcatctctgatgatcatatttttcctaaattggccaatatgccaaatattttaccattgtacccaaattaatccatacataaaaatttagccttaatcaaaagtagaggaccaattgcagccaggcaaaacactgaaacatttcagctctgatttcagaaaagcatcaaaagtgaaaaacttgatcttctgtatctcttccccatacatagtcactgaataaggttaaataataaatattttctaataactggccaattgttaaatttagtgacttcattgctagtcagacacttgcattttatatacctgtctttcaaattgtgttaacacatctctaggttttagccctaataagtttttgcctttggataggtttaattaactatgtgctaactggctgacttatttttacattttttgtacattcgcatatatattttttcaaagttgatactaatatatgataaaaagaaaatcctttgatttccttcatgcatgactgttttttatgaagcagctgtgacattaatctgttctcagacaaataagtaaaatatgtatatgtacattccaagtgaataattgcctttacactagtgaataattggtctttagaaatgagtagttttttttgttttttgagacagggtctcgccctgtcacccaggctggagtgcaggtggtacaatcacggctcactgcaacctcgaacttctcagctcaagcaatcctcccacctcagtctcccaaagtgctgggattataggcgtgagctattatgcccagccttgaaaatgaatttttttaaaagttttttattctctacatcatactatttaatcagtaggattaataaaaggaaggtttaatactagaaaggaaaaaatatcatttagaattttgtgagtagttctgcttttgacattttgtgggaaaaagaatgttttatgtctaaatgaccttcatttagatattttatggtgacccttcaccttgattgattgtattttctttcctttctttcttttgtcttcattttcttgagttgataccctttccagggttaattgagacattgaccctttttatctgtggctgcttacgtagttatggcatagtaggattttgtaaactcagcactgacaggccatccaccttaacagctcaacaacagaggggcttgaattgaaccaaggcctagagccaaaaaaaaccctgaccaaataattcccaggtgttcggcctaaggaaagcagggcaaagtgtccgttgctacttccttggccaattatgttagaaatgatcgcctcaaaactcaggtgaaataggttatcctttggctgaaaacttacaatttgacatcttctggtgcgtttctattttccccagggcagttatatcttaataagaagcactcaggattgtagaattctgaaataacagtgctaaagaaggcttacagatccttacttagaaaactgctcacctaacaggacatttcagggtaatgatgtcacagatggaataaaaaaccccagacctcactcatcccagtcacagtataatctaaatattcaaacaaatgctctgaaatggtctataatttaaaacataatacttaaaataagtcttctgccctctctcagaactgtagttgccacttgtcttcccagtcaggcagttgggaacacttgcttgcgaacactctttgatctgaagttctggaagaacaaacatgttatggagtctaagactgtctcctctttgcagctgtcaaatgttcaccaaatggaattttttggctcttttttcttaggctgtttttttgttcttcaacttctctgtttattcagtccaattactgtttaaactagaaaaatagcagagatcacttttcctatgcctataaatgcatttggagattatttacattcttttaaaataaataacaggcatagaagaagcatgaagaaacataaaccaaaagtaggtctccttatttttgtgttaaggtttcttcgctgtttgtattacatggcctgagaaatagaaaatgattagtaaaacagttttaatttagaagtgtagcttatcagtgcttctatagggtcgttaaattcctatctctgcaataacagcagtgttctttcccccttcagatcttgacgaatgtgagaatggagaagcctgctgtgcccagctctgcatcaactatttaggaggctacaaatgcagatgtcaggaaggctttcagatcacttccaatggttgtgaatgtgatggtaaattcctgagatttaacaagtaataattgatgtgacagggcaataaaggaagagaaatgtctgaggcagagggctagggtgggcaagggaaggctttcacactaaagagacttgactttctatgtggttctaccatttactatcgtataataaacttggacgactttaactgcaatgaaccttagctgctcatcagtaaagtgatgacaataataggattagtggggaaattaaggaaagtaataaatgtaaagtgcctagtgcaatggctgacatagaaaaataactaaaagtagctattattgttatcatatttattggtccataatcactttcacacaatttaatgtatattaaaggcaaatgagagattctgaaaggcacactgtcaaaggaaccacccatggcaaacttgactggaatgagaaagctggttactggaagacattttgaatgagttttttttgtttgtttgtttgtttttttttttagttagagagcaaaaggaccatcagttcacaagccacagtctaaatctgtaccagaatcccatacatatctgatattaatatagctaatgcaagttttaaaatgagtcatttacaatttcttaacttacatgttaaaattagttcacttacctttcaggtgattttttgcttgtatatatttttttttgatataagagtttgaatttagtgagtagagcttgttgactttgtttatacagttaggaatagctcatataaccattgctgtaatttaaaagtttaccttaaatatttaatctttaaattttcatttagtattattattaccattattttgaaccaaatttttcttaacatcaaagattagaagattgatatctattctaataacaatcaacttatataagactgtaatgcctcagagaaattagtttttctttgcttaaagaaacacatttcagaattctgtcaaagatgatagatagccaagctcccccaaccttgcaatgaagataacagcaatgaacacacaactatgatatctatatatactaaacacggtagcgtatattgccatttaccacattacatccaattaacagagccaaaaacatttttaaaatttcatgtaccatctgctcttaagcagaatgagccaagagatgattgtatggcatgaacatacatacttgcatacacgcatgcaaatggaaaaggcatcaacaatctgaggtaaagcttagaagctcatacatgaacttatagtattgtgaacatattgaccaaagtctggactcagacttggtcataaactagtaagttgcatgcaatcaaggcctaaaattctttcttctctaaaattgtccacaaagcttgtactgacttgtacctagaataagttttctatcatatatattgaataattcgagagtgaatgaacattctacaaaagggtacacagcctgagaccactgaattaattaattatttaattatttatttatttatttttgagaaggagtctcgctctgtcgccctggctggagtgcagtggcgggatctcggctcactgcaagctccgcctcctgggttcacgccattctcctgcctcagcctcccaagtagctgggactacaggcacctgctaccacgcccggctaattttttgtattttttagtagagacggggtttcaccgtgttagccaggatggtctcgatctcctgacctcgtgatctgcccgcctcggcctcccaaagtgctgggattacaggcgtgagccaccacacccggcctgaatttattttaagtttttcatctaaacctcacaaacaaggtctcagaaataccttgtctgtgtagatgaagtagagtaaacttgaaaatgagtgaaataaaaataattggccaagtgtacttgagaaagaatgtgggggctatgcttgctttctatgtggcagtacattgttattgtttaataaaggtcacaagaggaacaccaatatgtctattatttcataagatctatcttatctctcaatgcctaaaagcagatattgtttaaattttcttagatgtggatgagtgtctggatgtcagtatagtctgtgaccaactacattaattctgtgggaacatacgaatgtagttgtgaagaaggctacagaattggaaatgacagaaaaacttacccctgtaagtcactgaagaattttattgtattaatatattttctaaactacttccagcctcatcttgttcttcaggagcaatggaggccacatatttcttaactcaacctgccttcccctttctgtcttcacagactaagatctttccttattttcttttgttctctctgctacagttttaactttgtgctggcagcttctcaccttcatttacaatagacttttgaaatggccatctcaaagcattttacctttctgttaccccctgccttggctgtctagttcaaactctctcatttctctatcaacctttgcacagtacttccttcttttaaccaagttgaaacctcgcattttcttctatggccttagctttagatgatgatgagctagaggaagaagaagaggaatgagaagttgtgaggtttccaggtcttctattcaagagcccacctcaacagcttcattatgttgctacttttctgcctcccacctacaaagatgaagaagatgaggaggaagaggaaaaagatattcatagagaactgactgctttgcacaattttggtgtgtaaaagaatttaccttactatacttacttctatttttagataatttactacatttttgtagacaattttactatcaatatttaatgccatcatatgttttaacatgaagtttgcaagaaaagtagggccaaagtcacttcttcagagcttcctatgaaatccatcatcttttgtcttttttatttccttttgtacaataaaggagtgctgtgtaggtacttgtagaagtgggagtgcagtgtggaggggtgttcttgaagttaatacagggaaatggagcagaaaaatatctttaaattagcataatggggagaaagattgaaatcttataattctattaaaatttcactagaaatcaccttagatagttaaaatttaccttaaatagccctaaaatgtagttcctttctaggttttaaaatgcagagaactaattggttaatatgcttaaatggaccagaaaatcttcaaaatgtgagcagtttttcttatatatctaaacaacagaactcaagcgtcgacttctgatcaaagtaaatctctatcaaaagtaactgtttgcagccagtccactgcttcttttttttcctttgtaaaacagagctgttctttttattctccctctatttattgtattttaacaatatcaaagcttgatgattgctttagaatgtattcagaaaaatagaaatatttttacgcagtggtcaaatcataatatcatcaataagtgtctctatataaaaatagaagtactttaatgtttcttaattaaactcctgatgctttggctaatcaaagtcagaagagaaatagttgggggcggcaacaacaacagtcagaacttgagttgccaagatctgcaaagaagagaagaccagacaaggaggatggtctcagatgcttttctcctcaagccatttgccaattaatgggttgtgccaggaatctgaaagatagctgctaggagcttgaagagtgaagcacatttatcagcagtttcatgatgttggggaggcagaacatggagctcaggcctgccaaaggagagaagccttggtaaatatgccaagttttcaattagggcatcttaaagtccctaccctagaaacagggacaaaagttaaaatggaatgagccttaaacaactgaatacacatctctccacctttattctatatgataatttccctcaaaaacagaatggataaataaatacattgtggtacattaatacaatggaatactgtataaccataaaaaataaactctcgcatacacaatgtgtatgatctcacatacattatattgaatgaaagaagcttgacaccaaagagtacatacttttcaattctacctataaaaagttcaaaaaagggaaaataatctgtggtgatagagatcaccacgatgcttaatttatgaaattaatgattgaaaattattaagtcacttttgagattttggattgctagtaatattatgtaccttgatctgggtggcatttacatgagttatttacaatgtgaaaagaagtttgaagtatacagtttagatttgtgtacacttctctgtgtattaaattttaataaaaagatttactcagaaaacaaaaatacacataaaaaattctgaaagaaaaagcatcaaaatttcaggaacattgaattttttttggtctcaaatcaatgataatttcttttttaaaaaagaaattcctaaagattctaagtattcttagggacaatattctaatgtaataattggaaaaagtaaaataagctttattttaaaagctatatcttgctgttgtcctttttaaagattctttaggaactatgctcaaagatctttttttttttttttttttaggaaattaagggttttattttgatttttggttacgtagtcaattatggacgaactaagatggtatcacattacagtctgtttagatcacatctttggacacaattgcagcttgagctgcaaggactgcatgaatggaggaaagtgccaggaaggaaagagtgaatgctcctgcccagcaggttgccgtgtcattctttgtaatgaaagtaagtgacaccctgagaattgggtaagtgctccaaactactcctttacatatgttctccccaaaatgttttaataaagtaagcaattgataagtatgagaagacaatttatttgttgggcataaataatgcttatgaagtgctttaagttttaaactgaatatgtgatttaaaaaggagattttatgttccctaggaaactcaacatgctgtctcttgtttatccatggaatgtaaaagttaataaaggatcctaatattctaggcctataaaaatccctccatttaaataaatcattaggccctgacaagctattcccaatgaagaaaaaaggaaaggatttgtgctacaaagtgcaatttaaatggacttgcttgactgtttgctacttggttttgtgtacttttttgttctttttctttttaaaaacatgtaaacacagccaatgacactggtttaatttttttattcaagtctctcatgagtaagttcaaagatttaaaaatgatactgcccaaaattcctttcctctatattttaaatgaaggtatgctttcaggagttcaaacttccaagtgataaaatgtattgactatctttgtttcttctttctctttttaaattcattttatgagttctatttatataagtgttttgtcttagtttttgtgattggcttggaagatgatatgaacagattttcttttgaactctctacatatgggaggaacacagctgttgttactcttatatgatatagatgcaaaacttcagtcataacatagtgaaatggtttaaccaagattactagttagggttttgaggatcttcctcatgcatccctctgatcatgtttctctgctgctgaaaagctttgtgcctttcccttcacataaagtgtatacatcttacccagtcactagtggccatcagactctcataaatccttttggctttttgtcctagtcttaacgcttcacctaacctattatttcccgcatactaaaccactcactacttaatgtgctgcatttttcatctttgtgccttttgctaaactgtcatccttgaaggcctatttctgcctattgcatgaagctttatttgatggcctcagtctaacacagctatttatgtttttggtggattaaaaaaaaattctctctctctacattggattattttctatcttctttactagactgagagcttgctggccaggtcctattcatgcttattcattgtgaatttctccacactggaggtatccagtgcatgaatgaacacatgaataaaacttggtgttgaaactcccagctatattgacctgcaacttggcacactcaaatacataaaattgggatcaaataaatattattgcatgaccactagtaagtcaatatttaccttatattgtaagttttattgataaatatgcatctcccaatacttatccctaacatagtaaaaaaactaaaaaatctatctcaaacaaataagaataaaataaataaaaatttaaaaataaaaaataaaaatataaaaaatattttacacactagtaaatttaaaaactaaaaaataaaataatgaaaaaatctgtctctaacacgtaagaataaaatatctctgacataaaattaataccaaaatattgaaaatgagcttgctgataaaatagaaatgagatggcatcttctttggctttagaaaaccttggggatctctcaaatatttatatgttgcaataaaggggagtctacccctgaaagcagaacttctatcttctttgtactttctctatatccttctcttatttcttttacaacaatgaaaacagaacaatctatttaggagaaacaaaaaacaattgttcatatttttttaacaaaaagaaggagtgggaatattttctttaaaatccctattggccaggggtgctggctcatgcctgtaatctcaacactctgagaggctgaggcaggaagatcgcttgaggccaggagtttgagaccagcctgggcaacatagcaagtcctagtctctacaaaaataataataataagaagaagaataagaataaatccctttaaactacaataagcagagaccagttattcattggctatatttttaagattgccagcttttcaaatgcagcaaaataaatgaaaaaagaactttcaacagggatctagaagtcagttttcccgttgagtagatcttctagcccaatacatttattagtctataatgaaaatatctactttgatttcttagaggtttcttcaaataaatatattgaaacaattttaaaatgaccacatattatttaattttaaaagcacacttttagaaccccatttcttatgaaaggtttcatatcgagatcatttgttattgtgagactgtatctggtggaaaggaaagataggagtatttttcatatgtcaaatgagtagactaaaacatgggaggagagatttatgactttttttttacatcatccagctatggtttgggacgtgtttgttttacatttttcttccccagaatctctacactgtttgatctaatgaagtatttggcaaatctatagactatatgataatcacagtttactttgtgagggagtgtcaaattatagtgtcggtttgtctatattgatgactcgccataatccagacgctgtgcaagccatttaaacttccttagcttcattttacaggttaagtgtttaaaaattgccccttctgtagttgctgttaaaatgcaaacattaacaaaatgtaaattaataatataggccacaacaaatgcttgttgccagtctctcattttttgtttatcctttccttttttccctttcatagtaacctatggcttgaaagcaaagaaaagggtgaataagaagccaagttccatattagcatctggaatgggagcaggggatgaatggagcagattttataaatgtaattttataacatttagcctattatgataaaatgtcaattacagttattactgaaattatctcaacagctacatttgcttacattacaatataaagtcaccgacatttttcccaatttattgttttatagagcactaaacacaaaaataccaacaacctaatgaaaactgttgtttgcctgactttgtcttatctttggcaatgcaaactaccttgggacccccatgagaaccttagctgcattcattcctggttaaaaatacatgacattttaaaagcatttttccctcagttttcaaaatagaagatgcagtttgtttctcgttagggttggaattgtacagcaaagttgtctgggtagcttttaaagtgtgagggttagagtttaagaaatgagataaattttgcatttgaaacttgttagcaatttcttcagtcatcattattttaactagctgtatcagtaatcccctcgggagtgattatgctatacaaactaggaacatgccagaaaattttcctgggtctgtaagccactgagtttttaattacttggtatctatcctgatagaaagagaagctattttttccctccatttgtatcagaacacgtatgttccattgcttgttcatcttctctagtttcttcatagcttattccccagagaccagtgagaaagaatgtggcagcatcggtaattgtcagaatggaggcatctgtgatcttctgactgggcactgccagagccccccaggggttcatgggaaaacttgtgaagatagaaggaatgtctggtgcc

SEQ ID NO: 242 - DNA, 2374 bp, Homo sapiens
aacctgaatatccttggatctgtaagactttttctgatccatatcacagcctttttctctcctcaccgttgccagtgggatttctcgtgggcttttggagaggtagaaggcatacttgtgaatgtcaaaagagctgtattcctgtatcctgtttcaaccctgaggagaggcactgtgctagtgaggaaagaacacccaatcctagtcaaaggactgagttcaattcagcctcacaagaggctctaagtatgatcttagacaaggaaacttcaggccccagttttcccatctagaaaatgagagtggttagaactatatcacactgaggattatgtgaatttatatatacgtatataaagccgtgcacccaaatgctgtttacagcattctgtgatgaattccctatttcagttggtaccatttattcacagacaatcacaggtattcagagattgtaagaattatggtagcaattgcttactatagtttgtttattccataagagtggctttcatttttttttaaaaaagagacctctcccttggattttcgttataatatgtttcacttgccacattttctgaatttttccatgtcttgaagcctttgtgatggtgtttcataatcaacctgcaggttgtcagaatcagtggagcatgccatttactgcttgtcttagatacactcaatgattctttctttcctgagtgcttcaagttttggctttaaagatcctcctttgttttaatagattttccattagtgtctgcttatgtaattttatctccatttctaattgtgaaatttgttgcatagatgtaaattttctttcagtattattcagagagaagataatggttgatacccaaaagaggaagctaaaaatgccttttaaaattcttactatattttggtgatttttaccaatgacattattgtatagttgtggtcattataccgttcattaaaaatatttatttgaaattactgcatgaatgccaatctctgaataacatctttgcaaatatagcatgttattttgtcagtccaaatgtgtgctaaatactaattcatgttgttaaatgtggatataaaaatagttaattctcttgctaaggatactcatttatcaaagtaaagtaacattttaatatttttcaagacaactatttttaaatatttattagagaaactgttctaggagaaaaattaagataaggtattatgtattttactctgttatggacacatacatatttggatatcagatagtttcatatcaaattacatatctttgtactcaataaatattagaaaaactgtttactcatctgtaaaatataaataatagcatcttctcattgagttactttgaaaataaataaaaataatacctatgtacaggacttaacctagtgtctaccataatgtaagcacataatgaatacttgatactgtgattgagtacatgctatgactataacccagaataagacaataggaacataaaaatagaaatgatcatcattttagataggggaaaacagaagggaaatacagagaaatgacatcattgtgtttgagaccatatggtatcagaattggaatagaaggaaactggagttgggggagggaactggaagagtgttgggggtttgggaatgaagaggtgatactaagttgtgtttgggaatatattggatttaaagtgatagaaagtaattgtagtgaagatggactgtagtcatctcatgaattggaccagaactttaacattgttcatttagttttccaagagatatttactgtgggccgatactatgtgctagatactgtgcattggtacagtaaccaaggtacagtaaaccaaggatggaaatacataaatttgtgagtcggttttctgagtgaaagttagaaataaggaacaatgtactaggcatgaagtgttggttagtgattacaaataggagaggagaaaagaaaagtccccaatgacacaagactagaggctgaagacatatcaagagagtgctgcacgaggggagaagacaactttaagacattgtgatttccagaagaatcacttttatataaattgaatgctttctagagcttaagatcattcttatatgtttcagtaacagaaaatgaagataaagatagattattcttggctttttacctatttacacatgaaaatgattacatacatctacttattctagtgtgatattattttcattaaaataaaggtattgaaggaattgttcaatgaacaaagaaaactgtacttttgactaaattgtaattaagtatgcttgaacatttttaaatgcttagttctgtaattttctgcacaacatgtagtaaa

SEQ ID NO: 243 - DNA, 2514 bp, Homo sapiens
gccagccactatattttcatggaaagaaaacatattgagactcccacaaagtaaacttctttggatgccatgagtgtaaaatcttgatttgagcttcatttcatagccatggtggcaaatcaaattgttaaatatatttgtgagtctataattatggagaaagtcattgtctcataatatattccaaaaatgtttaaatatttgtttgtcctcttcttttttcagtgtctcatagtctttctcttttaccatgcccatttatttcttgacatcaccattcatgaaccttcccaacatggttttaagttcaagcttcttgttttttctgctttggtaggatcttgctataccattctcttgcccttcgaagcacaataaagccaataatagagacatcttcttgtatcagcattttggaatcaatattttcataggtcttttacagttaaatcagctcttggataaagtggaactttaagaaagtctggactttaaaatgactatattctggtaatcacaaagtcataaaacagagcatttcagtgacgatgggtcatgttttttcagtcttaatttagaatttttttcaactgactttgagttgctgttacaattcaacctgcctctggtgttttatatgccttaaaatttgtggctactgtataataaccaggaaagcgtagctacagggttccaattactttggcaaaggagccttattacattgtctccaactaagcacataattaatgtctctatttcaaggctatttcagcaaattcaaaacccagaatctatccatacatatttagggatgcatgggaacacttgtgatgtcttcattgcagcagacagtaataccagaggaatttttggaagaatatggaatactttatcatgggttgcaaatattttaaagatgtggtttgaaattaaacatgttgttctaaaaagtctccatgggaatagaatgtaatagaattacccacctcctgggagagtttttttatgggtgagacattttcagattgttacaacgtctgagcaggcattatatggcaagagagcacataggagatacatatctgtctacagtgcgtagggcatttgcaccttgagtatcctgctggacagttatgtaggtaaaaagcctgtttgtaatcatctgaacttaagcttatctccattttgcaaataaacacaaagtatttttgcacaatcttaatactcactgaattttgcagaaatgcagctaccatatacatgaagagaatattgtggttagttttgttcggaactttaccaagaattggtcaccatttcaaaaaaaaatcacaccattgatggcagcacagcttgtggcatttgagttgccaataaaacatgcccatattattatacatttgcagcagttgcagttgcgaggattctgcatttaggtgccaccatccaacaatttaattatattttgtaatcaagcagatcatgcccaaacatttacctatagaaatacatttttgtcatgaattcctcttcttatttttccccttatattatgggggagttggcattttgtatttaggcaaattattttattcattaatttcttttcagaatactagagggacatttaattatattatcaaaggagagttaggtgagataagatcaagaacaattctgaaatatatcactcctccaagaaaaagggggatgtggtgcctgcgcacacatgtgcccttcaatgcgaagaaagaagcaggaaacggagatgggagaattggccttgatttcagctcttattgagtgtcaggccctgtgcccagcctttcaaatgcatgatctcattttttgtgcatagtgctgagaaatgccatgtgtgctttgaatcctgtagccccagagtgccacactgggagctgactgcttgacattcggagatcagagaatgagaggaaatgagtatatgaatattcttgacattgctggagtgttagaattatttaaaagttctgttaaataagtgacagtctcagagcctgatgtatggtagttaatgaaattttcacaaagaagtattatcataaaattcgaagaaaatcatagtagctgcgcacacaaattcacatgcatatgaatgtcagtgcacgttggtgcattcatgcttcctatttatagctttcgggacacatccgaaagtgataaatgaacattgaaatgctacacatatgtttatatccacttttagctatggggttgtctcaaaatgtggtatctccactgagccaaatcccaggcatttagaaagtacgaaaaatttaaaactttaaagtgaaccaaagaggagagagaaaaaaaaaaaaatcctaaaactgagagatatggcaatcataaacctggcaccaaattactttttaaagtacagtatgaaaaatgaaatgtgtcagaattggttactaatacttctttgttggctaattgtcatttttcaagtgttggctaattgtcattttt

SEQ ID NO: 244 - DNA, 12559 bp, Homo sapiens
ccaacaattttttttaataacagtaaaaacaagaaattcgaagccctggagagggcctataagaaaagcaagaagtcaggcacagtggctcacacctgtaaccccagcactttgtgagggcaatgcaggaagatcacatgaaatcagtagttagaccagcctgggcaacaaagtgagactgtcactacaaaaatttttgtctaaattaacctggcatagtggcatgtgctggtagtcctagatacttgggaggctgaagcaggaggattgcgtgagcccagatgttcaaggctgcagtgagctatgatctggccactgtacaccagtgtgggcgacagcgcaatatgttgtgacacatgcaccaaaaaaaagagaagcaagaaagaacgtaggaagaaatcaatcttgttcacccagaaattctccaaagaactcagattttttactctgtgtttttaaatattgagaaaatggaaggcatgtaactaacagcatatttttaacagtttaaaaaaccacagtcatcaagagtaatttcagatgagctgaaaaccagataaaccacaacattcccctgtccccaaaaaggacttttttaaattacaggaatagaaaagaaataatcctacttgttggtggtcagtattgttacagtaacaccaagagatcagagctatgaaaatcctaacctcttcctaattttccatcaaaaagcctgattttccaccacagaatgcaaatgaaaaccacaatgatatttcatctcacactagtcagaatggctagtattgaaaagtcaaaaacaacagatgctggtgaggctgtggagaaaacggacaacttatatcctgttagtgggaaggtaaattagttcaactactttggaaagcagtttagagatttcttaaagaacttaaagcagaaaactaccatttgacccagcaataccattactggctatatacccaaaggaaaatagatcattacaccaaaaagacatatgtactcctgtgttcattgctgcactattcacaacagcaaaaatatggagtcaactagctgcccatcaatggtggatcggataaagaaaatgtggaggctaggtatggtggctcatgcctgtaatcccagcactttgggaggccaaggcaggtgaatcatgaggtcaggagttcgagaccagcctggccaacatggtgaaagcccgtctctactaaaaatacaaaaaattagccgggccttgtggtgggcacctgtaatcctagctactcgggaggctgagacaggagaatcgcttgaacccagcaggcagaagttgcagtgagccgagatcgcaccattgcactccagcctgggtgacagtgtgagactccatctcaaaagaaagaaagaaaatgtggaacatatacaccacggaatactacacagtcataaaaaagaatgaaattggggtcacagtggagcaggctctcatgtggaggtggggaagtttggtccatcagaatgatcaccaagaaacacaaagcagacctgggccctgggctcccagagaagaaaaagaagaagaaagtggtcaaagaaccagagactcaatactcaattttaaacaatgatgattactttgccaatgtttctcctataagagccacatccccctctaagagtgtggtccatgggaaggcacctgagatgcctctagtgaagaaaacaagtaaaagaagggtgtcagcaccctttgtgaggagcacgtagaacctgacaccacgctgcgtgccagacggtcagagaagtcacccaatcccaggaagcaggtgcttggccatttggagttcctctgtggggagaagaaaaagaagaagtcacctccagccatgtcccatgcctctggggtgaaaacctccccagaccccagacagggtgaagaggaaaccagagttggcaagaagctcaaataacacaagaaggaaacaaagggggcccaggaccccacagccctctcagtccagaacccttggttctgcgaggctggggatgctgcggacacttgctcagtggggaagaagggtgaggaacaggcagccttggggcagataacggaagcagaagagccccagggagcacagtgggaaggtgaagaagaagaaaacaaaaatccaccaggagggagatgccctcccaggccactccaagcccttcaggtccatggagagcagccctaggaaaggaagtaaaacgaagccaaagttgaggctccggaatacatccatccccaaaggagatggccctaaggcccccgagaagaaaaagatgaagtccaagaaggtagagcagccaatcattgaggagccggctctgaaaaggaagaaaaagaacaagaggaaagagagtggggcagcaagagacccttggaaggaggaaacagagacggacttagaggtggtgttggaaaagaaaggcaacatggacgaggcgcacatagaccaggtgaggcgaaaggccttgcaaggagagatcgatcgagagtcaggcaaaacggaagcttgtgaaaccaggaagtggacgggaacctagtttggccagtgggatactgctggttttgacaacgaggaacagaaactgaagtttctcaaacttactggtggcttcaaaaacctgtccccttcgttcagccgccaccccctccaagccccgcagcacgattgcaaggtccaacatagccctcagcaagaaggcggccgacagcctgcagcagaacctgcagcagaacctgcagcaggactgtgaccgggccatgagctggaagtacagccgcggagcccgtctctgcttctccaccgcccccaacaagatcttttatattcataggaacgcttccaagttagccaagctggaagattaaactctagagttttgtcccctcaaaactgccacaattgctttgattatcccatttatgctggagattacaagttttttttggtgaaaaatcagatcttggtgatgaccttgagcagtaggatataaataactcccataaacttagcgttccaataatggaacactaggcataagtgggttattcagttgtgctgatgaaagccatctgacagttggctcacattgaacacctgtggagactaaggacaaggacaaggacaactatcttgatgggcttggatgaactggggagaggcagctcatgtttggggagccaggagaacaagtgagtggctaaaacctcctgttttctgtgttaaacattccgtccctgtttgagacatcaatgtgtacagatgacctttgttgagtgtttagcaggtgctaggcacatactagtgttttccttaatgtatttaatcttcataattatgaaatgggtgctattattatccgcatcttatagatgaggcaaaggaagttcagggataaagtaataaaatgccctgggatcacccaaccactaaaaacaaacaaacaaaagaatgaaatcatgtcctttgtcccaacatggatgaaactggaggccaaagtcctaagcaaattagtacaggaacaaaaaaacaaataccagatgttcttacttataagtggatgctaaatgttgagtacccacggtcgtaaacatgggaacaatagacactgcagactactagaggggaggggaaggagaagggcgtaggtcaaaaaactacctactgggtactgtgatgactaccagagtgtaatacccatgtaacaaatctgtacatgtaccccctctatctaaaataaaacttggggaaaaaaagcatgattttcttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcgttgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagtcctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatgatagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgactttctcttttcctaattgaataccctttatttccttcttctgcctgattgccctggccagaacttccaacactatgttgaataggagcggtgagagagggcatccctgtcttgtgccagttttcaaagggaatgcttccagtttttgcccattcagtatgatattggcggtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatccatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgagtttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctggagatgtctattaggtctgcttggtgcagagctgagttcaattcctgggtatctttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcatcagttgatgcagtttcttcctagtctcgatggtctttacattttggcatgattttgcagcggctggtaccggttgttcctttccatgtttagcgcttccttcaagagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggttcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagctgcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgctttggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctcccatgattttctttttttaaactaaaagggatttttaaaaatatgattaagaaacagtgaaaatatgagatgggaaaattgttggctattaataagttcatatttttgcatctagctttgtatcataaggtatcaaagtatttgaagatgaaactgaagaactttcattaatagtttctcataatattttagcttttatttatgtacaggagtatgataaattttaaaaaatcttgaaaaaatgtgatgaatgccaaatgaccagagagagaaaaaatatcctgagtgccaaaaaggagtaaaataggaggccctgggctttgtatattgataagctcaataacaattcctagaaatattctagatagaatattaagcaaatgatttataataaatttgagggccaggcacagtggctcatgcctgtaatcccagcactttgggaagccaaggcgagtggatcacttcaggtcaggagttcaagaccagcctgaccaacatggtgaagccccatctctactaaaaatgcaaaattagccaggcatggtggtgcacgcctggagtcccagttacttgggaggctgaggcaggagaatcgcttgaacccaggaggtggactttgcagtgagctgagattgcgccattgcactccagcctaggcaacaagagcgaaactctgtctcaaaaaaaaaaaaaaaaagggaaagaacaactatcattcctagaaaataacataagttcatcaagagtaaaaaaattacattaaataatgcttatttcttattttgataggttaaccagattgctacatcaggggaatagagtagataaaatgtcttgatttcagcaaagcactgataagtgctttataatatctttgagggaaacaaagagaaattcaggtaagatgatagtcgtgggagaagaggtacctgataggggtgctccaaagtcaagatatggtgtttgtaaagaaattcggaagataagggtaaaacattaggaggttcttgtttagggagtgggtagttcatgctaggaataaatgaatcaagattaccatagtaatatgtaaatgtaacaaatataaagactttccagaaatccaagtgagcaaaatctattcattttcatttaagttcaatttgaatcaatggcgtcatttagttcttttaaaaaaaatgcaactttagattgaatactcccatttcaaagaaagagtagtaatagacaaaaacacatctttacggcttttgttacttggtcaaatatatcctgaataccttgtaacgtgcagaaaacatctgtggctgcttacataatatatgcggtacaagtggataaaaataagcaaaagtttgtcttcccatttaactgaaagccctgatgaggacacagactatgcctgagttcccagttcctggtacaatgtctgtaaatatttgtgattgatataatacagtgaaagtaagataatgatagaacagtgcaaagaaattgggaatgaagttaatccataaaaatgtataccagaaggatctgggacactattactatttgtaatgtgggtcccaaattcacctttgagcctcttggcatccaaggcaaggaaacaaatatgttaaaagatcacagtctccgaaacctaaaacttcatcccttttgccagaagcaacgtgttaatagatttttcttgcaataaaatcctgagagaaatttctcacaggatgcctcattgagcaaatacaatgtgaaatagggagaaattcttaaaatacggtaagctggttaaatgctttttactcctagttaaagtaattcctttagggaccaaagaagtagggtccaagtacacagattgccagtggtcagctttgctccaggccctgtggtgtggtaggaaaagtacaacaaattaagtgattgcatatacttgagacagtcttttttgaaaccaaacttttgctgtagctgggcagtatccagtttgaatctgtattccccagcaagaatggacaatgcagatatttactgttggtgattaaatgccaattcttttgcttacactgaagaatgagaatgagtctcagtcccactttgagggatgtaacaacaaactgggcaaacgtaaagaacagtgacaaggagaatgacacgtcaggacataatttcatatacaaagtaggcagcaaactgggctcggtatattgaatctgaagaccaacagggaagtcatgataaaaccaacctcaaacatctgaagaactctcttagggaggaaggagcacacgtcttctgtggtccagatcctgaccaaggagtaaaggtcccagacaaggagagcgaactcaggagaaaatcaatttccaacggtagagctgtctgtaacagggctatgccgccgtaaaatgatgggagggtcctggatgctggaggggtttagagagacactgcacaactgtctatcagtgatgtttcaaaaataatccctgtcctcaaagggagactgaatcagaaatccttctggccacacgaatttcctgatcctgaggtgagaaggcatgctccatgtctgtctacgcggagtccactgactgctctgagggaaacctcttgaactgtttatgggttctgttgccatctcctagcttttttacattagccatagtcctttaaagaaatactctaagcaagcagaaaccacagtttcccataccctccaatt

SEQ ID NO: 245 - DNA, 8300 bp, Homo sapiens
tggattacaagagtttaacacattttctaagacaccaagtgagtaatgtagatactgaggagatattcagtagaaaaagccaaatcactaataatagcatattttcaatatacaggcaatttctcagttgaaaagcttagctattattgctatggccatggcttcaaagctgtgaggttcgctttttatttatattggcaattttcccatgtgcttataaaaatcagtcctttggatggttcactcagtgtatttgaataccttttccaattctctgaagctccttgatccagtaacagtttctttccttggcagaccatgaggagtgggaaagtagctttttctaagtaggcattgattggcattgagcagtgggaaagattggagctggtgaacatggggtgtgcaaatgtattcagccaacaggagctcttccagttcatagggtggatctgctggaatagttgccttggttctcctttcacttcagggtggaattaagctcctggctcaatagggaggaagcaggataagtcttagcctctggacacttaacctaaaattctaaagaaaaattccttattccttttttccttttcaatggcttacctttaaacagcattaatatcctgcctgttgtactgaagcaagaaactgtagtatctattttcaaaactagtacatggattttcaatgtgagtgtcttggtaataaatgctggtttattttgaatttaaaaatgtattttgattttgtactgacagtttaactctttgaaatataacggaggaagggtcagaaataaagcaatctttctttcttctggacttatttattcactcttctttaaacagttgttaaatctctcttatgcatttgacattgggctttgcactagtgatagaaaaatgaataagactgtgacatcttttggtactacatcatataaattgtctagattgtacttctaagccagcatgagcattttagaatataagaaatagaaaccaaaccaagaaactctagttcggagcaaaattatatgcccagttgtctaagaaagggctttgctttttaccagtaatttagaattttatgactaagacaaagcagaaaattgggaagaacagtgaaaagggcaagaagttaatggagtgcggtcagagctgagaggacaaaatctaaatgaaagggggaaaagcaataaggattgaggaaggttgtttaggtcattaagcttacaagatcttctatttcccaattagtacattctgaccctgaagacgtttaagtacatgacgaggatgtcactggagtgtgacaaattcttcacattctcacttccctttgctaattctggcgtcagaagttattgcagagaacatagtcaaccgtctgtggagatacatctaaaacagatgtgcctattgttaaacaaacatggtatgtttaaatccatatttatttattaaacaaaaattagataattactccgattatctggtacccacagggatcatacaaatgacaaacacaaagggccagcactctgagaatgagaagcctagagagaggccaggctgggatagtgccaaccctgacataagatagaatataattaggactttaaaggaaatacaaacaaatattgtgggcactcaggaagaaaagcacttttggtggttgtggatacaggtagagggagaaagcacaaacaactcagagaaactttcttgaaggagatagtatgctaactggccatggaaaattgtttgaatatcaacaagtgatgggatctcaacagggataaaggatacaggtgtcataggtaaggtagtggcataagcaaagccatgaaggaggacagcttgtttgatgactagcagtgtgtgttataggagatggggtggaggatgcagagaaacaatgtattttgagaccacacaactatgcctttaaatcccagcccttccgcttatgcatacgggaccatgcctaggttgcttaacctttctaaatctcagattactcatctttaatatggggacaataatattgatttttgcatttgtgtgtgtgtgtgtgtgtgtgtgtgtgtgtgtgtgtctgggagagagagaaaggagagagagaggagagaaagactggttataatctatgtaaaccttctggtgctcaataaatggtagtaattattatggcaagtagttaggctatctcaattttggacaatgtgttagataaaataaaaaaaataatttgtgatcaaattttgggtgatcttaaggagctagtttaggaatatggagttactttgataggcattggaaagccattgaagacttttgaccagggaatgatgtgattagggcttagaattgcagtgctgattctagatatattgtagagctacgacataaaggattagacaattagatatgaaccatggtgtcagacacctacatatctgttctttactctcttgcagttataaaaaccctgatttttagctggaaacatgactgtctaaaatgaagaccctatttacctgttttgcttgtggctaagtgtgcctatgtgacgatgttctggccagaagtatcatgcagtagcatacctaaaagatggctggcccaccttcttctttatcacttcctccatcctgcttcttagattacctgccatcttggtctaggtccagctgctaatttggaccctagcaatattggagggatgaactggcaggagactgagtcccaaagaacttcatggaacagaattctgccataccatcccttgactaaatttcactagccttctacatgagaaaagaatgaactaccttgttgaagcctctgagattttgagattctgttacatgcagttgatcttacaatctgattctaaccaattcagatatggaggaaataaatgaataagaacttagtttctaggatttcaagccagtagccattataggaatataaggaaacatgtttggagcagggggaggatgatggttttggtttgggattcaatccaggtggagatgtcaggtaattggaaacaaatgtcaggagcttggaagagaggccagagttggaggtttagacttggggtgggaagcaggactttaaatagctctgatagttgaatgtatgataggggaagacattttcaagggataaaagtataaaaagagtgcaaaaacctgaaggctgaccctggactaagtgtctgcttatacaggtgaggaggcaatagagatagtgaaattgggcaggaagaggtgtggtgaaggtgagggtaaagggaagaagagttgaggctgaattaatgagcttatttcttttgcatatggcatgtaggagaggaaaaggattcctaggtttctcatagtcaagaatgtactgattatatgcatttgcttcattaatgaatacagtgctattttgtttagtgtttcaggaaatgctttgattccagcattgttttccgcttttaatgcttggaaacagctttgctaggctcttctcaggtgagtagctgcacgccaaagtgtctcagtgacagcattgctaaggagttttatggagaatggatggtcttgactggaaagtcacttaatggcttttaaagttgtgagcagatgatcatactgtataagtgacagactgtgaagtctgagacctcatgaatggttttgatgttggcatcagataaaattactaacaaattagatctgacatattttaatggtatgtataattattattggtctttgtgattataggctacatagtaactgctatcactggtaatagccagtattacttttgtctggacacacaccagacatttacggaaatagctggaagaagaatgatattgagaattgagggagagggtggtttgtgccaaaaggaaggtttggaagaggtggacactattcctctctcacttcctaactggcttattctggagttggaggcctgcagtgcctcaccctgtcaagctgacctaggcacctagtatgtttagctgttccagtccccactctccagatttggccacattctcccagttggaaatgatggaagatattgccatctggagttctctgatttcctgtaagttcttggagactttatgcatggccccacccaaagcttttccttcaccccaacaggagagaaggaggctgcagaccacagaaacttcagagatgatgatttatgtggactcatcagaagtctaaaggggcatgtctgtgttcttaaagggtacgggaacctcagagagccaattggcccaagaagcagtatgtagaatggctacatattctatattttcaaagatcaaacagtgcagagtgcaagattataggaaacccaaaagggtcacaaaccaggataagaaaatatcccattcactgccatattttccaaacctaaaagagtgcctcaatcaatgtttgttgagttttaaataaatatctttatttcagtaatatttaaaaatgtatcctaaatctacttgttgtctgtattttcaaacatagggaaataagcaccaatagctaattggaggaataggatgggggatggggcacagcatgaggagaggagtgagagtatgtctctcccagaaaacatttattgtaggtattgattcaaattccagttcctttcattcctagctgtgtgatactggacaagttacttaaatttgagccagagtgtctccactgttaaactaagtaacaatatctactttataagattattgtgtaaagtaggtaaaatttatgagaacatgcttaataaattctaagtgacaaaatgttaggtgttattactgacatttataacaataataataataataaaataataaagattggaacatggccagggagtggtgaggggtcatagcattggtgtgaaagttggatttgaatgtcagtttctctggctcatatggtaactctgcctatccaggatttaacttagaatcaacagctccccaaacaacagcagagctctatccagtttgaacacttgaactagttcttttactcagtgagaacctgtgagtctgtctggagtagagaggcgggtgttgagattaaaccaccacagtgggctgtctctgtcttagggaagaataacagagaaggagtttctgcacaccagtctgacttagagctgagcagcacatagacgtgtacccaggtatctcatgccttatgcccagcgggacccttcctggtgtgtatggtcgatatgctaccctgtggagggtggctatttattgaattcctattccactcaacttcagtttatctgactttggaggggttgcaacacggccttgcctcttatgctgagctttctttggaattgctatgtgactgtttctttgacagacttagttagaaattcagatgatactgatttaaaatagacccgtggggtttgagaacagttagagagagcacagatgagaaggagaggttaaattttttctaaactcaagttgtcagtactaaattcattatcccccattaacaggcataataatgaaaataataatgtataactttttcactccattcactcatttattcatgaaatatttattaagtgcctatgtactagagtgtatactaaatgctagacatatatagataaatagataaaccatgcctgtcttagggagtaaggtggaaagcctgagggtggcatgtaggttagtctggcatataatctcaacaagcttttggaaagatgaaatggttgtacttagaggcagaaattgcattggttttggtcacagatgtagcctacctccattgcctgccacagaacctggctcagctaagtacccaatagatgttttttgaattggcttaatatttctaattgcatgattaagtggccagaatcagttaatttaacccatgagtccttttcactccttttacagagctagaaactttttgtggccagtcaacctggtaaccaaacatttaaattctggtaattggtaaatatgcctcgtcacaggtttgttgaatgatttatttttcataaaagcaggaggttcatgacaagctcagcaaatctgttggcagttttaagacattataccgggtagtttagggaaatttctcagcacatgagaccctttagattatgtaatattcttgcaaggcaactaggaaaaatagtttttaaaattatgtctattttgctatatttaaaagcagaaattatcttattacggagaattgattaaatatttgatagcatttttgtatgatttaacatatttataggtgttaatttctcacaaaatttaagttatagctctaagtgtagaattaatagtttccctttgattacagtttttttggtgttaacgttcatctatttttggatgatttgacttacccttcctttttaaaattcagactctaaatttaaggctatacatcaccatagtgtttatgaagtgaattaaatcttacagaatgttccagtgcaatctgaaactacagcaactacttgaggttttatgtctgaaaagtgttttaatcagtgatggatttggaattattgcagctgattcctgaattcttaggcctaggccttaggaacacactatccagatgtttataaaatgccattttaccaatgtcctgtttatactttgactttgtggttcaaaaaaaatacatttgcctacttcaaagtaccagatgaaagtattttacatcaactaaatactgcatttgagctgcccaacagtccctaacactgactccttctgccttaaaggcatttatttcctatcatcacctgttttctccaagacatgtgagaagaataaagcctgtattgtggcattttgtgtgaatgctaagatcttggcaatgtttcttataccttccctagctcttctattttccctaaaaagtattctctttttgaaagaaaaatttaatttctcaatttcttaaaccagattattaattaaaactgcaaaatgaaggaaggaacacccactaattcttcaaagctcagcaacagaatcaaatcctttgaagatctgtctgcttaactcatcactattaatcagtttaagactatttagaaaaggtactgagagaaagaaatgaataaaaatgggtgaataaggcaatattaagctgacactttatagtccggttggtagagtaaaaaagcaatcaaacttaacagctttttaaaaaattaagaatgttatataggttgatgttatttttattattataaatataatatttactccttttgccaacttggaaaatgtagaaaagtcaagaaaaacataacattcatccatgatcccaccacccagacaaaaccacttttacctttcccctattttttaagtcattttttgctatgtaattaatcaatttgcataaatacaaaattgaggtaacggtatatgcacaattttgaaacatgttttaatcactttcttgtggcattaaatattcttcaaaatatgtttttagtggctgcagagttatgttatgactttctcatcctttagttggtctttagtgtgtttttatggtgtccagtttcagtattcatgttgatctcctttcaccctttgtcttcactgagtcactcttggctcactatggtaatcattagcactggtttctagatatttctggctcttcacctgcacataaaacagggctgtacatctcagtcccttggagtttgggtgaggacatgtgactttttctaaccaatgagatgtgagtagagcatttaattactgatgagagagacctttcagagtgctgtcctctttgccacagtgactggcagctttccagagagtggctgctccattagcgtggatcccagagtgaggttgaggccaacataaacacctaattggcctgggatggataggtaatgtgagaagaaaatgaaactttgttttagtgagtgaaatcttaggggctgtttgttatcagtgaataagtttgcctgtcttaactgataacaccaatcatttgtatctagattgggaatctgatttagaccttgtggtcatcttatagactcatgttcaccttcacatctgtaaattatgtggcaggtcatcatatacactttctcaaacaattggggaatctttgcccctatgcatctgttttcagggtgtttctttagttgacttcaggcgtattcaataactcatatcatatacatacataaacactcata

SEQ ID NO: 246 - DNA, 16382 bp, Homo sapiens
ggggtctttagaggtttcaagactagtgaaataatgattgcaccatattcttttggatgattaagcttcccaggagggaagtcctaaaatggctagcttacttcccataatacctccatcaccccttggaataacatattcagcaagctgtggccattcaccatgatttcacggtcatgagacttaaattatggagctggtctgttgctttgtgaaactgggtgattgccagaaacctttatttaagaactactactcataagactaataaattcccaaatgatttaatgcacagtaatttgtcaggattcactggcatttttttttttttttctggcataatgaagacatctggaaacccaagctacaacttaggagtaccagtagaattgtccagcaagggacttcagaatctgttgctagcctctaagactgattataatgtttcactgattttatagccaatccatatttcactggactcttaacttgtataattctattctttcaacatttataaatacataataacattggactttacatagcactttagaatctttcccatgttactttatttgctctgacaacaattcagtggctcatgcagaagggtcattattagccctattttattgatagggaaataaaagttcagacaattagacatattaacatgtttaagttttgcatcctaagaaataaaaacgaaaataaaatgagataaactatgtttgtctacttctagcttattgtttttagaaccaaatttctttgatgagtattctatattcctacctctaattcctcacctttcatttgctcttcagactattatagcctggcttttgccaatactgaaacaggacttgttaaggtcgcaaataactgcctacgtgtcaaatttaatggacatttttcaggccatcatcttacttcacttttatgaagcacttgcctccatcaactgcattttcagtgtttcttctctttggcttccatgacttctttctcatgttttctctctctttcttgcttgctgtcactctcactctcttctctattccttccctatatctctggcttctcactgtgactgtttgacctgtgtatcctcatcatgctcctatgaatgcggttcatacttgtgaagatgtgacttgaaccacaatctacattgtggccatttccaaacccctctctcccatccataccactgccgccagctctaggcctatatattcacctgcctgtggattcttctctgggatgttccatagctatttcagtttcaatttttttcaaaattgacctcatccttcatcttctaagtcacatggtcctttattgcttttttctctttctgtgtccatcatttctaacagacactgagtctcttaggttctgctccttatcagtcatttcaacaattacacacggaacagctccatttcccagcatgactccacattccagcagtcagcaatcactaacacttttcccacgcaccacgtttcctcaaagtgttgtgactttgcatatgctttctcctctgcaaccctccatttcccttctcactgccacacacttatgagtttcttcctctggggatccctccctgatatccacttgtagcccaggtgagttacctcttttttggtatttccacatacatcgttctgtgcatgctctgtatcataatgtcttggaagtattgatagttttggttcgtgctttggtagagtagactaactgttgtaacaaacagcttcaaatctcagtcacttcacacaataggagtcttttgcatgttcacataatggtttcaagggggtggtcagaatgtggccttctgctcctttccatctgtggctctatcatttttgagatctgagttctctgcagagtcttctgcattcatctgacgcataaggggatagagagagaaagtcgataacctagagggagattttccatggttatccatatctaggcctggatatggcacacctcacttctgctgacattctattgggcagaatgctattacatggaggctaggaaatttggcctatctttatgtccagggtgaaaggaaagtgaatttggtgaaatactgcccagtctgccccaattgcctgtctccacactagactctaagttccagaaagacattgattacgtgtattttttaacctctggattcctatcatctagtataatgtttgaaacatggtaataacttaggaaatgtctacggaaggaatgaatttgtctgaggatgtagagtaaatcatggcagggctctcgtaacaaaccagctgacccggttcctggtgctctttgtccgaactatgtaacccatgtatagtaagtttgaaacaacttgaacttttagggtactttgctctgcatttggaggaaaatattcagatgcccaatatgccagattatacattttttctgccactacacttatgaacaaagatgttttgagttgctgattaaggaaaatagctcccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttgtggtgtaatcatcaatatcatcagccattttgggtctgcagtggtcacacagttgcatgacagatgtcctgaaaaaatgtccattgcttgttgtcagcatcgtctccaggttcattattgttattctctgtgttgccattattagtgttcttgggctcaactttacttctaggagatattccctttattaatgcttttctaatgacacttctttccatcaccattatcaactgagacccccccattagagcttttttagtttttctgatggtaaaatacctttctttgcttttgtcctgggaaatatgttttaagaataaatgcaattaattagagatttaagtcccacagaggaaagcttctctatggaacaatttgtcttgcattatttctctaatttatcatattgtttagtacatatttcttgagagcttcctagttgctcagaaatttccgagtactaggattactaaggtgaattccatgtgttttttgtcctcaagaaatatttttatgtagccaaaagagaagggggtaagaacatgtaagtgattagtgttatttattttatatttagtgctaagtgaatgattgggggaaagggataaagaaaggaaattactatttattaagcaccaactttgtactattctaaagggttaaagagtttgtctcaattaattctttatgtaacccaatagaagtagatactgtattggtatctcttttactgaaggagagacaggttcagaatgattaatggcttatcatgctacacatctaatgaaagaactaggattcaaactcagtctctggctctaacttccatgctgttagattgtaccaagcaacctggagagctaatgctataggaatctagaggagataacagaaatctgattggggttggttgcactgacaatgtggatttggggtgtgttcaataaaaaggcagaattgaccaagagaaaggaggtggaaagactctctgtaaatatcaaagcaaggtgggactgcatgatatatttgggtaaaacacaagcagatcagtttagctggagccaggcctcctagggggtcagagaaatgcaattctggggtgagaggaagagaccaggcttgaagaattcagggtagcagattaggcagttttaagtctaatgtggaggaaatggagaaccatggaatgtgttaaagatatggggtgaattttacagcagtggttcttgaagtgtggtccctggaatagcaacatcaacctatctaggagcttattgatgtgcaaattattaggccccacctaatacccgttgtatcagaaaagctaagggtggggtccagcaatctggtttaacaagccctccaggtgattctgatacacattaaagtttaagaactactgttttagaaagatcaatttggccattgtgcatagcatgcattagacagggaaggacaggttactcctctaataatgcagatatgaagtaatgagggcatagatgatggcaattggaatggaaagaaatcagcaggaggcatagtatgagaacattagaacttggggattgattgtattcaaagggggaaggagtaggggtccaagttgataggcaaggattaaaatctatgggatgaatctgtatttagttcagcccaaaatttaaaaatcttaagtttcaaataacaataaggatttgtggttttagagaaaaaccagatttggtgatatatcttgtatgttccattgggcaaacttcagctgagcagattagccatcaaattcttcttgttgatgggatgtcccccctcttatctgccaagttttcccctctttttttatatactttattcatttatgttgcctattcgagtcctgtagatatttgagctgatgatccctgctctaaggatcccagcttggggacaggagaataagaaatgtaggggtcgggagagggagctggcttggagggaaaccagccagtttggtttctagacattttgagtccgaggcaactgtaagatagtcccattaatctggtctttatattttgcaagaaaaacagttcagcatttccatttctctgttgtccgctttttagatcacccaaggcagtttaaaattctaggctggctttcttgcaataccttgggacttctgcctcctgctttcttagcatgcgagctcaagaatgcaaagtaatttttatattagcccatgtaaaatataattcaaaaggtaactctactgaggccaaactgtttgttgtattcccactgccacacatacattttttcctagttattttctccattgccccagatagttgaacagggactgcgacttttaatcagctaaggaagcaaaagactttctcttcactttactgtgaaaattgcatcaccacactgggtatgaactcattgaggtgggaatgagttgttgatagggcttggctttggaaatactactggctgatgttttatatcacttggcctttgtgtactgtattgacagagtatagtgaagaggaggaggaagaggagcaatttagtttgaagatgactaagagctgattaaacattcagctggggagagagatgagtgaatccaggtgatgtttatggagtgtcagagagggagaatgctataccatctggtgagagagacatgaaaaagtacataaatcaatctctataatgatacttaattaatacagagttgataaatgacataattgaagcaatgggtgggctacatcatagagttaaatagcttcaaagagggtgctgattaaagccattacaatttataaaacattcttcatgttaagaaagcatcttgatgagatttcacatgaacattttgtaatcagagggccagcttaaaacactcagagcagaggtgaaatgtcttaagaggtctattttggatgatttttgaaaaccagttattctcagggaataaaaaagcttgctttccccactccctttgttttttaatgggaaaaaaattaatgttgcattcttcacctttagacaatctcagatttttgatgtcctggtggtttggttcttaagcatgaccttaagataattagctatcaagcttcatttaaattgttttgaaatatcattgcaatttggggagcatatgtgcctgctggtgaaaaataaggaaaataccactgggactcaaaaactgtacaagtgactcacctcgattagtaggcttattttgtttttgcttaactcactctgaagctcataacagatgcacagtaatcaagcagaatgccaattctcatcattcatgcaggtggggccactgtgctcccaagggggaaccagagaagacccacaacaaacactgcgttttttcttctcatcatcctttcttttccccctttctgatttttggaaggtacattctttgtttggaaagcctttgttagaaattccaaaatgttctttaatcactggattcttattattgtatcaggtagtgtgacaggcatgcttcctcataatggatagagccaggcaatgtattttggagcccgcattctggagactccatgcctgtgtctttgttcagccacttgccagatgtgcctcattggtgcctcagtttcatctgtaaaatgggggaaatatcttctttgtttttcttcctggagttttgagggttttctttttttgtttcattttgtttttgtttttctgaggcagagttttgctcttgttgcccaggctgcagtgcaaatggcatgagttcggctaactgctacctccgcctcccgggttcaagcgattctccggtctcagcctcctgagtggctgggattacaggcacccgccaccacgtccagctaattttttgtatttttggtagagatggagagtcaccatgttggccaggctggtcttgaactctcgacctcaggtgatctgcccgccttggctcccaaagtactgagattacaggtgtgagccactgagcctggccttttgtggggtttaaaagcagtaatgttattaatgcctgacctatagtaagttttaagtacatgtaaagttgctactattatacagtcttattaactattgactggacatagttattgaatgaaaaggaggaagggagggaagcaggtaatcagggagggattgagggaaggaagaaagagaagaaaggaaagaaagaagaaggaaggaaggaagaagaaagaagagcttgatttagttaatgtcactgttgtaattggtggattataattgaagctgtctggttgggagacaaaccctatgccatttagatctctgtctgttcagtttgtccaaactctgctggggttatgtatttactagtctgtctccctttttggattggcaattctgcagacagactgtgtgtcttactcatctgggtatcgccagggctgtgctctatacctggcacacagtagtgctggaataaataaagagctggaagcagcacatccctttctctaacatgtaaattcaaggtgtcaccatttcacattcatagacattgaataataatgtagatgaggtgactaaccttttgaattgctactcatcaaaaatggaatctctggaatctgagaggagactatatagttatgtaaatttcggcaaagtattgcaaactccatattactatggtgctttgtggggctgctataattaatggtctgtttgcatttctagtacaggctgtcatttttcatctgcttataaccttgatataaacatttattcttggctgctattttgcattcataattgtaaaatatatataaacgttaaccttctgtttttcagcttttttatttatcaaaagcacagctcaagaatcacatcattgtggcatgtttttctgaatctctagtggcaaaaagaaatgaatgcattttgaattcaggcttcaggattaaggcaatgttgtttgcttatgcagtgccctttgaaaaatgtgtaatgtagcatatgaaccaaaagaatcctgagaaactttttccagccggtctttttctattacttatgccttttttatccctctgtgttcctccccacctctgtcatcagttcaagatgactcttaaagtcctcttgcatccatccaaatgacccattggcctctttaggtgcctggagaaagtaccagcaaaggtatttgttggagtctatcaaaggtaacaatacatagagtgggtttcaaaatcagacaggctgggttctattgttggctctcccatttagatgctgtgtgaccttatgtacattaaacaaccagtgtgagcctgttttctcatctgtaacatgtggagaacaatgtttacctcatagagttgttgagagaattaaatgaaatcaagcccttgacacagactgaaacatgggaagtgattgatgaaatataactgacgtcttatcttggccatggtcattattatcactgtcatcattagatagtgatgggactaagctaggtaggttgacatgagctgacttatcttaaaaggcaccagctctagatagagccctcctcagtgttcaaagactcaaaagacttgggttctgtttatctcccgatttcgggagcccactctccttagtctccctcagtcattgactaaaaactatgcacttgtcttttccattctctctatcctcatgttaaatgcttgatattgttcttgcaagctgtaccaaagttgtggtggcccaaatcagtatcagtggccagcttacccaaaatgcagcaaatattctatttcaaacaatacccaagatattttccacctcagggcctttgcactcactgtcccctttgtctggaatgctgtttccctgctttgtgtatggttggctctgtttcaatctttacattttaactgaaaggttctttttgtgaaaagcctttcctgactatactaagtagagtagcactctccctcaaactctctcacacataatctcctctgtatgcacagaatcctaattatatttggtaatttatgtctatctacctacctacctatctagttttcagcatgtacttctgcataaaaatataaattgcatgaggactggaactgtgtctttcgtgtacctcattgtattctcagtacctaggagattgctggcacagggcaggtacttaagagatattgattgaataaataactattttaaaaatcatctaagacaatagagaaccaattaaacagatacatactgtattatagctatttttctgaagccacattctaaagcaccacagatttttttctcaattttttgttttgttttgttttgagacagggtcttgctctgttgcccaggctggagtacagtggcatgatcatggctcactgcatccttcaccccctgggaccacagacacaaggcacaatgcctgtctattttttaaaaaaaattttagtagagatttttgtggaaaaatataaatctatagtaaggctgaaagaatagtaaatgactcatttactcttctgagatcagacaagatctcagtgtggtatggccatagatgtgactcatatactctttataagaaattgcctaactttttatttttatttttattttttgagacggagtttcactcttgttgcctaggcaggagtaaatggcgcgatctcggctcactgcaacctccgcctcctggattcaagcgattctcctgctttagcctcctgagtagctgggattacagtcatgcaccaccacacctggctattttgtatttttagtagagatagggtttctccatgttggtcaggctggtctcgaactcctgacctcaagtgatccacccacctcagcttcccaaaatgctgggattgcaggcatgagccacggcgcccagcctcctaactttttttaaggaagttgtaccattttatattttcggcagtcatgtgtgacacttcaggctgctccacattcttgccaaaatttaattttagcctttttggcagatatgtattggtatatcactgaagttttgatttacatctccctgatttctgaatccctctttgtgaaaagtctactccaggcttttgcccatctataatttttttaaaaattactgagtggtaggagttctttatataatttagatacagatccgtagtcagatatatgttttgcaaatattttctcccagctgatgtctttcccatcttttgtgtcatagagtcttttcttaatagtgccttttgatgagtagaagttttaaattttgaagtctaatttatccacttttagttgctttcttttatatgcatctacattcattactcaatattttgccacatttgctttctctctctctctctctgtttctggatcatttgaaagtaaggttgttataacactgaaaacatttcacccataaatatataagcatgtattcataagagcaaggaccacctctaacataactgtaatatctttgtcatgcctaagaaatttagcattgctatagaaatattatttaatttaaaattcatccatattcagattttcccaattgtttcccccagtaatgttgttgatcttttctttctgaattccataatccaatcaaggacatacattacatttagttgtcataaagctttagtctccttatatctaaaattgctccctagtctttttagtattttatgacactaacattttcaaagaatataagggagttattttgcacaatgactctcagtttggagttgttcctcattattagattcacgttaaatatatttggcaagggttctatatggataatgtcatgcccctcattgcatcacataaggaaacaaataatgtcacttttccttattggtgagaccaaatttgatcacttgtctaaggcattatctctggatttctttatcgaaaggtagcattccacctttgtagaggaaatacattgcaattattgtgggatgctcttgagactttgtgaatcttaagttctttaacaaaatttcacccagtgagattttaacatccgttgatgacccctgcctgaatcaatcattgtactggaagttgcaaatgtttttctaattcaattatttctattacaattatttgctgtgtgcttttgtaataaagagcatctgcctccttttccttctttttgtttctgatgatcacttcatgggtttttaaaaaatgtatgtgataaaattcattactatcatcattctttttgataaagcatcaaaaatttcaaaataattaatgtaaaagttagcattacatgataagcttgaatatttgaagcactggaaggaatactctttttattcatccaaagttacccagactaccacagataagtcaactaattaggagtgtgtaatcaatatcatttcctctgaactttttattaacagcatgagctttggggtaataatcctgaagttatttttagtttacaattgccaatgtatagaatatgcaaataaagatccttcatcccatacataattgctgttaattgttaaaataagtgagcaaaatctcaggtccagcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccagcagggatgtatctttaggatgggtttacctcatatctgtgtaatacagagaactataaattatccacccactccaacctccccatgtcatcagtggttgtgaaggggtaactagcctctgcctgggtgtcaacagtaatagtttaatagctcagtgaatgtctgttgcctcactggttactgctccgtagagtaaatatttgacatcaaggacaagaatttaatttttaactttctcaacttaattttattcagtaaacatttattatgtgtcttctatatttcaagccaggagaagacccaatttttgtaggggtaggaacttacataatttgggggcctctttaagaaaaacaatacaaagttacttctacacatttagatataaaatcaacatttatttacaatagggaagaaattataacaatttatgaatttaagagagccaccaaatactacaaacgtgacacaattcagaaaaatatcttgttttgattaaataactacctatcaagctgctgtactttgtctgcattttttatttgcacattctttgattgctctttgtatgacagtgcttttgtgttgtagtttctaaaacaagaataaaaaaggaattcagtctttcctgtagtatggttgatcataatttagcttttattattgatagtttggaaaagtttatttcagctttatagcttttttattggtagtatcattatacaattttaggattgttgtcaaatttgggaaaatgttatcaagttttgttcatgtatgggctgtaagatttcaggacattttatgtttttgtatagtgacaatgaatgaacatcattccatttagtttgctgtctagatcctcgtttttagtggcattttatgaatttttgttatgtttgtatttgtcagcattttgtgtcaaaccaacaagaaatttcaatcttttctcaaggtgatgtactttttcattatttggcttattgagtgatctgtgagactactcatcccaaatacccaaagtatgtctctttctgtcaataaactgtagttttgtatggcttttgtctgggaatgccatactttgtcagaataagatgtggtgtatattttaacatgtaatccaatatgttaacacaaataaaactgtgacttcatacatagatgcatttgctctttgagctctacaatcacaggaattctgataaattctattttgcatgacttccttaaaaatataaaattagaggttgtgttcgcaatagcatactctgaattactgaacctattcttgataggagagaacttccattttaagtaggaattaatgaggattggatacctcgactgcagttctgcatatctgataactggaagcattttccagtgactggcttctggatctccaccactgtctccatgctttcactgccagatgttgcaggatgcattcttgttacaatatgacctctgaccctgtgtctttgtattatgacactagtagtcccgggacacattcctgtaccaagatggaaacaactgtgaatcacctaagcacatccctgtaaacccaagccaatatatctccaggtcagcttctcctagctggatcctcaatgcctatagtcaatccagtgctgctccatatgttgggaagtatgacagaaaggaagtcagagtggattaaaagattccacacctttggtgtgcatggattggtgcagcccttctagtgagacatccccagatgttagctgataacatcctcaccctcatcctccccaccatcacttctctatgttttactggcctgatccagtttttggtggcttggcacttggaattctttacaagcactttctttctatattgacttactatcatttttagaacccagattttttaaatgttcaagctggatgaacccttatacatttgctctactctttcattttataaatgaggagcttggggctgaaggtcattcagctaagtagaagaacaaggacacattattttttagctctttatgccatctttcttttctttcaagtctccatcagactacacccagccttccaggattaaagtaagttaattaggcatgcattgatttgatctccgtaggtcccccctaaattgatatttttaggagttagaatattcaatgtgctccccaaatgctacgtaatagtggttttttgctcattttgatagggcttttagcagagtgaactgtttcgtggacactgtcacaggaagtggaaactcaccttgtgaaaaggtaagctttccatgggctttgagttttcctttcctcagcaggggaagggcctatatgtgttagtgttagctgcctggccttcctctggggcttggtttttaatctccagggaggcaaggctgacaaaatgtcatctatttgcctactaaggaaagaagctgtgaaatagatctccattgcttatgcacctcaagtcgcttagttccagctgtatccataatatcatggtgtatttaaaatactgctcattgcaatccttttgaaaagagattctgatgctcgtaaatactccaaaaaggcattaaggtgttacactgatttttatttttattttattttattttattttatttatttatttatttatttatttatttatttatttattgagatgcagttttgctcttgttgcccaggctagagtgcagcagtgagatcttggctcaccacaacctctgtctccagggttcaagcgattctcctgcctcaacctccctagtagctgggattacaggcatgtgccaccacacctggctaattttatatttttagtagagacagggttgctccaagttggtcaggctggtctggaactcctgacctcaggtcatccactcagcctcccaaagtgctgggattacaggcatgagccactgcacctggccgctttttatctttaattggatttattccctttagaaaacttaagtttgtggattcatatccaaatattgccctttactgatctagctttttctgctgtaagttctaggaaccttttaattcagagaggggtaaagaaaagagctagcatacactcaatagcttttatgttttggatgcttcataaatatcacctcatttggacccttacaagagctttgggaggcagggagctttagacacattttacacctgagtaacttgatcaggacattttgaaaaaaaggtttttgattatctgtttttcaacttgagagagtcgtgagataactaaactacaaatgaaaaatacgtaggtaagtctctttgtaaggtcatattcgtaaaggttgcaaaagagaccaaacaatgtattccaattgagaagtccaggtagagtatttggttcatttgtgctgctataacagaataccatagactgggtaatttataaagaatagatctttatttctcacagttctggatcctgggaggtcaaaaaacaaggcactggcagcttctgttgtctggcaagggctgttctctgcttccaagatggcaccttatttcttcatcctccagaggggaggaacgctgtgtcctcacatgtggaagaacagagggacaagtgaaccaaatctttgtgtgaaacctcttttataaaagccttaatcccatttatgaggggaggagccctcttaaaggccccaccacttaatatcatcacattggccattataagtgtcaacacctgtattttggaggggacactttcaaaccatagaataaagaaaacgaaagggggaaaactgcaaacaaatgtgctatgagattagatggatttgaaggggactcgacagtcttgggccctttgttttggaagatggattttgaaagttatcttttattgtattcctgtgaggcccatttgtttcctacccttttctcttgtccccctcttccttctctttattcagtatcttcctctggcaaatagcagttactaaatttggttctctgttatcttccaactcgaaaggcaaaaggcacaggcagtaccctcctggtaattatttatgatatttctccttccagagatttgccctatggcagcttcaatccgttaccatcactttttatttttttgcccatattggcagcttcccaagactttgggaggaaaaagcagatctgcagatacgcaaacctcaaaatcaagacttggttaatgaaatcactcctccacttgcccttgcctgttactgaatcctgttccagctgggatggaaaaagtgcattggtcatgctgtcaaaagcatatcacatttctccactgctatttccttccttcttaactaaaaacaaaacaaaacaccatagacaacaaatagacacacacacaaaaaaaaagacactaggtgagagtgaaggtagtttgtactattttcatttttcgtgtgttcaatcgtatttctctcagcaaatatgattggaagtggtgcttttccttccttccccaccttccagcattaggtttgtaggtgaacataaaaatacactgacactcaaagaaagagctctttctgctctgcacacatcccatctcgccctcttccttgctcctgcttatttctctctctttctgcctccttacctccttcagtttagagcttagagaagtttttcactcttcttttgacaggtgtcagatagacagtatgagctcatttaagctgaactgtctgggggaaactaaatttgttcaggagaatagcaatttggatgacaagtgccaggacataccagatggcacggctggagaaattcttatcgggctcccagctcacgttccaggcggcctctctgtctctctcctctattcttatttgttcatggttgacccagatggaaacttga

SEQ ID NO: 247 - DNA, 20915 bp, Homo sapiens
gccaagagtctatatttcagatgctaaatagtcagatgccttaaagtgtaatccttcccaggtattttccccagtcagtagttccagggtaaagttatgtcatcatcaggtagctagcccagggcttgaagggtttaggattataatactatcgctgtttggtcgagcaggctgggtgagctggcctaaggttgtgggcaggtgggtggcagggtgagagtgagttattgggatccttagtctgtagcagctatggagtctcagaatctgaggctgaagtatttaggcagaggagttcttgagagccagagggctgagatagtgctggctctgacagcttcatgagggacattaacatcttctggctaggagggcttgggcctatttgtcagctcagcctgactcattcttttattttttaaaatcagctgaattgaggtataacttatataaaataaatcaaccaatctaatgtacaatttgatgagtttggaaaatgtataatgtaaccactactacaattataatatataatatttccaccacccaaagtttcccttgagttcctttgtagtccatctccgactctaccaccctgccctggcagccagtgatctcctttctagagctatagttgttttttaaattattatttcatatataagtgaaataatataatttgtagtcattttctgtgaggcttatttcactcagcataatgcttttgagatgtatccatgttgttgattcagttgtttcttcctttatatccccgagtaatatttcattgtacagatatatgacaattcgtttatccattcagcaattgatggatatgtgggtggtttctagtttttgattattgtgtataaagcttttgtgaacattcttgtactagtctttctgtggacttaatgttttcctttcttctgagtaaatatcttggagtggaattgctggactggcctaaatttaagtacccttctctctgtcaagatgcttcactctgtattttgtcggggtagcaccttctcccagaaggtagatggacaatttcagagcaatcatgagatttaggatgttgcctagaattccaagagttgatcataaatactttgttaccaagatgtaaaaggtagaagtttaacaaaacttcttccacaaagaagtaacagcattactttcacagaaaaaaatgaaaatgaggacagtaaagtcaagtctgtggttgcgttttgtggagggaatctgcattctagctggcctggaaccgcaggggacatacagactatgaaggcaagcaagaagcatgaagtccctctgcaggtgttaagttgactaatgagcctgaaaaagaatggccttatccccaataaatgtcgcttcttccatgaagactgctttgataacattcccctcatcccaacacttcatgccactgttatggtgtcatctcctagcagaacttgcaaatgccctgagagcaggcactctgttcactctatttcctttcttttcctttttcccgccctaatggctatttcaggaacttggcatgcagtggcttctcaacacatgttttattttggtaaaatgaaggagtaagtaagaaaaaaatggttggaggatgttactaatcttgatcctctttaaatctggaagttttactgcccttttagaataccaattgttcattggcacattgaacctcatccctgaatgtagtgcaacatgtccaaatatgaacacattggctccctcatacctgattttttgtctttgtttcttgtttctattaaatgaaccatatttatctaacagcaaagttataaaacttcaagttaattttcattccctctcctttatcactgtcctacagtcaggtatcacatcctattcagtctattttcagcatattaaaaaaaaattctgttcctaccttgcctttactgctactactgccttaattcaggccctcactatttccccccgattttttttcttctggtcttttccatacttctttgcaatgaggctcaaagttattttaaaacatttgatctcaacatggtgattccctgctttcaggtccctctctcctgtttcttataagataaaggttgtgatgaagataaatgctgaggtgagtaatcagaggtgagcagaagacagagaaaaaaagacaaagagagaggggagtcagggttagataagaggcagttatagtaagaagaaattatatggtaccattcataaatgaacagaaaatgagaatgaagaaaggggaaaaggaaatgtatgatggtgaaaggcaatgtctggtggagattcaaggtcaactgagaactgatctttcataggccagggaaggagttcagttccaaagtctagcagactttcctaaaatcattcatttttaagttatcagtaatgctaacagtaacttaaaagttggtttttataatttaggttgactaacttctgcctgacacaaccttgctactttgctccatagcatactaaagaatagtggtgctaaataacttataaaattagctgcagtggaaattatctctataaaaggagaaggtctgttgaaactatcattattctgcctgcagaataatgcaaatatctttggagacttgaaagtaggcagaggggaggaaagtgggtatcttagtctgttttatgctgctattgaagaatatcatagaatgggtaatttataatgaacagaaattagatcagagttctggagacagggaagttcaagagcatggcaccagcaatttgcaaggaactaaggaacttcatgctgcatcatcccatggcagaaggtggaagggcaagagatggtgagagcaagagagcaggaggggaccaaactcctttttataacaaactcatttttgagataattaacccattcctttgataatcatattaatccattcctgatggcagaaccctcatgatttaattacctcatattaggccccaccttccagcaatgttgcattggggattaagttctcaacacatgaactttcgggtgacatatgcaaaacattgcatggactaacactaggcagtggctaatagatattgttcagtaataacacccagtatagttccttacatctcatcaaccatgcagagaaccttaataaaagtaaagcagttagcatgtaaataatccttccattttggcccaaaacccatgggcaaaatgtggtaaatatcagctttagaaaagtgtatatgtgattgataaagtattagtacatttcaaaaccctgttgcataattcatccataagcctggaccgaattaaccacaggctttaaaaagatgccaataggccaggcgtggtggctcacgcctgtaatctcagggaggccgaggcgggcagataactaggtcaggagatggagaccatcctggctaacacagtgaaaccccatctctactaaaaaatacaaaaaaaagttagccgggtgtggtggcgggcgcctgtagccccagctactggagaggctgaggcagaagaatggcatgaacctgggaggcggagatcgcaccactgcactccagcctgggcaacacagtgggactccatctcaacagaaaaaaaaaagccaataatgaaaatactttattgggtttcactttgtgaaaatagcagaataggggtaatatatacctaaaatctaccctctttccaaaaaaccgatggtggcacattctggctcctctaagcccagaattctctctccactctgacttcctcagaaactgtactcttctgtgatttgggcatgttttgcaggacccagaagatcttggacagtgtgcatgagtgcacttcactggggctaaagcagtcctctggaagctctgacattagcctcagaactgcattctctcaagacagctttatccctgggaaatcatggtatatttaagacccatctatggttgagaataaatccgagtaggtgaaaatgagcgctttttgatttctgagctgatacttcatggtactaaaatagcaatattatttctacccccacttatcaaggaactactttgcatttgaaaattcagaggaaacttcttaccatctgtgaataggttttattttttgttaactctatagaggttatcctaacaattaaaatagtcttagaggcagagacagagagtagggatcctagagatttagtacaaactctatgactttcagattaggaaaattgaccaaggagaacttgtccaaggggacacagcaaatatgtggtacaaacacatctggaacataactctagatttctggactcccatttcttttaacctctaagagattccattatgcctgggcatgccttagttgaatggtgtataaatttgagggctatacattgattcaggatataggcagttccatccttaccaagtcatttttataggagaaattgtacctttctctcatgctttttctcctgacatcttttccctaagcacaaagagttctcatatctaccgtcctttgtcgtctcagagtttccttagagcacccctgaaggagtttcacctgggaaagtcgcctgtgcttgatccattgattttatgtatcctccctctaagtcctccttgggtcatttctttttagctccttgtcactttggaagaggatctgatgaatgcatcacttctggggtgttaatgactctttatgacgccttgttcccctgtgcctcttttcacaccccttcaccaatcagctactcaggtccatctttatcagagggcaacagaaaaagccaaaatagatgcactactaatcatattatattgtaaaataaattttttagaaataattttagactcacagctattgtaaaaatagtgcggaaagttcaaatgtatgctttgaccaggctaacatgatcagtgataacatcttacgtaaccatagtacattaacctgttgaggacactggtgagaggagactcctgagagcgagctgctttcttggaaagcgagggctgtcttgtgggcatctctgtgtagcacccagtgcagggtggacctgctctgactttagcccccttagtctttttccagttttaatttatgatgctttcatgattttccacaaacagatgaacaaataaacacagaaggaaggttgtgcttgaattgacctgaccagaggacaaactgatcctaaactggactctctctcaccagtaatggattctctaatgttgactcttggggctggcccatttcttttgatccccagcaatttcctaggtcttattttgaggtttgcttagtaaaggcaatatttttaaaatgttaatatattcatgaattattctgaagttattgtatggaaaggaaagtgtttgggattttggagtggttggcggttgatggtattcaaacccattttgataaggccttgatgcagtgaattttttttttaacatgcctttttcttacagcagttattttcatgcattcaaagaacaaattcagttttatatgccagtattattttaaatatagtacagtactgtgaaggctagtggggaacattgaaatgaaaactctagtttgttaactgaacacttcactttcttttttcagtgtggggcaggatttctcaacatcatctctgttggctctttggatcagataattctttgttgtagggggctgtcccgtgcattgtggggtgtttagcaacattcttggccactaaccactaatgtcacttcctaccccacaccacacctcctgcagtctcgagcatcagaaatgtctccagacattgccaaatgtcccttgggggacaaaagccaccccaagttgagagtcactgatgtggagtaatggaaggaagactagatgggtgttgtgaggctttggttctggttttatttctggcacaaataagctgagtggcttaatccttcatctatagaaggaggaactttgtctgaaaaagcttgaaggtcattgccagccctaaaattcctttattaaaaaaatactgaaagatgaaaaaaaatacttaaagatgaaatttatcatcacactaatggtaaattctgtgtactgttaaatagcaacaagacgtcatggaagccctttctaaagctggtgctggagaaaagcattatttacagagtaagggtgttgctgttttgttttgtttttaaattctgtgttcgaatacagttgggaactttcctattcaaaaagttaaacaggctccctttttctgtggtacttcttaagcctttaatgtgctgatgtgcactgggaatctttaagaggtagctttgcagtattctgcaaatttttgatcatggaacactgttttcacagagtatcttaacataaaacattttgtgaaacagtaggatgaggcatgagttttgctgggtagattatgttttagtgttttttattatattctttttaaattgctcttacattaattcagcatctatttacttattgggtattggtatgtgtgaggcactaaggttatagcaatagcatggggtgggcagtatgctctgagcataacctgtaaaatttgcatcctgtctcttatattttgttggtagactattttgcctttctggatgtaaacatcagcctttcctgaagatgggagaacttatgcagaagttgagaaataggagaggcccattaggagggacagcccacggtgggtctgacatgccatgtgaagggccagggctttgtcctgtaggcagcgcgaaggcactgtagagttttagcagtggatttgcgttttagcagtggattttcattttagcttactctggccactgcatacttttgagtaggcaaagactgaaattcagccagaagataatagagtttaaaccaagacagttgaaatagtgttggaaaagaggagaaggattcagaaaatgtttggaaataaagttggcaggagttgttgaagtttgggtatatgagagaaaaagaggtagaagtgcagtttgggtgagtaggagaattcatccattaattctacaggaatttattgagctcctactttgctgggtgtattagggttctctagagggacagaactaataggatatatgtgtatatgaacaagagtttattaaggagaattgactcacacgatcacaaggtaaagtcccatgataggcaatctgcaagttgaggaacaaggaagccagcagtggatcatcccgagtcccaaaacctcaaaagtagggaagctgacagtgcagccttcagtctgtggccaaaggcccgagagcccttggcaaaccactactctgagtccaagggtccaaaagctgaagaacatggagtctgatattcgagggcaggaagcatccagtacagaagaaaggtggaggtcagaagacttagcaagtctgctttatcctagcctcactggccattgcttagatggtgcccacccagattgagggtgggtctgcctcttcccgtccactgactcaaatgttaatctcctttggcaacaccctcaaagacacatccaagaataatactttgcatccttcaatccaatcaagttgacacttaatattaaccatgacaagttcaccccttgtcaacttgaacccatacacatctcctgaaatcgtatataatctccaaataaagacaataattatgcctaatataatacagctatctcttgtgcaacccggagcacactaattgttaacctaaatgctattacataaagttaacaatacttaaatactgatatgaagtcaataactcttacgtcacatgacaaaggaaaaagaaaatgaagatattttcttagtgcaagtgtatacatctacatattcttaacaaaattaggaggaaatattcacaacaattacagtcctctttctgtagctggtcacgtggttgtagctggtattgatgactacctttttctactacctattctgtattccctttgccttcagcaagcacctcagtgggtcgtagttttttacttggtgtagtgacccaaaccttcactcctgaagggtctgggccatttgtagtcatgcctggattgggttgttgtagtttcccattgaccataatcacaaggcatggtaatactaagagatgccgtaaggatctcctgtattccatgcatactcttccttacctccattatgggataatagactaattttatcttgataatccggatcagttgccccggccaacactgtaactcccttcttagcctgttgacttagaggtaggcagagcccaaagtgtccagatggcaaccttaacttccaatttaatagaatcattgttgtgcctcctggcaacattcctccctctggaactaagacttctaagccagcagaatataatgtagcaggaacagaaaacaagaattttgctagtgggtcactaggggtgatggtgagtgatgccacttccatttccaccccttgttttttggacctgtgaatcctggctatgggagaaacagtaccatgtattggatgctgattcagatcatacacagccttctggagaacttcactcgagccctgcaaagccctgcaaagtattgtcgcctagttggcattgtaattgtgacttcaaaagtcattccaccattctatcaatccagctgcttcaggatgatgggtaacatagtaagaccagtgaattccatgagcatgcacacattgccacacttttttagccatagagtgagtgtcttggtcagaggcaatgctgtgtggaataccatgacggtggataagacattccatgaatccatggatggtagtcttggcagaagcattgcgtgcagaatgggcaaacccatatgtctattccggtgcagacaaactgctgccctttccatgatggaaaaggtccaatataatcgacctgccaccaagtagctggctgatctccctgaggaatggtgccatatcgagggctcagtgttggtcccggctgctggcaaattaggcactcagcagtggctgtagccgggtcagcttggtgagtggaagcccatgttgctgagcccatgtgtaacctccatctctgccaccatggccactttgttcatgggcccattgagcaatgacaggggtggctggggaaagaggctgagtggtgtccatagaatgagttatcctgtccacttgattattaaaatccccctctgctgaggtcaccctttggtgagcactcacattggatacaaatattttcacagtttttgaccactcagaggtccatccttaaaattttgtatatacatattatcccattatcaaatattgtcaaattgccctcatagcaccatagctgcatggtaagatgggcaattaaacaagcaacagtgatagaaggtggtaagtgccacagtatggcagctacatgcttctataggggctcatttgagggcaaccgtcctggtctaggaagccaaggatggctttctggagagattcagtttattcctactaaaaagaagattaactgcatgctagagattataaggatggggttgggatgaggtatattacaagctgaggaagtacatgtgaaagcctgaagagtagtgttactcttttttttaagaaacgtgatgtgacttcctttaacttctgaattcatttgctaatgaatcctgtttttatggagttatcctgtaaaataacccaaagacaaagacatggcttttttaatgtatatgtgtttttagaaataaatcattgaaaagctcagtaatccctttggagaacagctttagcattgatgctgtcaagacccttgtcaaaagaataaaccaaacctgattggcctggtggataaactcattccatacataactgaatagttagagactgtacagaaatgcagttttgcctttcatcttaatatgtagtctgatgatttgtaaaaaccttcttagtgggaacagcaggttattctgcctgggtgggagcctttttactagcttaagcagctgtttaaactttcataagcaaagtaattattaaatgtttcatgaacatattggttggaacgtttgttcacattttaaccttgagttggaaagtttcaggggggtggggttaaagagttttaagctggcaaattcattctttttttctttcttattataaactttttatggcttagaaccagccaacctaaatcatggaaggaaaaatacatgtgtggcaagcatgagacatttcattgtttatttttcaaatttctgaaatgtgctcatagctgtgcatgcctctgggctcataaagacagcaaatggaaatagctgaagccagacagactgttttagatagatagccacccaggtaggcaaggaaaaccttgtaggttactctttcctccaatcaagtcatattaatttgccaaaatgggattttcaagcaggaggatgtgatctttcataggtctgaacaccttgcctttttcaatgatggagccatttaataataatcataatcagaagatgaggaataatatacatttatagaatacttagtacatggcaagtgtatatgacacatagtagtctacgtgtttctcatacattatctcctttaatgttcaccacaaccttgtcaaacaagcaatgctgttatatccatataacagatgaagaaacgaaggcttagagaggtcacagaatttgcaaagcttctgagtggctgagctgggatttaaattcatctgtcctatccaagaacaattcattatcctgtacttcttagtgcctttttattctagtttgtgaagtgctgctacctaaagagtttcccattttactctaaatgaaaaagaaaaccaggacaaccatcagcatcaacagcaactaatgcttgttgaacaactactatgtgcaggacgctatgttataagcttgggaaatattctgggatgagaataaagaagataaaagggtccttgcccgtggctggtgaggaaaataggcagtaagttctagagctcacactgtgcagcactagtgcagggcctgcagcactgtgtccttgctggcccagtactaatgtctgcatatagtactttacaatttgtaatgtgccctcactgatattgtcccacataatcccaacaataggactgataataatgattcccactttaaagatgaggaagctgagattcagagggacaaaataattggactaaggtcaggcacacaccaaaataagtggaaaatacgattcaaaatgtggttctctataacttgctgtagtcattacctagagccctgcaattttatatagcataaaataaatgctttaaggattacctgaaacacaaccttaaaaaatgaaagcctttaaataataataattacaatatagtgaagtaatgagagcaattttagtagttttaaaatatgtccacatttttttttaaaatttctgtttaaaaggtggagccgaattctcttcccctgcatgtgtactgtacttagtgtctgacttctagtgaacagaatattgcagaagtgctgggttatggcagccaagattagaacataaaatgcagtgtagcttcctccttgctctttctcttgcatcacttgctctgggagaagccagctgccacgctgggaggagcacttggagaggtccaggtggtaagacactgacttcttctgctattaaccagtacaaactagctaacaagtaaatccaacaggtccagtctaggcttcagatgacttcaaccctggccaatattttgaccacaaccttatcagagaccctaagccagaaccacccagctatgccactcccagattcttgactcacaagaacagtgtgagataataactgtttattgttttaagccactaagttttggggtaaactaatacagcaattaaagggcacaagatacacagaaaggaataactgtgtctaagctgtcacaaaagatgggtactaaaatgtgacaaatatgagtaggaacttataggtggacaaggaatttattgggaggtgttctgggcaaagaggcaagtgtatgcaaaaaagtgtggaagtgtgccacagcaaggtacatttatgaaactgcacagtacagcacaagataaaaatcacaccaagaaatgtaatatatcataatataacaacaaatgttcttaagagtgactttgagtctgcaagaaatttagttctatatggactattttaaaagataggaaagcaattaaaacattgtttgaaatatttacttcaaaatttttttaaagtactgtataaatttttagttagagtctaagctatccagaaaagccacttccctgttttcttacttcactagaactgtctggttccatgttttgaaaactttagtttaaatgtagagccaagaattaactaatgaagaacacctggattttctgcaggatttcactgcaccaattctgttacaacaatcaggtagaaattaacattttataaccaattatatgttttacttggcatcatgctaaccaactgaatttttacaaaagagaattggccaaattgactcattattctccaccatacctcactcattgactgactatttattgagtgccgtccgtgtgttacccactgtgataggcccataaaacaaccctttatggttgcaaaaatcactttgcatcccagttgcagctctactgttttctagagttaatagaagttcctggtgaaaaaaactatgcttagtttttttctaagcatgtttaacttgggtttttaattaaaattaatacctactcatttgaaataaagagaaaagtgaaaagaagttttacttggaaatacattaattgaaagacagttgctgttagcatcttgctgcacttctttcactctattttcttctatgagtatctttataaagttataatattttatagatactgtcaaatctagttgttgtttaacatcaggcaaaatatcccttgaaacagaatttttaatgtatttaagttattctaacaaatggatatcctgcaatttacttaacctggtattagatgttttgattatacatgaatctttcaggaaaaatgatgtcatagttaaataaatatgtagctagtgaattttgaatgtgtcttttgaactgtttatgggctttgtgataattgggtaattttaaatgataatcagtaggaagcttaggaagaggttaacatggtttctctcccttccaagagaactgcctttgtaagattctgagatgaccactgtggccatgtgcccaagtgtgctgtcacagttatactgtcagttaaattaagcatgaatgattggatggagaacattattattctctgcacattcttgattcttaatttaaggttaaactaatttaatgtcatgtgaatttttagcagcaattatggacagttaatgcatgttcttccttagttatgcctcatctctttgcaaaattacaatatttcattccaaatttcttctgaccagatttggaagtagctctctcttctcttttccctcaatgtttatatcagaagggttttgagtttatactgtaaatctccatttgtgtattttcataataagactctaagaaccttgactggttatgagggcactggaatcaaagcaaatgagggcactggaatcaaagcactggacccagtgctttctccatccttcaggggatattgtacagacaatagagatgctatcttaacatctctgtttgagtttttccctctccacctgtcttgcataccaccctaaccaatactccttaagtatggctctatattactatgcccctatcaacactctattttaaaaaggcatggcttcacacttcctgtaagataatagccagtagtccttgaatctggcattcaaagctttaaatctacaagatgatatactggtcataccttttcctgcctattttctagagtcttttcccagaagactctgttccatgtatttggtgtcactttcctgtctctgtgccttcctcatactgacccccttttctaacctgactgttgaaatcttacctactcagtcttttttcatttatttgttgattgtttcaataaaattaatttacttaataagtatttactgagcactgattgctcatcagacaacattcaagagcctactgaaatggcaccttccctgagaagcctctcttaattacacacccatatacaatgtttctctcttcagaacttccataggtctcttttttatgctttccataaaatttgtcacaaatcccataccttatttatgtgcatataggagcatctaatgggaactcaaaattgctttaaagaacataaatgaatgaatgaacatgaatgagctaatgaatgaaagaaaagttatgccttctgcaccagcagaagctaatgactaaaataaaatggttaaactggactagaaatttaagattgttatgggtttctagtctaggaaacaccctcaatgtggtttccatattggattatcccaacagagaaagatatggaatccccatcttctgattcccacaccattactctttctgcaccatgttatcacatgctactctattaaaattgaggcagtattatcatactttgttattgcttttcattattagacatagtgttttaaggacagtattgaataggaagattgttttttcagagtgctgtaacctattttagcattcaaaggggcaaatgtataaacctgagtggtgagaaaaacgtagcagattaactaattttgaaagataatttattttgaacttgagtaggggctagggaccttcattagttcctaagaaaagtagaccacaaactcaacctctatgctcttttttatctagtcatgatattagagtatgtgtggactttgacagtgacacctaaatggtttttacttgcctcattgtttccttactaactgtatgaaagaagaacacgtgttgagcccctccaatctaaaaatacaaactctggaatgctccaaaatttgaaactttttgagtaccaacatgactccacaagtggaaaatcctgacctcacatgttgggtcacagtcaaaaggtagtaaaacaattgtttcatgtacaaaataattaaaaatttgtatgaaattatcttcagactatgtgtataaggtgtataagaaacataaattaattttgtgtttacacttggtcccatcctcatgatatctcattatgtatatgcaaatattccaaaatctgaaaattccaaaatccaaacatttctggtcccaagcatttcagacaaggaatactcaacatgtgagactctggaggtgaatttttgtttgtttgtttggttggttggtttttgcagtaaattgttgaagtcttagaaggggcgcattcagcagttagagcttcccttttaatttgcataccatgccgaagaagaggaggtgtgattctccttctggagatgatcattctttcaaaaagaattatggtgaattgtgttttttaaaaatagacttctagggcagagtaggggaaaaacatagggaaccgttaattaaggtatcagggcttgagaacgttgtttttgtctgcccaagacccttcctttggaaacagcacctctcccaacatttgtgctcctagtggactggtaacttgcactcctaagaactggaatcttgaggaagacacagagcgatagatgagattggggctgagtcatccatgatggtatcctgggcagttcagaatctctgagcctcagtttttcttccccccaaaatgggattctatgtctcactgagttatttgaggattcagtgagatgatgtctctgcaagctttggcacagagttgttattcaagtgaatattagctaccactctttgaggttagtagtcctggggacaattcttttctccccctaaagaaggaaagggaaaggaaactttctactgaggaggtagcaaatgcagaatcactgaaagtgcttgcgaagaatatccaactattcaaattatgaattagcaaaagataatcaggtgattgtgaactgtgggttgctgctgctttgttgtaatactgctgttaaaacccacgttagagatcacatggacacaggaaggggaatatcacactctggggactgtggtggggtcgggggaggggggagggatagcattgggagatatacctaatgctagatgacacattagtgggtgcagcacaccagcatggcacatgtatatatatgtaactaacctgcacaatgtgcacatgtaccctaaaacttagggtataataaaaaaaaaaaaaaaaagtcaatagtactgcagaaactcaggcttcttgttgggtcggggagtggcgaaatgtaaagggagtaaaaagggtggtagtctataaaggaactagccatccagccacccagaaaccaagtccctcttttaattaatagagttatggagaggctccagcatattaataaatgtccccctatgggtggtgagaacgtcaaatgtgaaacagagcatattggattttgtaataaaaatacagagaattataaatgagatgtccaggaggcatctaagttaaggacacctaagatcaagaatttatattctagttgataaaaagttgtggataaaattagggtgctgagatggaaaaagaaaggctcctgttggcaggaggaacactgatatgaagtgatgggagagttttgatcaagcctgtatctttggtatttaatatggggatgcgtagagagtattagaagccataggtacagccacatacattgttaaaatgtgactttttgtatattatttcacgtttgagcaattaccaacttactagcagttgtacaaaaagtaagccattgtgaatttgggatgcattttcacatatacattgtattagaccattcttgcattgctattaagaaatacatcagactgtgtaatttataaagaagaggtttaattggctcatgactctggaggctttataggaagcatggtgctgacatctgctcggcttctggggaggacttaggaagcttacaatcatggtgaaggtgaaggagaagcaggcaactcacgtggcgggagtgggagcaagagagagagagtgggaggagaggtgccacacacttttaaacaaccagatctcatgaaaactcactcactattgcaaaggcagcaccaagccatgaggaatcttcccccatgatccaaacacctcccaccaggccccacctccagcactagggattacaattcaaaaggagatttgactggggataaatatcgaaactatattagacatgaagctgcaaattattatttaattcatattctagcattaggtataccagaacaaggtatctgggtaagagaaagtcgatatgaagggcacaagataatggaggaagacagtttcttctatcgtctagggactttgagccaattcttgggaaaaaaaatagatgatgttgtctttgatggtccttttgttgttgttttgatcctcttcttcaaattcctggtaccttttctttctgactaacagaactctcttgttgtaaaacagcccagtgaaataggtattatcccaatgttacagttgagaaaagggggctcagaaaggttttgttaacttgctcatgccagtataataaataggaaaagccagtttcataatcaagtatgtctggctctaaagctcaccaagtccaacatttttgccttggaatgtgtaagttaacaatgcccccactaacaacatgaagcaatacagaaggaatgggttgagatggggtttgggcaaagaaaagatgagcttggttttaggtatgttgattttgagctaccttggaaagccattttctgttttgtggttgcaagagaaatcgtggtttgttgccctgtgttagacatgggtaaacttagagtgttccatttgctgtagaattagtggaggatagatagatgggatatataggcagagatcgatagatagttgtttgtacattggttgtttgaaagttgagcaatgtctgcagtcactagtcagtatttctattgcttagcaactctatttcctcatgtagccataacaaatggaacttttatatttattttttatgcttaagggtacatagtgctgcttataaatgatgcataagtgacaattttatactgtgagcattactctgactcttggaatcatagaatctcaaggttggacgggaacttaatagttggatttgttctatattcagactgctttacacctccatgaggtcctgactgacacatactactcatttagatagtgctccctatctgaaaagtcttggttttcagataacattttctttcctttaggcaaattattcctgttttacccatgaaggacaaatccaaatatcttgtcttcatgagaactcattgcacatttagaaataggccccatgtctctgccaattttctctttcctgggctgagcttcttctccatcttttcagtggctccttggagagatatattccttgagcgcaggactctttagcccaggttctgggaatgcacctcacagaaggctccagtgtcatcccctgcaggcattgtctcactggcagagagccactcatccatggccatagccttttccggtgtagtccccatctaatgatcaattcagatggggtataaaagctcagttatttcagtccaatatgtgacaactctgacaagccattttagtctcagagctgctcatggggtcagctgagtctattgttgggctgcattgcaacttgatttgttttctgttccttcttgagtccttcccctccctttctcaggtgttcattcccagggcataaacattctgcctgccaactctgatgcagagtctgcctcctggggaaccaagcctgcaatgtatgacttcaagtcttcttatgaaaccattccaatttgtttatggacttagacttctggagtggatagatacctctaggtgtaatctcctgtgtaatcagaatacattttgctttgaagaatattttaaattaagtaagattccacaaatctaatgtgtaaagctcatgcagtagaaagttttcagtgtggatgtcttagcttaggttccccctcaaaagcagagtgtgaaacaaggacttacatgtgagtagtttatttgaggaaattatcccaaggaacagaagtgggagactggaaatgattgttcacaataatctctgtcatttcatagccatagtttttcatcaacactttcctaatgagctcatctttgggatgccaagtgacattgctgtgtgctttcttcaagagatctgagcaatgtagtcagacagccaattaacatttttatttactttgggaaagctttgagtcctgagacctgcatgagatttttctggtagtatttccaactgtctaacaaaacatgtcaaaaatttcatatttgtcgttccaggaattcagcttaataagactacacagaccaggactgagaggttggtggcaaaggaaggagctactgagagccacacatcaataaaatgagatatccaaagcatggaaggagggtcagtcaaggcaatgagggatagactgggatcagttcaggaggctcctcccagaaccaggaatctaattaggagactgaaaagaaaggaagtgaaggggccccaagccagagagccctatgtataaaattatacatgattttatatatgtaagtcgtaatttaattctcacagaaatattgtgaagaatgtgccaatattattatcaaaactatttagcagatgaagtaactgaggcacaaagaggccaaataaattgtccgatgttgcataggtagtaagtggctgagcctgacttcaaacctcgatagacttttcccaaagttcatgctcttctgaatattacttatttctcatgtacctgtttctgaggcagaggttctcatgtattataaatttccttgatgaaagaccaggactggttcagaatgtgtgtgttggagaagaggggtgtaacagatacacattttatagacctccttccatcccatccatctgggcccactgcatcttgcactgcaccactcagggaacttcccccttgcccttgtctgctactatgtatctcggtcagcaagttccaacttggagtttctggctcttcttgccacttcaggacttggatgagatactaagccatggggcacgcaatgtggccccacatgtgttggaagaagccagatgatacaccctggacatgaaggagagttaactccttgtagggtgaaatttgaccagaggagggcaatggacaggagggaagtggctaaattccctcatcttgcactgtccaatcgacttctctgaggcatgagtttttcttctagctcattctttcccttgtcaagtggacacaccagcaaaggacctgttgcgtctctttgtggcttagtgtgaagtgataggcaggatagtgatccttcagttggcattgcttggcatcttttcttgcctcaatttccttctagctcattctttcccttgtcaagtggatgcaccagcaaaggacctgttgcgtccctttgtggcttagtgtgaagtgataggcagcatagtgatacttcagttggcgttgcttggcatcttttcttgcctcactttccttctttctaatccttgtaccctgggtttacccctttcaaagaaagcattaaaggccaagctaagaa

SEQ ID NO: 248 - DNA, 4282 bp, Homo sapiens
gactagtgtgtctctcccttagtatgttcctcctcagtttgaaaggacttcctggtaaaggactgaaagaaatgtccactccatcatgtctctgctgacacctagcttctcttctccagttataagtccattttcctactggggtaacacaagaaggaggaagaatagctcaggggtcttcccttcacatctctcctacaaggattgtgaaatgtcatatgcctcctcccatagacttagatagacctaaaattgtcaacatgtgtccagatagttgcaaaaaatatataatttccaacatattctccatattaacactttaaaataaaactgttaatcactcatatgttcaattcaatctaaatatcataatgttttgacacccattatcattaatttaaaaaatatacaaacaacctctttcttaatggttggaaattttacattgctcttttttcccactttgaattcatatttttattctaccccccatgtagaatttttctttttctttttttttttttttttgagttctcaaccctggttacatcctaatgtaatttttttctttgttcttggaaatcttttattgagccacctattctgcttctttgcaacaaaatatgttcttacattgaatttttaatttcttgttgtaagtgtaaaagttatatgggctgggtgcagtggcccacacctgtactcccagcactttgtgaggctgaagcaggaggattacttgagcccaggagttcaagaccagcctaggcacatagggaaacctcatctctacaaaaaaaaaaaaaattactggacatggtggctcctgcctgtagtctcagctacttgggaggctgaggtaggaggatcacttgagcccaggaggtcgaggctgcagtgagccatgatcgtgccactgcatgcactctaccctggatgacagagtaagatgctgtctcaaaaaaaagttatatggattaagataggattaccaactgttagagatcaaaataatgtcagtacagattggatatgccttatttgaaatgcttgggaccaaaagtgtgttggatttcagattatcttggattttaaaatatttgtatatacataatgagatatcttgaggccgggacccaagtctaagcatgaagttcacttatgtttcttatatacattatgcacatagcctgaaggtaattttataccatatttaaaataattttatatgtgaaatgaagttgtgttaagtacagtacttacatgtggcatcatattggtgctcaaaaagtttcagattttggagcatttcagattttctgatgagggatgctcaatctgtaatacacattttggtaaataaaagtgtaagtttgtaatggtaaaatttaactagaaatgcatctcttaatgagatggatagggactttattttcccaatttcatgttgacaaatgttacttattgttaatgaatctgggctgtatattatttcaattaaaaaattttaacatgaaagaactaaggaatcttgatcatataaatgaatgagaaaataaagacttgttgaggcaacttcacccaatttttaaaatttcttcttagtcgtatgcaaaactcacataatgggctattattaaataatatttttaataatctgtcagctgacaactcaagtataaggttcttcttcaattttgttgaaagcaaagaattagaaaccaattgacttgcaaaactatttttatacatacattaggttctttcactttgtttttagaactataccaaagacttcacaaagtcttataaaataactaataattatacctgctgctctttcccttagagataccttgttcatgaatctcaaattagataaaactagggttaaagaaaaacaaccccccacacacaaaattggagatcaaaaatcaataggttcttaaaaaatatctcttcattttttatgtcatctggaagtgccttttaaaactatgacacagagatggtgctgtatagtttacagttcatgtgtgtgtgtgtttaatttcattattgtacaaaattgttaattttataatcatgcatttgatagatgtaaaacagtgtgtcagcctccaagcgggagaaattaatccaaaataaatgaagctggatttctaaagtttagagcatcacatccaagattgcatttgggaacattctgttttgtatccatacacaaatgaatttctgtttttaagaacacaatttaatctacttagtggaaatcaacagcaaaatgaagagaaggtattagataattaataaatataggtttacagaaattctattactgactgctattatgtgcattaattacagcagaatccacaaaacatttccatcaaattaaatcttactctaggaggtatatgataaaaataaataaatgaacagagaaataacagcatactataaactgttacccaaatagaaaaatatatttacactatccagaaatctttggtaaaagttaatgaaaatatttcccctattagttagaagaagttcaagaaaacatacattaaaataccttcaatatgtgtttgttttactccaagatgtgatgttgatctgtgagaaattaattttgagcgttttgcctccactgccttgaaataatgcaaaataagcaactgagctgggggcagtggctcatccctataatcccagtgctttgggaggccaaggagggaggatcgctggagcctgggtgacagaataagactctctctctctctctgtgtatatatatatatatttgcaactgaagcacagatgggacacaggtaagtgggagaactcaccaagctctttgttagtatttagagtgtttcatagaaagttaatatttcttaacttttttttttttttttttttttttttacaaatttagaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattat

SEQ ID NO: 249 - DNA, 6242 bp, Homo sapiens
gactagtgtgtctctcccttagtatgttcctcctcagtttgaaaggacttcctggtaaaggactgaaagaaatgtccactccatcatgtctctgctgacacctagcttctcttctccagttataagtccattttcctactggggtaacacaagaaggaggaagaatagctcaggggtcttcccttcacatctctcctacaaggattgtgaaatgtcatatgcctcctcccatagacttagatagacctaaaattgtcaacatgtgtccagatagttgcaaaaaatatataatttccaacatattctccatattaacactttaaaataaaactgttaatcactcatatgttcaattcaatctaaatatcataatgttttgacacccattatcattaatttaaaaaatatacaaacaacctctttcttaatggttggaaattttacattgctcttttttcccactttgaattcatatttttattctaccccccatgtagaatttttctttttctttttttttttttttttgagttctcaaccctggttacatcctaatgtaatttttttctttgttcttggaaatcttttattgagccacctattctgcttctttgcaacaaaatatgttcttacattgaatttttaatttcttgttgtaagtgtaaaagttatatgggctgggtgcagtggcccacacctgtactcccagcactttgtgaggctgaagcaggaggattacttgagcccaggagttcaagaccagcctaggcacatagggaaacctcatctctacaaaaaaaaaaaaaattactggacatggtggctcctgcctgtagtctcagctacttgggaggctgaggtaggaggatcacttgagcccaggaggtcgaggctgcagtgagccatgatcgtgccactgcatgcactctaccctggatgacagagtaagatgctgtctcaaaaaaaagttatatggattaagataggattaccaactgttagagatcaaaataatgtcagtacagattggatatgccttatttgaaatgcttgggaccaaaagtgtgttggatttcagattatcttggattttaaaatatttgtatatacataatgagatatcttgaggccgggacccaagtctaagcatgaagttcacttatgtttcttatatacattatgcacatagcctgaaggtaattttataccatatttaaaataattttatatgtgaaatgaagttgtgttaagtacagtacttacatgtggcatcatattggtgctcaaaaagtttcagattttggagcatttcagattttctgatgagggatgctcaatctgtaatacacattttggtaaataaaagtgtaagtttgtaatggtaaaatttaactagaaatgcatctcttaatgagatggatagggactttattttcccaatttcatgttgacaaatgttacttattgttaatgaatctgggctgtatattatttcaattaaaaaattttaacatgaaagaactaaggaatcttgatcatataaatgaatgagaaaataaagacttgttgaggcaacttcacccaatttttaaaatttcttcttagtcgtatgcaaaactcacataatgggctattattaaataatatttttaataatctgtcagctgacaactcaagtataaggttcttcttcaattttgttgaaagcaaagaattagaaaccaattgacttgcaaaactatttttatacatacattaggttctttcactttgtttttagaactataccaaagacttcacaaagtcttataaaataactaataattatacctgctgctctttcccttagagataccttgttcatgaatctcaaattagataaaactagggttaaagaaaaacaaccccccacacacaaaattggagatcaaaaatcaataggttcttaaaaaatatctcttcattttttatgtcatctggaagtgccttttaaaactatgacacagagatggtgctgtatagtttacagttcatgtgtgtgtgtgtttaatttcattattgtacaaaattgttaattttataatcatgcatttgatagatgtaaaacagtgtgtcagcctccaagcgggagaaattaatccaaaataaatgaagctggatttctaaagtttagagcatcacatccaagattgcatttgggaacattctgttttgtatccatacacaaatgaatttctgtttttaagaacacaatttaatctacttagtggaaatcaacagcaaaatgaagagaaggtattagataattaataaatataggtttacagaaattctattactgactgctattatgtgcattaattacagcagaatccacaaaacatttccatcaaattaaatcttactctaggaggtatatgataaaaataaataaatgaacagagaaataacagcatactataaactgttacccaaatagaaaaatatatttacactatccagaaatctttggtaaaagttaatgaaaatatttcccctattagttagaagaagttcaagaaaacatacattaaaataccttcaatatgtgtttgttttactccaagatgtgatgttgatctgtgagaaattaattttgagcgttttgcctccactgccttgaaataatgcaaaataagcaactgagctgggggcagtggctcatccctataatcccagtgctttgggaggccaaggagggaggatcgctggagcctgggtgacagaataagactctctctctctctctgtgtatatatatatatatttgcaactgaagcacagatgggacacaggtaagtgggagaactcaccaagctctttgttagtatttagagtgtttcatagaaagttaatatttcttaacttttttttttttttttttttttttttacaaatttagaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcgtatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgacgcctctttttcttcctctttctttcaaaatatcttaatattttcaagccatggataactgaaactgcagaaagtgaaactgtagataaactattaactctatttaaacaataaaagaattataattatattcttgggaaaattaacaattatccaaagtccctttgcaaagggaaaaaaaatgcatgtattggaaaaaatctcaaccacagggttccctaagctttgcaaacaacaaatagcatccacctatccatcctcagagagcaacagttttactgttatttagaaaaagcaactatttcaggctgcaggttgtgcacatcagcacttcccagctctctactaatatgggaaaactgactatccctgacttcagtttttgtgaagctaaatgcctgactagagtttaaactgaggctaattggagatcataaaattttacagcttgctagaggtggac

SEQ ID NO: 250 - DNA, 30940 bp, Homo sapiens
tctgctctttctctttttcccatttaataatgaactttctacatttcagtatttatggcttttatttttacaaattgttccattagttattttctggtttactttgatattctctttataattctttgaatatttacttggctattttaagacattcttttaaaatcgggtcttttaaaacttctactcttttaaattcactgaggtgttgtgttttggccatattcaggaacttgcatttataaaagcacccccaaatttttgaaggtttccttaaaattagttacactattttctcttttactccttaacgataaaattttcaacatgatattaatacattcactgctaaaactctcacacttattgtttatatttcccctgataaacagatacacatcgtcccatgaagtttgtggcttgtcagaatgggatcacaagtctctttctttaaaacccatgagtccaacaccacataaattgtgcagagtgctaccgaaaattcagttacttcattctattttgtgggcttctggctgtaaaggccatgtcactcttcaaagaggctgatatcctgtagccttgggaaaaggcaatgtctccttaatgtttctattcactaaagtatcttgctcaaaccctggacactgcagattctaaaacagtatagattgtaggtgtctggtgaaacagtaggcactaaaacttagagaaatcacagttaaattcatcttgtgccaagtttaagaacttaaccctatcaacacggactcagtacaacgcagaatatgtcccacagggggttatgtggggcacagtatatataacagggggatatgtgtggtccaggaggtgagagaagcagggagagaagcaattgttgcattcctttgcttctgctgggcgctctgtgatgctatatataaaataaggtaagtgtgcggttgagtgggtagggagaaaggtgaggcatcttaaggcctggtggaaggtgactgatttcatcctgtctttgttatgcatctgataagcaggtttataaccagtacctgtcagtgttcaatatttaacaaactccagttaaacaggtaagaggtcagcagtagcttataggccttggttctattatccatgtgcccaactgcagccatcgtgggctggtgttaaaattttcctttcaattgtcatttttctaataattgcaatcagtgagaggagaagaaaaagttcaagggaatgacctgacctttcaccatcctacacaggagatgactgatgacatggattcatacactaatgtatatcgtatattctccaaagaccctcaaaaatcacaagaagttttgaaaaattctgagatcataaactggaaacagaaactccaaatccaaggtaacaagtctgaagaaatgggcaagcagctgtgcttctcaaattgtgtcttcaactaacagcattagcatcacctgagagctcattagaaatgtaaattcatagaaactctctgagctgggagaggtggagcaatctgtggtgtgccaaggactatagctgattgtggtgtaaactcaactttgaaaactactaagcactgaggtattaatcaggtgggagcaatgtaagtagagaactgcatgtctgacaatattgctttcttggctttctctcaggttttcaagaaagtttaggtgaggggataaaagcagctgcattttcaaattcagtgaaggtagagcattcgagagcactcctctttgttacggaagatatcctgaagctctatgccaccaataaaagcaagcttggaagctgggctgagacaggccacccagatgacgaattggagaggtacaaaaaacatgtgctgatcatttataattgctattccttgtacatttttgtaattcacataaatcagttttggaatgaagagacgatgaattcattccttgggatgaataaaggttgtcaatggtcaaaatacgccactttgcaatggtgggtcttttaacaagaagagggcctgggatctctagaatggaagggcacctagaaattacaggagtggggatgaaagttgttgtctttctttttgttttctacagcgagactcccaattttaagtatgcccagctgaatgtgtcttattctgggctggtaaatgacaactggaagctagggatgaataagaggagcctgcattacatcaagcgctgcctaggagccctgccagcagtctgtatgctgggcccagagggggtcccggtctcatgggtaaccatggacccttcttgtgaaataggaatgggctacagtgtggaaaaataccgaaggagaggcaacgcgacacggatgatggtgcgatacatgaagtatctgtgtcagaagaatattccattttacggctctgtgctggaagaaaatcaaggcgccatcagaatgaataaggcactaggtttccttgaggcctcctgtcagtggcaccaatggacctgctacccacagaatcttgttccgttgtagacaatgaagctgcttagcaatcttgggcaagccatctcttaatattaaagcagacaccacagaatagctttcttcacttacaaatgttgattgggcatttatgatatggcaggaactccttctcacatggagacctgatgttaaaggacacagccatgctcttgaggagcttacaatccaagctggaggcaggggagggtatagtctttaaatatgcttaagtgttgtagggaaggacagagttaccaataaacatgtaactagaaagccaggctcagttcttacctctgggaatcagaactctttatgaaacttgattgatagaatctactatctggaagataattgaagaactttaataaaattgtcaatagaatatacctaatctatatggatactttattggaaagaaatacccctgctatgtatagatttatgaggcaatggctatactaaagaatggaatcagtctcttagtttagtgactagcaaggtatcaaaggtgaagcctcagacaaatggctttcctaggctacctttcatcattgttatgcagaaaaggatctccagagaatcaagtgggctggtcttgcggcctctgctatggaaatgacatttgttgtgcctcctttcccctactctttctcacttcctcatcattagtgaagcatggcacaggacaaggtgttgcctgtgagtctggttataaattcagcttttgatgtttgcagcactgctatcttaaggggtcaagggcattccagggagaagagaccactaaggtgaagactggagagtgagtaagagtgagccatacagtaaaagtggaaaaatccagatgatggaaagggcacgtgccatgcactatcataataactttataattgaacacttatattacaatctgaatccctgatctcaaaaaaaaaaaaagaaaaatactcttcatgaaaaaaacgtggcctcatttggctctgctctcccaccctgtcattggagcttggattactgtgaacattgtagccacagcaaaaagaaaaaaaaatggcatttttactccttctgatagtctagattttaaaaaaacaaaagaaatcttaatagaattgtcttttggagtaaagtctaccagtattaaacaacacctcatctctccataaaaaataaacctccacaaaattgaatgtttatacttgatgcgatttgaaagtgtgcaattccagcacctaaagaatagtgtaggtcatggagtttttaagaaactccaattcatcttagaaggctatggtagatctgttacatcttagtataaatcaatccaatcagatttctaaactcctgagacctggctgatttgttacattgactgaaatgaaagcatggtctgagagagagagtaaacatgtcatttgggatttcaaagggtggaaaattcttacctaaaaaataaactcaggaacttggagtcatataaaaacagctatattttggcactcaagaggcaaaagctaatacagatgatgaaagaacacaaagaaaataagatttgcctattcaaaatggtgcctcgggcaggtcctgtatccagaagaggatgttcatccagggtctggggctaaggtcatcttagcacagcccagctgccagcttccctcctctgccgcttccctgaacacaagccagcttcccttatctagcccttcttggccctgttaaaaaagtgattcctaaaccttatcatgcacttggattgaaaaaacaacaagaaagcatgggaaagaggaaagaggattccttaaatatggcacaagtaagtccaacattatcaataaacgcactaaaaatgaatggggtaattttcttattaaaatatatgtttttcatactgagttaaaaacaaagtccaaaaagcatacatctctgtgccctcacatggtagagacagaggagagctcagactctcttccttttcttagaaggacttaataccatcataggggctccacccttatgacttaatctaaacccaattacttctcaaaggcccacctccaagtccattgggagttgggtcttcaacatatgaatttgggggtcactgtcagtacataagaaagcatatctgaaataacacacaagtgttcacggaaaggaaaaagatatactaaatgaatgtgaaactgaaaagcaaagtaataccatcaacacttggcaaaatagaacgtaagttgaacatctgctaaatacagaaattctcccacaacatagatcatgaatctgcctcaacacaacacaactacaaactatacatggcaaaagctgacggacatacaaaagaaaaatgcaaatccacagtctcagtgggagaactcaaaaaacttccctcagaaagcaacagatgatgcagacaaaaaataaagacaatttgccaaaatgccatcacaacttgatatttctggtgatgttggggttatctgcttactgtgtatttgagaacttctgttcacctgcttgtcaaactgaccagcagggggtgctgcggagggaaacactccatctggagaatgctggcaacttgtctcttaagtctagaggctccttgtccccctcatgatcatcacctatgaggtgcaagcactgctgatacaggagctaaaaagaaattattaagcagttagtgtaggtaagagagtcctcggtaaggtttttcttttaataaaaagcagcccccatataatttcttttctagcaaaaatcagcctaaaaaatcaagccacaagcatacataagcaaactaaaaacttgcatagctaaatgctggcacctatgcaaatagaaaagggatacttggaagccaggcatcctcaacatagaggtttcctcttcctatttttttttgtttgtttgtttgttttttcagatggaatcccgctctgtcactcaggctggagtgcagtggtgcattctcagctcactacaccctccacctcctgggttcaagcaattatctccctcagcctcctgagtagctgagattacaggtgcccaccaccacgcatggctaatttttttttcgtgtttttttttttttagtagaggcggtgtttcagcatcttggccaggctggtcttgaactcctgacctctcgtgatccatcgtccttggcctccgaatgtgctaggattacaggcatcagctaccacgcgtggcctcctattcccttttctttgtattcacgtgtgcaggcgacatggcacaggccaggtagaggccccgtttgcatactaaagattcatgtgggatggccaggctcttcatgcatcacataaatggcacacctgctccaaccaaccctctgagccctatgtaaatcagacactgcctcctcaagctcctctataaaaccaaccacaactcgccccaaacccggaaacctgctcaggcacctttccaatgcatgaggaaactctctcttcattcttttgcctattaaacttttgctcttgaacccactcctttggtgtccacatctcaatttccatactgtgagacagcaaacctctggcatttccccagacaaacgatgccgcttcactgccatctcaagcccaagtgccaaaaatgaccactttagtctgaagaatgccacagctgccaccatgctgcttaggataagcaaggacatgaagatggagtggggacgggtttattagagaggccgcaataaaagcatatcccaggcaactttccacttcttaacttctgtcattttcaaacttaaaggtgttttttattgttgttggtttgcttttctttttaacagtttctatttctggccaaaagactgctttttgttttcctgctatgacatatttattctttgttcaaaagtcttttccatgatttcatataggaactaagaagacagccatgtgtttgctcaacacattgatcccctctccacctagaactctctttactgtttctcccaggaagattccacccctcctgttctgccagtttcctcatatttgcctcatacaattgcccttgtaggcagatgaacccgggctagttctactttactatggacaccaaagcttctgaaataacatctgagtcttgggatttgcatatgaatcttcccttgacacagcaaacagtctttccttttaccttcactaaagtcatctacttgggagaatggagagcactaaaattctacagatttcaaaaacaaacctgctgtgcctttccagagtccttggaatgcaaaagagaaaataggttagaagggatattttctccttcctttcttaccttgaaggagctcctatttttaaagggaatcattggggacaatccaaaagaaactcttgcaaatcaagctttgccatgccatcacgagaagggtaacatgtgtgcccagtggtgaaatttttaaattttggtaatgatctccagggtcacccctatggataacaaaaatattttaaaaacctataatggtgccagcctttcagaaccctgtctctttgcaaggacctaccaaggtctagagatcatagcacctcactagcagcctacaggcattctccaaaggttcccacctgccccacccaacatacacacacacatacacacacacacaccctcctgctatcctttggccctagatttcacctaactttattctaaatcttaatcaccctgtgcccccaaactcatgtgttatagggccttggtaatccctttctaagcatattccctgacttcttaaattctatttatgagacatatatctaaagtaaaactatatttcaggccagatcagcacgcttcttattacaattataaacactgaacttcttagttgctgggaaaatatattgaaaaggcattattatgcttgtatagccatagattatctagggaaaagtattgagtgtctcgagaatgagtgaaaattgtttccccaatatacacctttttttcttttgaaaagtatatcctgcgtatattcaaaagataatgtttttcaaaaggggaaattgcctccactgtggactcttattaattcacttatccatcaagttctcttattaactcacttatacatcatattcccttattaactttttattcaatcactggtatttgtttctagtgctcataattgaacacaaatttgtttactattatataaaataaagtaacagctattcaccgtttcctcctttacctcaataagttgacatcttccaatagatttatttccctgttttgctccctcctcagatccagatgagtgtgctaagtgatacaaaatgcttttattcctctaccgttcaaccccctgagcccgatgttttagttccacgtgttttagttccaggtgtcacagaatttcccttgcagtgtgtctcatcaatttaaagaatccttctttaaaacttttcttacacattcccagagagcctatcattgtccatttagagttaactctctacataaaatttgtcaatttttttttactcaccactgtttcctctccttattttctgctcctatctgaaatctcttttcctatttgattaaattgcttcttcagtatttcctgcatgtacatatgctaccgatataatatctgaagactctcaaatccacaaatatctttctttgaccctcacaagaatataatttctgcagccttatacattgacaaatgtttgtcttttaccctcaagtgactgattccctatgacatcacattttaggatgaccaaatataattttccactttatacataaggaaactgaggtacaaagaaacaaggtagccttgaactttcattcaaggtcacaaagctagcaaaaagtggatgactagcgatgaggtcttcaggttgagattaacaaacaacatcacaggatataataggatttaacccaacttcaacttcataaaatgaatggacattccctgatcttccctccactcccacccccacctcaggggatttcaggatgcactgggcaaaactgtctccctccatccccaaccgtttctcaggcagtgacaggtgtcaagaactcctcgccgcccttcttgaagcttacattctggagcagggaggcagaagctaaaccaaaaattaaaacaactgtgaacatattccctataaactcagatgtagtatatgaaaacaacacatgatttgacgacagaagatgatggagggagaaagaacaacaaataaataggaaaagaggcctcagataggagcaggtaaaaaggagagaaaacaggaaggggtcaggactggtttccctcaaagcctgtcatttgacagagagctgcagaaagaaggaatagagccaagcacataacaggagggtagagttgcagtctgaagcacccaaaatggtccactaggatggacaaaggacatacttgaaccaccacttagattcatcttcatctaaaaaataagaaattaagtgtgtgtaatatttaattatttagtacattaattacagtagaatatatagagttgatgctcaatttgttaaaaaatagatatctaaaattaaacctcagagattactcttgcctatgacaacgagcttctgaaaggcaaggataggtctcacccatctctgtatcttcagaatccatcatattatgtggaacataataggtatcaatagtatgttggggaaaaaaatcgaaaccatgctgagcaccggaattctgtgtaaatctttttaaaaagtctcttctactttacatcagagtcccttttgtatttttagtatcatccagccccacgccttgcagataagcccctaagaaatgaatgggtgaatgaatgtgtggacagcgggatggatcattgagtgaggagcagtgattcgcaggacctgcatgcattgaaatcctgccaaagcagcctctgcaaaataaaagaccttgggctttggtttctgacacaagttaaaattatccaaggactctccttgggccacttagttgaggtttcctaatctgtgaaacagaaaatgaattcaatagaaagatgattgagacaaatttctggaaggtgccaaagcaggatgcctggcattgagggacgcttcacacctgttatctctctccctattctctcttcacccctactcccgcccggcaactccccgctgtcagctccaggaatacttacctgctgagaaaaggaaaagcacaacactgactttaccccgcgacgcttttaaaaactccaaaacacccagcgcgatggggagtaggtttccctaaagacaggtggagcagccatagttaacttagaggaaggtgaattgacaaagagggttgagccactacgagcgggagttaccttggactaacagttgtatcttcagcgagcacaagtcctggaatctcccacgcccatccctttttttagcgccacaaatgcagcctcctaagagaatgggaagcttgggagtcagagaacagaagattgagctaccattggccttaatggatgtcaatcttcacttgtctcttttttttccttcctcgcctccttgcccctccctatcccggtaggcgcgttctctggcgccatcatatggcagaatgcgggactacaccaaatgcggaaaggcaccttccccttccctgagtatctgcaaactcagggctgggcttggtttttaagagctcagctcctgtgccaggggcggtgctaaaaggggctgcctgcgcagatgtcattcccacaagatgcaagtaaagaagcaccgcggacaccgggggagggtcacagagtgacaggaggactggttgaccagctgactggcctcacttctgacaaatgcaaattacccagccacagtccaaccaagggtatcaaaacaggatctctgcagatggagctcagtgttatgtgttttggatgctcgcaataagattttcatgcaccataaactttcctgagtatctcaaccagttttgttgatgccggggtttgttcaaagctgcagattactgggcctcaccccagacctactctacttaaatatagtggggttcccataatccccattttaaaaaacctatccaagttaaagtacagagaatcacaaactggaagaactccttaatttacaaataagaaatggagacccccccaccaagagagaaaggaatttgcccaaggtctccctgaaagagcctaagaaagcgtgaggctctaaggttaaaatcctacctgacaccctttcctttccccaactagtcctgtgacctctagcaaactatcctgtcctaatctgtgaaatgggagcaacagtcacacctaccccaactggtgactgcaaatattaaatggggccacaatgagtcaactaccaagcaccaccccattgtaagttgaggttgaaatgattctagatcgccctacccccattcatctcccagtaccattgtatgaccgtggaggtgaaaccatccagccgcctgttggtcccaaaccatgttcacctccacccgtggctcagtgactatttcttttcttgaagagagagagaggctccttggagcctctggaatctggagggggatgttaccttccccctgtgtgcattgtcttcccaagataggatggactacggggtctccatgtgaagagttagctgccagggcatcaaggatggctcctaagtggttgctggaggcttagagaccccactccagctctctctcaaatgggggcagcttgtttgcagcagtgagtgaggtgggcccactacgaacccacaggaggagaggaaaagaccgtcccatctaagcttttacataacccattgcaagctccagaatgtggtgcccaggcccatatctataacccacccccagaggccagttctcctcagcctttcctgccacttctgccattgtacatccagacacttcccctgttctcttctatcaaactcctactcatctctcagccatctagtccaaatattaatctttctctgtgatatactctcagggtagaggcagtggtgccttcctctgtattcccagaacatgttgtctgcaactctaaatacagacatcatcctactattagggttcaagagcatcttttatgggttcatgaaggaatcactcttcgtaaacactggccttattccctaacttcaccagacctgaccttagtgcatgatccattcccacctctcccaaccacatgagaggccttttcctctttatgggtttgcaaaccacaatatgacctaaccaccagttactggccaaaagcattcttgtcacgtttattataaaatccagccaacaagatgctttgtgccaagggaatgttccttttcagggcaaacactctgtccccagggatgttagacaacttccatagccccgtataagcattagctagaaatgagtttttcctagtggcccaacagattccctgagcatccctactctttcacggattcccattgcagtgggattgcatcaaacctctcagggcaaagctgcaaagggaaaagcaaagctagagctctactctggacctatcgctctagacagttagtttctctgtgagggtcagttttatacgtaaggaagaaatggaagattgctccccaaaacggcatcaggttacttatcccaattgtgtggttcagttgctacgccagtgatgagcaaataaacaggaagtagaagcacaactattcctaagctcaagaagcagggaagctcaggaattggtgtgcagcagtgctgcttggagcgccattacgaaggaacaagcacggtccactgggaggtaaaattcagggaatcgaagacacagggggtatgggaaacaaggcaggcttttttatttatcatttgccatgatatctctctgtgaactttcttctcccttttaattttccctgtactttaattataattcttaggcctgacgtggtggcttacatctctaatcgcagtactttgagacgctgaggcaggcaaagcaactgaggccaggagttcgacccagcttggccaacatggtgaaaccccatctctattagaaaaacaaaactcagttgggcatggtggcaagcacctgtcatcccagctgctcaggaggctgaggtatgagaatggtttgaacacaggaggtggaggttgcagtgaatcgacatcatgccactgcactaaagcctgagcaatagagcaagactctgtgtccaaaaaaaaaaaaaaaaatacaaaacttctcagctaatggccaacattgaaatacaaaacttctcagctaatggccaacattgttaccatcataagtcccagcttccctgtcttcctgtcatcatgtgttgaatgtccacttccctccttatttttcagttggagtggattagcatcaccaattcaacatgtcacaagtagaattacacaaacacacataagcaccgcaatcctggcacacacagcatctctgtcctcagacttccccatccttctagttgctcaagtcaaaagcccaggaatcatcattgagccctctgtttctcttatttatggaccatccataagcaaattccatgggctggcccttcaaaataaatgtggaatccagccatttctaacacttccaccattaccatctgaggtcgggctccaacatctttgcaatcctgggatagactcttagctgccttctcccttccacatctcttcttgtcctcccagagtttgtaccgcgcacaaacgctgctagggtggttttaaaaaatatgtcagggtatatttctcccttacttcaaatcctccatttaaaataaatttcacatttatagccaaatccagacttcttcatatggcccaccaggggctttatgctaatggaatgtgcagatgctcctccctgaggagcaccttttaccagggcaaattttctatctccaatgatgtcaggcaattccgacaacaccattctctactacctcttggttttcatagatatttttcctccagattctacaaaaaaagaagatcaagtctccttgtgcaatgatttactctctgatgtatattggtgccaggcacgtgtactgctttcagatgattcaagaataacagcgatttgagaaagctgtccttaagttttctcttctccttgactgtatgacattatttttacaattatacttccaaagtttgctctttccaaacaccacaagacctatgtaatttaagcagtgattttaggggtctctgtatattttatattaatttcagaaacatgctcatgattattccaccaaaactatcaactgttacataaacatctgtccttctatgagttgcaaaataattgtcaccatccccacttaatcaaccatcttgtatccttctttgaccaacttctgaaaaataacacccaatactaaaggcatctccttctattcagggtctcagacagtaagacgttctttccttaaacagtaagacgttttctcaagtcccatggaaagcacttctttgatatcagtttggggaggccgaactctggagtcttcatccgaagagtaaagtaccgcactcagtaatgcgcgtcctgggaaccaagcctaagcagttttggccgcttcctcgtccaggctggcattgtctgtgttcgccagcccctccgcgaagttagctcatttgcggatcaggccaaatccctggagacttcacgcagacgcgggtgcagcctgctctgggacttgaagtccgctggagcctgagcctctgcatcatccgggtggagctctctctgctgctgccaaaggatcccgcctggatgctcatcccgccaccgtcgcccaccccgcagctgcagaatggcagcaactgccacacacctaagcaacttggctggctattcgccctgcagctcccgccagcgcgctgcccaagctggcaatcaaaagtctgggaaagcgcgaaagcgccacgtgcctcgcactccgcccagctgccgcgcagctcctccctggcttccactgggagacaggggactcccatgagaaggaaggagcagggcagtgattgcttagtttatcctgggacgcgggagctgtccccgtggactgagtggcgcggagaggggatcactgagaccgggaagggtcatccagacaaataaggaggggtgcgggtgggcgcgcagtgccctccgcccggccttcagacccacccgcgcgcgcgcaggcgtgtgctctcatccttcccttcccttcactgtctggagtgatgataattggcttccaaagtggatgagagatgagtcatttacatccaatgagggaaaaacagcctccagagactcttcgtccattggccagtgagagtgtcaattcccaggctcctgccgcacgcgggcgagcccttctaggcgggaaaagttcagctgagagatataagagagcagactttccagcacctgtgaatccagagcggtgggcactgacgggcacgtgcaccgtgtggacagactctccagttctatgagtggtttttcttttcccgggtcggacctggagttcttaagaggatggctgacaagggcagtaggcagaaggacctcagcccaaagtcaaggaggttttggatggggagctgggcagccgcccgttgtaattcccttcccgtctcagcttcaaaggccaagagttgtactcctgaaaagatacttggagatcatctgggtgttcctgaatctcaagagggtcgtttgaccctggtgggtcctttccctacccggtgcctttctcgcccgtagaaggagaccaggttcggttaagcagagcagaaactattcactgatcaaggaatggagtaggagagctcctgctcaaagtgcctggggtgtagtgtgggggtgctccttaaggtcttttagggcacgtagttggaaagcaaggattcctggaaagagatggggctttccagaaccagctgagtgtggcagtctcctatttgctgttgccgcccaacactacatgtgcctagcaagctgcatttctcccgtaggcacagattgaggtatggtaattagcaattgaggattcaggttagggtagcgcttctaagttcgtttcccatcttgtagcacggtggttactgacatccagtctctgtttctgtaagcaagcacagcttcaagcacaggttaccttaattggttctggggctttaggaaagcattgaggtcatcctgcggtgacagaggcagctgttcaaagaacttggtgcgagtttgaggcaggggttgtggagtgaggcaggtaaaaatgcagattccatagccacaccccgacatactgaatcagagtctgtgagggtgggatctggaatcctttttaaaaagctcagaggaaccaattcacacgaacaataaaagtttcatctgagccaaagaccttaatctagaaatgagaaaacggggatccccaaaagggttacagggagagggttggaggaaagttagactatgacagttttagggtggttctttcctggccttgggaagttttctcagctgctgctctgatcagtacgcagctgaatgctttaggggaaccctcttcatatatccggagttccctctctgtgcaggtctcccaccagggtctgtggcccgtgacctcttgccaccctggtctctccgctttgtctcctcaaatctagaattccaactggctttgtcttgctgcccttccttgcgacactggcctggaatccttcaagttagtctgctagcgtggattgtaggatgcatctcagttgtcactatccttaattgcatgatgtccagttcctcgcaaagcgttgtttcatatattttgcccatttttgttttgttttgctttcagactagggggaaatccagtccctgttcttccattttggccagaaattcaaggtaatgacttttaatatttctgactactagttccatcatctctctcacttctggatctgtctctattcactgatgttcctagtcattatgggtcatatttatccacttcttaaatgcttgctgattgttttattagatatcaagctttgttaatttcacaactttgggtgccagaaatttttaccttcccatcaatattcttgaactttattttagtaccttgatattttacatggaaaccattttataatttcaaagtttgcttttatttgttaggtgggagcagaactagggctaattttgtcccactgtggaagaaatacctttcagagtagtctctctgatatttcatgaattgtgaaattttctagtcagatttttgtgaactgaatctattccctgtcctgtatgagcctcagaaattgttacatctgctccttttgggtacttctttttcctgttccttttcaacagctttattccactcatgcattgaccaagctgaaatctcaagggatacccactgcagatctctgatactatgtgctcctgtggctctcttctccctagtactctgccatacaagctccagtcagcctggcctcccaaaactccaagcttgtcttctcaactcagggaaactgctagactctgcctgttctcttgcctaagatatgccttggaaactccatacagtaacctaaatagccacagggcttacctcatatgattttcttctcagatatcagagatgaggtcccacacagcctgatgtccaatgattgagagttgttatttcacagatctttcctttttgggttttttttagacatttcatgtggcagaatgaactcaatccttgtttctccatcttatccactagtaaatattagttatattctcttcgaattcatcatgaattccatgaagactgaagaaaacaagtcacttagtgccacaaaagatgacccgaggactagacctgaagtttcaaaggtatatctacttttttacaactcctcagaggagtgatagtctaaccatagtgccatatgaggttcttggagataagttcttaaacaatggtcgttataagcctttctcttaggtagtttaaaatatatttgggtagctcatacacataagtgcttgtggaaagcataatgatagagtatgagttaataatgctaaacgtgtcttaagacaacaagatgactaacaaataatatagacacttaaaatcatggaaagtatagacaggcaaaaataattagctaatgttttctgaggaaacactgtgtgcctggaattgtgtcccatcatatggattatcccatttaacagttaatagaactgtgcagtagttattatcatacttattttacaaaagaagaaactgaagctcaacttgcttatagttgcagaagtaacggacttcaaagcaaggatcttaacctaggcagtcagactacagagactggtttttgacccacactattttgctcaaaatatgcaaaatgataatactaaattgagatataaacaagtgattttagagtacagagagaagaatacttaattcagactaaggaaactacagcagcatcatatgagaaatgatttattaatgaaaaataaatctaaaattgtcaaactcatagatgtagaagtggttgctgggctgggaagagagaaaaatggaagtgttagtcaagggatacaaagtttccttacacaaggtgaataagttgtagggatctgaacagcatgagtgccaatagttaacactattgtgcactcaaattcttgctaaaatgatagattttatgttgtgttcttattacaaaaataataaataagagggcaggaagagactttgggaggtgatagataggtcgatgtcatagaatgtggtgatcatgtatcttcacattcatcaagttgtatacactaattatgtacattaattatgcatttggtatgtctaaaactaatttattttttaaaaagaatgaataacatttcactagtgtatcaaggatgaaggaatggcctgagtaaagtcatgtacacaggaaaacatatttggggaacaggatagctgcatttgatgctatgtaaggagaattcaagaatgtggtaggcaaataatgctttctatactggtaaggtagtgtggtgccaagatcacagtaggctttatatcaataagagcttttcatattgacagtaaaaatattttctacttgtgaaacaataaaatggattcattggttcacctgagtggacattccagaattcagcagagctcttaattcagtagtatacagtttctttgaggacttgtttgtgtgttcagtctctatgttctgcttttcatgttatcccctggctggctttctgcatagtgacaaatacagctgcagtaatatcggatgtgttactctcccgataatgagtctaccctggtttcctgaggaaacttctctttgccatcttattgtcccaacttaagtagctcacccatttcagcacaaaaccttgtgactccgagggcacatatagatattcttaagctgtcatgaattcatttccatacatgtatggctcctaaaaagtgtgagagaggtagaatagctttctggaaaatagctgcagtatctcctacttctttgaaatccatgtgtaggtttttggattttcttctgtaaatagaggagacgcgtttgccgactttatctctgtatcgcttaggaggagttatttaattcactttagactttgttaagttaaatattaatgttaaaatgcccagggctattttgttcaagacagttgccactaatcacgtgattttttttttttttttttgagacggagtctcgctgtgttgcccaggctgtagtgcagccccacgatctcggcttactgaaagctctgccttctgggttcacgccattctcctgcctcagcctcctgagtagctgggactacagggatccgccaccatgcccagctaattttttctattttttaggagagacggggtttcaccgtgttagccaggatggtctcgatctcctgaactcgtgatccacccacttcggcctcccaaagtgctgggattacaggcgtgagccaccgtgcccggcccacatgtgattatttatattcaaatttaaattcaacttaactaatatcaaataatgaaaaaggtgaataatacaaaatctcagttgcactaatcacacgtcaagtacttaagaaccacctgtgacggtagtattaggcagtaccgatgtagaacatttccatcactgcagacattttattgggcaatacttgtttagggcatccaattatagaatagaactacagtgtaaaactgccaaactatttgtctagaaaatagaatgagaggaaaaaatcaaaataaaggaggcaacaaagcaaaggtttataaattgtgaaaaagtggaaaaagtaggtgatacaaaaaaagatgatagaaataaacgcaaaacacgctacacccaattaattgtcttacagattattcgaaagactttaacttttcttgtttcttttaaattcatttatttcatatacagtaaaattcagtctttttggtatatagttcatgtaaccatgcctacagtcatgtaaccatgaccaaaatcaagaagcaaagcagtttcatcacactaaataactccttttgtggttccatcacaataaataattccgcgttctccccactcatcccctattcaccctagtccctcgcaacaactaatctcttccttactctagtgttaccttttccagaacatcatataagttgaacatacactgaatcatacactttgagtctggcttctttcacttagaacattccacttaagattcatgggtgctgttgcatgcattgacagtttttctctttttattgctgagtagcattcccactgtgtgaatgtatcaaaaatctgtttatccattcactcactgaagaatatttgagttgtttcccgtttggggagtttgtaaataaagctgttgtgaacatttgcatacaggtttttgtatgaagattagttttcatttctcttgggttcacctagcagtggaattgctgtcatggaaagtgtatgtttaactttataagaaattgtcaaattgatttcaagatggctgtgtaatttcacatcctcgataccaatgtgtaagagttccagttgtttcatatacttttcaacacaaagtttttctgattcatttattatcataggtatgtaatgacatccttttgtggtattaatctgcatttcactaatgactcatgatttgagcatcttttcatgtgtctatatcatccacatatcttctttgggaagtgtctattaaaatattttgcccatttttatactggttacttattgctgagttttgagagggctttacatattttagaaacaagtcctttgtcatattgcttttctcataacatttgtgataattgctgatattttatctctgtatagcttgtcctttcatccccttagtcctgttttgggagggaaaagttttcaaatttgatgaagttcactttctccatatttctctttgtgaatcatgcttttgttttttacatcagagaattctgctaaatgtaagatcacaaaaatcatttctaagttttcttccagaagttgtatagttttaggtttaagtctgcaattaagtcttatttttatttttttgtatggtgcaatacctggatcaaagtttgtgtgtttgtgtaaactgtgtgttaattgtataaacaagttatctcaatagtggatgattagcgtcttatcattgctgagtcttccaatcttaaacaaggtatatttctccatttattttggtcttgtttaatttcttttgcttcgaggcacctgggagaataggcaaacctggcggatgaaggcagattgggcagtgggggggctgaaggggcaatgggactggtgcacaactctctccaaggccagcagacaaggcaagaattagaaagaccggaaggacaaggcacgagtgacagagaaggttagtgatcctggcatcatgcagcttgaagattgtccagtaaactgtgagtggctcctcctagcagactttctactattacctctgggtttctggagtgtgtctgcactgtcttgcccctttgaccagaaacccttgcttcctccacactccctgaattcctcaaaggacaaacctccagcactggaatctccctccccagacaaaatatctgcacagatgtagtcacgtctccatcaggggtccccagagttacatccccctggaaactgaatggtcaagataataagctattgggacttttgtatgccaaatgcgacagtctgctgggcactttatcaatgtcttatgggagtctcaccacaccaggaggaaaatgttttccaatttagctttctttcccacgcccagccatgcactttttgcatggccatacctaaagactgcatttgcctccttaaggttagctctcaaagctcatggagatcacctataatatgacttataattggggtttgccagccgaatgagatctcataggatgaatatccagtttgtttggtgacggtgcacctgactcagaggagcacaacgggcgagacctgatcccacctcagatgagtttcctgacaaagtttcttcagcagctgcttgggtgtccatttcatgcacttcacttttcctgagctctgtggccggtaagctgagtgtaacttccattttatttttaatagccgagttaagtcctgaagtatttcagccacaaatgctggtccatcgtctgacccaagagtcagggttagtccaaatctgggaataatgtcttttaacaacaccttggttacctctcatgctttctctgtcctggtagggaaagcctcgacctgcctcgaaaaggtgcaaatgaacaccaacatgtaccgaccgagaacaccctgctcaaggcagctctttaaaatccagcattgtgtgtgagtggctccacaagtacctcctagtgcagcccctcagtttaaagaggaaagtgggggaaaaaagaaactccagaaagctttaatgttcttgagtgattcctttacgtaatgagcatggttttaacaactggagatgagcctactttggaaacagcccctcttaccccatgtttattgttagggcactcctttatccactccatgcccaatatgtctcattcccaagtagcaatgagttaactagaaatttaacaattttctacaactttacacttagattatgctttgttataaatttttacacccttcttctgttaaagatgcagaattgggctttaaaaaaaatcattggatcaaataagcccttccctttccacttgactctgggaatgtgagcagacggttcttaagatgttgagttttgtctactatccactgctttttagccaggaattctctagtgatctgaagcaatgcaactgaagaacactttttaaattatgtgttgacaagttgccttatatataaagaggaaaaaaaattacctggtttatattatgccagatgtcagtaacatgaagtcctaatttattgttctcagttgttttcctgcctaatgtgaacttccgtgtccctgagccctcaggagtacctacagcttatggtgcaatgtcttctcccaaagtgttggccaccatttcacccaagggcctcttccaattcttgcttatctgagtcagatttagagagtaccactgtctccccttatcccttacttcatctccaaaccacatactcgtgctatacttttcttctcagtacctctccctgaatggtgagctgccattttaggaaattggaccagataccaatttgggagctttcagtcaaacaacctcaaacccatgtcttcctatgaagaggtgcaagtctctgaagctctcactcacccctgcagtctgtgtagaaaatgtactgtaatccccctggcccccaactgtcattgcctttggtgtgagatattccctatttcctagtttagcttgagtccctctctcctctgctagccaacccccatccagcaataaggaaccaagcgacagcctcctattcacactccctgcctcctttccacacaaccctagggaatacctggattgccccactctgtccacatactgtagcattcattctctatcatcctctcacctgtggtggtttatggatgtgatagagtttttaagattactacaaactagtaaaaaggaaaagcaactcaaagagagacaaagagagaaagaaagatctgttcagcgtctttgcccatttttaatttggattgtttgttttcttgctattaagtttctcattattttaaacattaaccccttatcagatgtatggtttgcaaatattttcttccattccataggttgcctcttcatcctgttgattgtttcctttgctgtataaaactgttttagtttgatgtaatcccatttgtctattttggccttcgttatctgtgctttagggattctatccaaaaatcattgccacaactaatatcacgaagcttttctcccatgtttttgcctagtggttttacagtctcaggtcttacatttaggtctttaaaccattttgggttgatttttgtacgtggtgtgagataaagtctaatttcaattttctgcacgtggatatgcagtttttttcaacagcatgtattaaagagactgccccttccccattcacatgttcttgacaactttgtcaaaatcaatcatcttaaatgcatggatttatttctggacgttctattctgttccattgtttcatttttctgttttgatgctagtaccatcctgttttcattactattgcttcttagtacattttgaaattaggtagtgtgatatctccagctttattcttgttgctcatgattgattttgctcttaaggatcttttgtgataacatatatattttttggtgttttatatttctttcaagaatgtcattggtatttagataggaattgcattgaatttgtaaatcacttggggcattgttgtcattttgacagtattaatttttgcaatctataaataataaatagctttctatttatttgtgttttcttcacttttttcatataactttcataattgtcactacataagtctttaaccaccttatttacatttactcctaagtatttattttttctagcttatgcgaacaggatttttttctttgtcaggtctttcattgttagtgtatagaaacactactgatttgtgtatattcattttgtgtcttgccatattactgaatttgttcagtagttttaacctagtttgctgcagtctttaggattttttatatataggaccatgctatatgcaaacagggacatatttagctacttcctttccaatttggatactttttatttttttctcttacctaattgctctgagtagaacttccattaatgcactgaatagaagtagtgagagtgagcatccttgtcttgtccttaatcttagaaaaatgtttttcatatttcaccattaagtgtgatgttaactgtggatttatcgtatatggtctttattgtatgagctacattccttctatacctcatttgttgagcgttcataatcaggaagtcatggtgaactttatcaagtgctttttctgtacctatcaagtgtcatatggattttgttatttattctgttgatgtggtatttcacatttatggatctgtatgttgaactatctttgcatccctacgttaaagcgcactgtatcatgatgaatgatctttttgacatgttgttgggattagtttgttagtattaatatttattgatgcacctatgttcaatagtgctattgcctaatattttcatttgttgaagtgtccctatctttggtatcaggattatgcttgccttgtaaaacaactttggaaatattccctcttcttcaattttttggaaggcttttagatggattgacatgagttcttctttaaatatttggtggaattcagcagtgaagccatcaggtcctgggcttttttttaatggaatattttttattactaatttaacctcctaactcattattggtctgtttagattttcaatttcttcatctggtggggtttatgtatctaggaatttacccatttattgtagattatctaatttgttggcatataattggtcataatagtctcctgatttttttgtgatgtaagttgtgatgtctcctttttgtttatgattaacctttttttttctgttagtctggataaagatttgtgaatcttatttaacttttcaaaagatcaaatttcaggggttttttttcattgttgtcatagtttctatttaatttaactgccctgatctttatttattccttcattctattaactttgggcttagtttattctttttatagttccttgaagtgtaacattaagttgtttaagatctttcttctttttcactgtaaacgttttgaagcatctaacaagttttggtattttgagtttccatttttgctggtctcaacatattttttaatttccactttaatttcctctttaatccatctgttgttcagaagcatgctgtttaattttcatgtatttgtgagttttctaaaagttctcctgttattaatttctactttcatgtcattgtgatctggaatgataaatggtatgatttcagtcttcttaaatttattatgacatgctttatgtcctaacatttgttctctagcatttcctgtaagacagctctgatggtaataaactccctcagtttttgtttgtctggcaaagattttaatctctccattatttgcaaaaaacagattttcccaggaacagtatttttggttgacacttttttttctatagaacattgcatatatcattccacactctcagcctataagtttctgctcaaaaatctgctattagccttcttggaactcccttatatgttattggcttattttctcgtttgttttcagaatctttcttttctttgatttttgacagtttaattaaagtatatcttgtactcttgatgagactgaatcttatcaaacatcttcaatgttcctatacctgtatatttctctttccgcagacgtggaaagtattctgctattatttcatcagacaagcattctttccctatctgtttctcttctctttctgggacacacatgatatgtgcattggttctcatactgatgttctataattgccaaaggatgtcttcattttttctcatttttttccttttgtgtctctgacttggtaatttcaaatgatgtgtctttgagttcattgattctttattctacttgatcaaatctgctttcaaagaactctatgaaattttcagttcaaccgttgtgtcctttatgtccagaatgtctctttttttatgatttctttctgtttgttgaactttctattttgttcatgtattatttctctgattctttttagtcatccatctgtgttttcttgaaactcactgagcattttaaagaccattattttaaattcactgtcagaaagttcataaacctttattttttggggtcagctattggttattctttttttttcctttggtggtatcatttttctcttatatttcttgatttttaggctgtgcattggtgtctgcacatttgaaaaacaagaaagttattccagtctttgcatactggctttgtctggaaaaaccttttcccagtcatccagcaattcttggtagggtgtctgctgtggtctgcaggtgaacttgttgctgaagtcttcaggcaggctggcctggtgcctgtgtcagcaggtggtaggcttggttcctgggtctgtagagttgggcctgaatcctgtatccactggttggatattttcattgggtatgtggggatgaacataaagcctatgtctataagggcaggcatacagcctataccaataagggctggactgaagcccctgtctacaggggctgacatggctctgatgtgggcaatgagtctgtgtctacaagggctggctaggttgtggaatgggcctagtgtctgggtctactgggatgagcctggaatctgagtcgatggggactggcctggtactggtgcaggattagagcctgaatctgaagaaacgggcctaggatcttggtagatgggagctgacctagagcctgtgtcttcagagatggtcctagagccttggtgcatgatggccagcctagcgtcagggtctgctgaactcagcctgtacactgggtttgcaagagcacagctcggctctgagtttattgcatcctgggtcacaaaaaccagcctgaaccctgaaattggcctagggttggagtggggttggggccagtctagagcctgagattatagctgctagactggtgcctgtagccataggagctggcctagaaactgcggaatggcctggaggccgggtgtgtgaattctggcctagaacctaggtcttcagggctagcatggagactaggtccacgaaggctgcctagggtcccagggctggaggaactggactggaacctgggcccacagaagcagtgctagatactgggtctgtgggcacaagcccaatagtggagtcaactgtgatgggtctggaccctgggtctgctggagcatgtgaccctgggaactggcctcaagagtggggtggcagaaattagctgagtgctaggttggcctgaagcctgtgtctgcagatgcttgccagatacctagctaagggctagtgctagggctgcccacctggaactggggttggcctgaatcctggatttgtgtgagccaacatagttctgggctggtctggaacctagggtagacttggagcttgtgaccacaggggctagcctggcactaggcagtcctggagcccgtattcacaggggccagcctggaggttggatcgatggacactggcctggtcactagagttcaaggggccagcctggccctggggctggtgtgaaacccggagttgtggaaggcagcctggtcctgggagcagtctggagcctggagtcactggggctgggctggtcccagggagcatctgacacctagggcactggggtagatctggcattaagatatatccagaaaccatgtctgccaggcaagtctggaacctgggctgtgggatctgctctggcttagtctgcagctacgagcctggagtttgaggccatagcggcatacctattactgtatttcactgaatcaggctgtgtttccgtcgaaggcaaagttcagtgcccacttcccttttcttcttcaatacaaaggttgcctctctctgtgctctgctgtccgttattgtgggagggatgacataggtaatgtaaaattgttcttcctatgctcttcaattcatcttttcttatttctctgctacacaaagattctgtgttttttcacctggtatccctagctcttgtgaaggtatttttgtccacagatagttgtttaaattgatgttcttgtgtgaggataagtactagaaagtcccattctgacattttgctgatgtctagttgtgtggcatctcatcagatttctaaatagtgattttcaaagtgcctcagcagcatcagagacaggactcctgctaatttggaaagaaagatggcaaaccttatgttaaatgatcttaccaaacacatatatgcaaacaataatgataataaatagagcagacaaaacttttggaagtgacgaatatgtttatggcataggttgtggtgatggtttcatgagtatgtattcatctctatcttcatcaaggtttatacattaaacacatacagcttattgtatgtcaatcatacctcaataaaatagttctacaaaaaaaagaaaggtaaacacaacagaggaaaactactgttggcctatttctcccattaagtatgacttgtatttcagagttctgatggttactgaatcttccagattttctgatgataagtataataagagaaataacatgttaggctagaaaagataaaaatatgtatttgaggattaatcaatcaaattttcccttaacataataggacttgttgttcaagatattcaagccagtaccaggctagagggagagaaaagttcccagatcaaatatctgtgtaaactaattcaactaaagccacaagaggaagagactcatgatgagatatttggaggtacaacatgcaaaattcatcacaaagtggaaaccagcatcttacaaaaaaagaacaacggcttgggatttagaacgtctgggctctggtctcaagttttgcacattcaatcatgtgtctatgcaatcatgtgtctacattccaggacttagtttcttgagactagaccatctctgataaactttctacctgattttcctctctttcagaaagttaggcaggtgctcagatcaactttttcgtcacaaaggaggaaggaagaagactttgggtgtctttcttaaccacagttttatgacatgggtttagagaatgcattagcagggactaagcaaataatgaaagctaaatttggtgtagaaaaatggggaacagaagatgaaagaatcagaaagaaaatatttaggagcaacaaagagagtcctctattgctttgtagtatagcgaaagttcctgtttttctcttctttagactctaagaaaaccagaaaacataagacagctttagagctttaaaatgttcttggatgccccaagacaagaaagcatgtcctgtggatcccacactttcccaattccctgatctagctaaaaccatatacaacttcctgatttccctggaggcattgaacctcatcaccaacccagaacagtttggcacgaattggtctctccatgaagtatctatacatcccattgcttcctctgtaaaagcttcaagattccactttggtgtcaagtttttctacagggcagattgttgtttatttcaaactccagaaaccctcactcttttctgggatccatttaaattggtgctatcaggctttttgaccctaaagaacctgtgtttacttggctcttctatgccttctcaccagcccccagtcagttaaaacacctttcttttgctacagaaaactgcaaccacatctaaagccaccatcagttcaaggtcttctgactgaatgaacaacccctccctcagtgtccagatgtgaaggatctgctcaatcaccaaagctcctgaattaagagtta

SEQ ID NO: 251 - DNA, 37040 bp, Homo sapiens
gaagaaagaagactcttcaggcatctgatgaccaaaataaaagaaacattatgatggtggtggtggagtgttctgctacaggcatgtgggaggctcacagaactcttaatattcacttttaattcattccaccagagaggaaatgcatgggttttggataggactctgtcatttatccctgtaagaacttgagaaatttatttagtctctctaagctttggcgtattcaaaatgaagacgatactaacagtacctacatcatgagtgttacttgaatggagatgtgtaaagtgcattttaatttcatctggtcctttaacattttcccttcacttctcttcagagttttttcttgaagggctcgaggactgaagcatcccacaaaatgattctattgaataattctgagcagctgctggccctattcaaatctttagcaaggagcattcctgagtccctgaaggtgaaggaacagtgggaggttggggtatgggagtaggggtgttgaggatgagaaaataacaggcccaagaatctcgtccttcctgactttgtgcagagggttggagctgggaaacaggatggggttggggacaaaggaggcatgttaagagctgctgcttctcctcggcaacaggcaactaggccgactctgcagattttatcactcatttggagaggtggtgaagaatggtggctacgaacatcggtttggggccagattcaataaatatgcattgcaaggctgccattttttagtcagatatcattgtgcctgtgtctttagctttctatgcctttatctttggtcttttcattaataaaatgggaataatattagtagccacctattaaagttgttgtggacactgaatgaatccatacaatataagtgctaagtgcattgtcaagtgcccagctactgcacagtagctctgtggtatcacaaggacacctccctgggagttctgcctgtttgctggtgacttcacgtccatcagtatggtcctggagatgctgctcatcacactatcaccaacttggtcccagtgctgtctcctgacttccatttttctcttcctcttcacatacagacccccatctctggggatctcaacctctcctattccctttcatccctccttcaggtgtatggctctctgtttcacatcaatcacgggaaccccttcaacatggaggtgttggtggactcctggcccgggtatcagatggttattatccgacctcaaaaacaggtaggcacacagacagggactggtggagccaggcaggtccaaagggcctgaggaactgtccaattcagacaccatggctgctttcatagggtgaaaggaaatgtgagtattttaaaacactccttcgttaatgagcagcttgcatgaatgccacatgttaacactcttcccgtaagcataagactaatttgggaaaggggttcaagggggaaggggaggaaaaggacaaggctgacactcacagattaagggccctttgaggtggcaggggtcacctgcaggggctgaatggaggccaatttacagggaaagttgtgtgtctgagatatcagaacagtgatttagaaacaaaaaccaaggcagtagtctaccagcaaaattacctctcatggccaggcatggtgtcttttacctgtaatcccagcattttgggaggccaaggcaggaggatcgcttgaggccaggagtttgggacctgcctgtgcaacatagtgagacctcatctctacaaaaaaataaacaaaattagcagtgcatggtggtacatgcctatactcctagatgctcaggagatggagatgggaggatggcttgagccccagaaggttgaggctgcagtgagccaagatcacaccactctactctagcctggccaacagagtgagaccctgtcataaaaaaataaaagttgcttctcaggaaccagggaaggggcacacaattactgtgtgtcaactgtttggaagcacctcactcattagtgactgtcatcatcagaacaattttacaaagtgagctttaatatcttcaatttagagatgaggaaacaacactgagaaatattaagtcctgtagctgctggataccaactgttaaagcattccccaatctgaattcaagttcaacggactctgccacttttactagctatataaccataggcccttctgtgagttttatcatctgttaaaatgggaaaaattggaggacactcttcagaggatcacagaaggtttaaatgagataccatatgtcaaacacttagtacatagcacataattctaaatagtatttaccataattagccattgttggccgaggaaacacaaggtatacacgattaagctgaaatagtaatacaaacctaggtctattttttggccctaaaggcttcccctttttgtatctgtttcatgcacatctggttagtgaactgaagcctcatggacagcccagcttcaggtgggtatagacgctgagcccccacataataataagctgagcctaacaccttcccagggatgttcttttgatctcaaggtttcctgacaatttcagatggaagattaatgcttagtttatttgatccatggtccaatttcttcaaagtgtgatatgctaaataactgtatgaggtcaaatagttctttttacttcagtaactttgtagttactatgtgtattttaacaatgtaactgcaccatcaagctgtaacttcatatatgcattgctttgaacaaggctagtttttataaagtgagtcagtaaacaaaaatattaaaatataaaagttccatgccacacatacatgaccaaaaaaatggaaagaatgaaatatgctgcaatttacttggaaatacattcacctagtctgattccatagtataccacgtttctttcagtattgaaaatcgatgcaattttgaagaagacctttttaaggtgagatgcaggagaatttctctagaaaaaaattaattttttctttcttggtttttaatcagaaagataatatatgctgattatacaagtggaaaaatccaatatgattttaagaagttaataacctctcacctcctttgccctcctctcctccattcctaccctttggggtaatcagtgtccttgcccatattaacacacaaactgtcatcactttttaatttgcctttgacatatggacattgctttgagtgaatcaatacagcactaacgttttcgttttagtaactgtggtgttccatagagtcaatgcaatgctagtcagtcattctcctcctgttgggttcaaattgttcatacttctttgccattacaaacaatgcttcagtaaacatccttgtatacatgtctttacatcctggaaacttttctcaatgcaattggtttccaaaagggatacgtccaagtaagagcttctcttatcctaagtaggcactgccagactaccttcccaaaggattccacagtattatttccattagcaatttgtggaagaattgtttcccacattctcaccagcactgaatgttatccttcttctaatttctgccaaactggtgggtgaaaagtggcatcttattgtagatttaatttgcatttccctgactagtgatattcaacatatattttcatatgattatcagtcattttgggtttacttctgaactgtttatattgtttgaccatttttacactgggattttgtgtcattcttaaaattctctatgtgttttggatatgagggatactaacacaaggtgtatgctacaaatttgttgcccaattgagaattattttctattttattgatagattttcacatgaagcaatttttaattttcatgtaatcaaatatattatctttttcactatgattcctgaggctttgggggtttttttgttaataattaggaagatttttcctaatccaagatcatacaagttgtttttttcattttgtcttacagtgagtttttacttttgacatttcaaacttcattctatttgcaatatatttttgaatagcatgcattaacattcttttatatttattcaccttatggctggctaattacattagtgctatttattaaataagtcactctgctactgaaacataaatgtctattttgtcatgtaacatttttatatatttttgtagctatttctgtatttgttttagtcttttctcatgctatttcaatgttttgtggtaaatattaatatctaataaagcaaatcacccttcactaatgtttttcttgatttcctatttcttataaacttaagagctatatgaacaaaaactaatttttcagttccccaattcccccaactaagtattgcaattgtgatttgtattggaggagttttttagacaattgtggaagcattaatatttttgtgatactaaatatttttatcaagaaatatggtctttctctcacttttttcagtttctgttctatgccatctggtaaaatattagtgttttcctgaggtaaactacattgttttctgtcgaagtctcttatattttctaaatgtgtaatactgtaatctataaacaaagtaatttgctgcttctttgccaatatttgtatgggtttttagtttcttgccttattgtataatgtacaacctaagaaaacaatatcaaataaccataataatagttctattcttgtctcattcctgattctaatgaaatagctataaacacttacctttaaaattacatttaattctgtctttacaggcttagagcactttcctgttttcccactttcatagaaattatatttagaatgaacggtaaattttatgttatttcatttttgtctttttatggaaatttatatactcatgtaattttttcctcctttaatttattaccctaaaagatcttctgatcaaactcattctggcctttctaaaacaaactgttcatgttcacattcttttcatatgctactgaatattttattcagaatttttgcatctgtattcataagccaatatggtcagtaactctctttttgttatttctttaccagatttggcattaggatcttttcatcttttaccaaacaatacaattaaaattatgtgtttggttttgtcttatgtagaattgaaatgtaaaataatctaattttggctactttttagtttgtaatttcaactttccttttagataaagggggtacatgtgcatatttgttacatgcaaatattgcatgatgctgagtcttggagtacggacagatcccatcaccctggtagtgagcatagtacccgataggtagttttctaacccagcccctttccctccaccctctagagtccatagtgtctattgttcccacatttatgtccatgtatggtcaatgcttagctcccagttatgagtgaaaacgtgatatttgattttctgttacagcattaatttgcttaggattattacactgtggaaagtagtctggaaatttcttagagaacttaaaacggagttgccattagacccagcaatgccattactaggtaaatacccaaaagaaaatgaatcatcctaccaaaatgacacatgcactaggatgttcattgctgcactgttcacaatagcaaagacatggaatcaacacagatccccatcaaaggtgcattggataaaaaaaaaacttgctacatacattcatatggaatactacacagcagtagaaaagaataaaatattgtcctttgtagcaacacggatggagctggaggccataattcttgtccacttttcaaatggtagatgtttaatttcatttctgatatttctattagttcactgaagttttctattttttgaaagtcaattttgatagtttattcttgagggataacatccatttctttatcagtgaatatgttgccttggagtatataatcttctattataagtcttttttcttttctgtttccgttctcatggctcatactctatgcctttttttctcttttctctttctcttctatttcctttaaatgccttaccagaagtttatctctctcttctgctctttctctttttcccatttaataatgaactttctacatttcagtatttatggcttttatttttacaaattgttccattagttattttctggtttactttgatattctctttataattctttgaatatttacttggctattttaagacattcttttaaaatcgggtcttttaaaacttctactcttttaaattcactgaggtgttgtgttttggccatattcaggaacttgcatttataaaagcacccccaaatttttgaaggtttccttaaaattagttacactattttctcttttactccttaacgataaaattttcaacatgatattaatacattcactgctaaaactctcacacttattgtttatatttcccctgataaacagatacacatcgtcccatgaagtttgtggcttgtcagaatgggatcacaagtctctttctttaaaacccatgagtccaacaccacataaattgtgcagagtgctaccgaaaattcagttacttcattctattttgtgggcttctggctgtaaaggccatgtcactcttcaaagaggctgatatcctgtagccttgggaaaaggcaatgtctccttaatgtttctattcactaaagtatcttgctcaaaccctggacactgcagattctaaaacagtatagattgtaggtgtctggtgaaacagtaggcactaaaacttagagaaatcacagttaaattcatcttgtgccaagtttaagaacttaaccctatcaacacggactcagtacaacgcagaatatgtcccacagggggttatgtggggcacagtatatataacagggggatatgtgtggtccaggaggtgagagaagcagggagagaagcaattgttgcattcctttgcttctgctgggcgctctgtgatgctatatataaaataaggtaagtgtgcggttgagtgggtagggagaaaggtgaggcatcttaaggcctggtggaaggtgactgatttcatcctgtctttgttatgcatctgataagcaggtttataaccagtacctgtcagtgttcaatatttaacaaactccagttaaacaggtaagaggtcagcagtagcttataggccttggttctattatccatgtgcccaactgcagccatcgtgggctggtgttaaaattttcctttcaattgtcatttttctaataattgcaatcagtgagaggagaagaaaaagttcaagggaatgacctgacctttcaccatcctacacaggagatgactgatgacatggattcatacactaatgtatatcgtatattctccaaagaccctcaaaaatcacaagaagttttgaaaaattctgagatcataaactggaaacagaaactccaaatccaaggtaacaagtctgaagaaatgggcaagcagctgtgcttctcaaattgtgtcttcaactaacagcattagcatcacctgagagctcattagaaatgtaaattcatagaaactctctgagctgggagaggtggagcaatctgtggtgtgccaaggactatagctgattgtggtgtaaactcaactttgaaaactactaagcactgaggtattaatcaggtgggagcaatgtaagtagagaactgcatgtctgacaatattgctttcttggctttctctcaggttttcaagaaagtttaggtgaggggataaaagcagctgcattttcaaattcagtgaaggtagagcattcgagagcactcctctttgttacggaagatatcctgaagctctatgccaccaataaaagcaagcttggaagctgggctgagacaggccacccagatgacgaattggagaggtacaaaaaacatgtgctgatcatttataattgctattccttgtacatttttgtaattcacataaatcagttttggaatgaagagacgatgaattcattccttgggatgaataaaggttgtcaatggtcaaaatacgccactttgcaatggtgggtcttttaacaagaagagggcctgggatctctagaatggaagggcacctagaaattacaggagtggggatgaaagttgttgtctttctttttgttttctacagcgagactcccaattttaagtatgcccagctgaatgtgtcttattctgggctggtaaatgacaactggaagctagggatgaataagaggagcctgcattacatcaagcgctgcctaggagccctgccagcagtctgtatgctgggcccagagggggtcccggtctcatgggtaaccatggacccttcttgtgaaataggaatgggctacagtgtggaaaaataccgaaggagaggcaacgcgacacggatgatggtgcgatacatgaagtatctgtgtcagaagaatattccattttacggctctgtgctggaagaaaatcaaggcgccatcagaatgaataaggcactaggtttccttgaggcctcctgtcagtggcaccaatggacctgctacccacagaatcttgttccgttgtagacaatgaagctgcttagcaatcttgggcaagccatctcttaatattaaagcagacaccacagaatagctttcttcacttacaaatgttgattgggcatttatgatatggcaggaactccttctcacatggagacctgatgttaaaggacacagccatgctcttgaggagcttacaatccaagctggaggcaggggagggtatagtctttaaatatgcttaagtgttgtagggaaggacagagttaccaataaacatgtaactagaaagccaggctcagttcttacctctgggaatcagaactctttatgaaacttgattgatagaatctactatctggaagataattgaagaactttaataaaattgtcaatagaatatacctaatctatatggatactttattggaaagaaatacccctgctatgtatagatttatgaggcaatggctatactaaagaatggaatcagtctcttagtttagtgactagcaaggtatcaaaggtgaagcctcagacaaatggctttcctaggctacctttcatcattgttatgcagaaaaggatctccagagaatcaagtgggctggtcttgcggcctctgctatggaaatgacatttgttgtgcctcctttcccctactctttctcacttcctcatcattagtgaagcatggcacaggacaaggtgttgcctgtgagtctggttataaattcagcttttgatgtttgcagcactgctatcttaaggggtcaagggcattccagggagaagagaccactaaggtgaagactggagagtgagtaagagtgagccatacagtaaaagtggaaaaatccagatgatggaaagggcacgtgccatgcactatcataataactttataattgaacacttatattacaatctgaatccctgatctcaaaaaaaaaaaaagaaaaatactcttcatgaaaaaaacgtggcctcatttggctctgctctcccaccctgtcattggagcttggattactgtgaacattgtagccacagcaaaaagaaaaaaaaatggcatttttactccttctgatagtctagattttaaaaaaacaaaagaaatcttaatagaattgtcttttggagtaaagtctaccagtattaaacaacacctcatctctccataaaaaataaacctccacaaaattgaatgtttatacttgatgcgatttgaaagtgtgcaattccagcacctaaagaatagtgtaggtcatggagtttttaagaaactccaattcatcttagaaggctatggtagatctgttacatcttagtataaatcaatccaatcagatttctaaactcctgagacctggctgatttgttacattgactgaaatgaaagcatggtctgagagagagagtaaacatgtcatttgggatttcaaagggtggaaaattcttacctaaaaaataaactcaggaacttggagtcatataaaaacagctatattttggcactcaagaggcaaaagctaatacagatgatgaaagaacacaaagaaaataagatttgcctattcaaaatggtgcctcgggcaggtcctgtatccagaagaggatgttcatccagggtctggggctaaggtcatcttagcacagcccagctgccagcttccctcctctgccgcttccctgaacacaagccagcttcccttatctagcccttcttggccctgttaaaaaagtgattcctaaaccttatcatgcacttggattgaaaaaacaacaagaaagcatgggaaagaggaaagaggattccttaaatatggcacaagtaagtccaacattatcaataaacgcactaaaaatgaatggggtaattttcttattaaaatatatgtttttcatactgagttaaaaacaaagtccaaaaagcatacatctctgtgccctcacatggtagagacagaggagagctcagactctcttccttttcttagaaggacttaataccatcataggggctccacccttatgacttaatctaaacccaattacttctcaaaggcccacctccaagtccattgggagttgggtcttcaacatatgaatttgggggtcactgtcagtacataagaaagcatatctgaaataacacacaagtgttcacggaaaggaaaaagatatactaaatgaatgtgaaactgaaaagcaaagtaataccatcaacacttggcaaaatagaacgtaagttgaacatctgctaaatacagaaattctcccacaacatagatcatgaatctgcctcaacacaacacaactacaaactatacatggcaaaagctgacggacatacaaaagaaaaatgcaaatccacagtctcagtgggagaactcaaaaaacttccctcagaaagcaacagatgatgcagacaaaaaataaagacaatttgccaaaatgccatcacaacttgatatttctggtgatgttggggttatctgcttactgtgtatttgagaacttctgttcacctgcttgtcaaactgaccagcagggggtgctgcggagggaaacactccatctggagaatgctggcaacttgtctcttaagtctagaggctccttgtccccctcatgatcatcacctatgaggtgcaagcactgctgatacaggagctaaaaagaaattattaagcagttagtgtaggtaagagagtcctcggtaaggtttttcttttaataaaaagcagcccccatataatttcttttctagcaaaaatcagcctaaaaaatcaagccacaagcatacataagcaaactaaaaacttgcatagctaaatgctggcacctatgcaaatagaaaagggatacttggaagccaggcatcctcaacatagaggtttcctcttcctatttttttttgtttgtttgtttgttttttcagatggaatcccgctctgtcactcaggctggagtgcagtggtgcattctcagctcactacaccctccacctcctgggttcaagcaattatctccctcagcctcctgagtagctgagattacaggtgcccaccaccacgcatggctaatttttttttcgtgtttttttttttttagtagaggcggtgtttcagcatcttggccaggctggtcttgaactcctgacctctcgtgatccatcgtccttggcctccgaatgtgctaggattacaggcatcagctaccacgcgtggcctcctattcccttttctttgtattcacgtgtgcaggcgacatggcacaggccaggtagaggccccgtttgcatactaaagattcatgtgggatggccaggctcttcatgcatcacataaatggcacacctgctccaaccaaccctctgagccctatgtaaatcagacactgcctcctcaagctcctctataaaaccaaccacaactcgccccaaacccggaaacctgctcaggcacctttccaatgcatgaggaaactctctcttcattcttttgcctattaaacttttgctcttgaacccactcctttggtgtccacatctcaatttccatactgtgagacagcaaacctctggcatttccccagacaaacgatgccgcttcactgccatctcaagcccaagtgccaaaaatgaccactttagtctgaagaatgccacagctgccaccatgctgcttaggataagcaaggacatgaagatggagtggggacgggtttattagagaggccgcaataaaagcatatcccaggcaactttccacttcttaacttctgtcattttcaaacttaaaggtgttttttattgttgttggtttgcttttctttttaacagtttctatttctggccaaaagactgctttttgttttcctgctatgacatatttattctttgttcaaaagtcttttccatgatttcatataggaactaagaagacagccatgtgtttgctcaacacattgatcccctctccacctagaactctctttactgtttctcccaggaagattccacccctcctgttctgccagtttcctcatatttgcctcatacaattgcccttgtaggcagatgaacccgggctagttctactttactatggacaccaaagcttctgaaataacatctgagtcttgggatttgcatatgaatcttcccttgacacagcaaacagtctttccttttaccttcactaaagtcatctacttgggagaatggagagcactaaaattctacagatttcaaaaacaaacctgctgtgcctttccagagtccttggaatgcaaaagagaaaataggttagaagggatattttctccttcctttcttaccttgaaggagctcctatttttaaagggaatcattggggacaatccaaaagaaactcttgcaaatcaagctttgccatgccatcacgagaagggtaacatgtgtgcccagtggtgaaatttttaaattttggtaatgatctccagggtcacccctatggataacaaaaatattttaaaaacctataatggtgccagcctttcagaaccctgtctctttgcaaggacctaccaaggtctagagatcatagcacctcactagcagcctacaggcattctccaaaggttcccacctgccccacccaacatacacacacacatacacacacacacaccctcctgctatcctttggccctagatttcacctaactttattctaaatcttaatcaccctgtgcccccaaactcatgtgttatagggccttggtaatccctttctaagcatattccctgacttcttaaattctatttatgagacatatatctaaagtaaaactatatttcaggccagatcagcacgcttcttattacaattataaacactgaacttcttagttgctgggaaaatatattgaaaaggcattattatgcttgtatagccatagattatctagggaaaagtattgagtgtctcgagaatgagtgaaaattgtttccccaatatacacctttttttcttttgaaaagtatatcctgcgtatattcaaaagataatgtttttcaaaaggggaaattgcctccactgtggactcttattaattcacttatccatcaagttctcttattaactcacttatacatcatattcccttattaactttttattcaatcactggtatttgtttctagtgctcataattgaacacaaatttgtttactattatataaaataaagtaacagctattcaccgtttcctcctttacctcaataagttgacatcttccaatagatttatttccctgttttgctccctcctcagatccagatgagtgtgctaagtgatacaaaatgcttttattcctctaccgttcaaccccctgagcccgatgttttagttccacgtgttttagttccaggtgtcacagaatttcccttgcagtgtgtctcatcaatttaaagaatccttctttaaaacttttcttacacattcccagagagcctatcattgtccatttagagttaactctctacataaaatttgtcaatttttttttactcaccactgtttcctctccttattttctgctcctatctgaaatctcttttcctatttgattaaattgcttcttcagtatttcctgcatgtacatatgctaccgatataatatctgaagactctcaaatccacaaatatctttctttgaccctcacaagaatataatttctgcagccttatacattgacaaatgtttgtcttttaccctcaagtgactgattccctatgacatcacattttaggatgaccaaatataattttccactttatacataaggaaactgaggtacaaagaaacaaggtagccttgaactttcattcaaggtcacaaagctagcaaaaagtggatgactagcgatgaggtcttcaggttgagattaacaaacaacatcacaggatataataggatttaacccaacttcaacttcataaaatgaatggacattccctgatcttccctccactcccacccccacctcaggggatttcaggatgcactgggcaaaactgtctccctccatccccaaccgtttctcaggcagtgacaggtgtcaagaactcctcgccgcccttcttgaagcttacattctggagcagggaggcagaagctaaaccaaaaattaaaacaactgtgaacatattccctataaactcagatgtagtatatgaaaacaacacatgatttgacgacagaagatgatggagggagaaagaacaacaaataaataggaaaagaggcctcagataggagcaggtaaaaaggagagaaaacaggaaggggtcaggactggtttccctcaaagcctgtcatttgacagagagctgcagaaagaaggaatagagccaagcacataacaggagggtagagttgcagtctgaagcacccaaaatggtccactaggatggacaaaggacatacttgaaccaccacttagattcatcttcatctaaaaaataagaaattaagtgtgtgtaatatttaattatttagtacattaattacagtagaatatatagagttgatgctcaatttgttaaaaaatagatatctaaaattaaacctcagagattactcttgcctatgacaacgagcttctgaaaggcaaggataggtctcacccatctctgtatcttcagaatccatcatattatgtggaacataataggtatcaatagtatgttggggaaaaaaatcgaaaccatgctgagcaccggaattctgtgtaaatctttttaaaaagtctcttctactttacatcagagtcccttttgtatttttagtatcatccagccccacgccttgcagataagcccctaagaaatgaatgggtgaatgaatgtgtggacagcgggatggatcattgagtgaggagcagtgattcgcaggacctgcatgcattgaaatcctgccaaagcagcctctgcaaaataaaagaccttgggctttggtttctgacacaagttaaaattatccaaggactctccttgggccacttagttgaggtttcctaatctgtgaaacagaaaatgaattcaatagaaagatgattgagacaaatttctggaaggtgccaaagcaggatgcctggcattgagggacgcttcacacctgttatctctctccctattctctcttcacccctactcccgcccggcaactccccgctgtcagctccaggaatacttacctgctgagaaaaggaaaagcacaacactgactttaccccgcgacgcttttaaaaactccaaaacacccagcgcgatggggagtaggtttccctaaagacaggtggagcagccatagttaacttagaggaaggtgaattgacaaagagggttgagccactacgagcgggagttaccttggactaacagttgtatcttcagcgagcacaagtcctggaatctcccacgcccatccctttttttagcgccacaaatgcagcctcctaagagaatgggaagcttgggagtcagagaacagaagattgagctaccattggccttaatggatgtcaatcttcacttgtctcttttttttccttcctcgcctccttgcccctccctatcccggtaggcgcgttctctggcgccatcatatggcagaatgcgggactacaccaaatgcggaaaggcaccttccccttccctgagtatctgcaaactcagggctgggcttggtttttaagagctcagctcctgtgccaggggcggtgctaaaaggggctgcctgcgcagatgtcattcccacaagatgcaagtaaagaagcaccgcggacaccgggggagggtcacagagtgacaggaggactggttgaccagctgactggcctcacttctgacaaatgcaaattacccagccacagtccaaccaagggtatcaaaacaggatctctgcagatggagctcagtgttatgtgttttggatgctcgcaataagattttcatgcaccataaactttcctgagtatctcaaccagttttgttgatgccggggtttgttcaaagctgcagattactgggcctcaccccagacctactctacttaaatatagtggggttcccataatccccattttaaaaaacctatccaagttaaagtacagagaatcacaaactggaagaactccttaatttacaaataagaaatggagacccccccaccaagagagaaaggaatttgcccaaggtctccctgaaagagcctaagaaagcgtgaggctctaaggttaaaatcctacctgacaccctttcctttccccaactagtcctgtgacctctagcaaactatcctgtcctaatctgtgaaatgggagcaacagtcacacctaccccaactggtgactgcaaatattaaatggggccacaatgagtcaactaccaagcaccaccccattgtaagttgaggttgaaatgattctagatcgccctacccccattcatctcccagtaccattgtatgaccgtggaggtgaaaccatccagccgcctgttggtcccaaaccatgttcacctccacccgtggctcagtgactatttcttttcttgaagagagagagaggctccttggagcctctggaatctggagggggatgttaccttccccctgtgtgcattgtcttcccaagataggatggactacggggtctccatgtgaagagttagctgccagggcatcaaggatggctcctaagtggttgctggaggcttagagaccccactccagctctctctcaaatgggggcagcttgtttgcagcagtgagtgaggtgggcccactacgaacccacaggaggagaggaaaagaccgtcccatctaagcttttacataacccattgcaagctccagaatgtggtgcccaggcccatatctataacccacccccagaggccagttctcctcagcctttcctgccacttctgccattgtacatccagacacttcccctgttctcttctatcaaactcctactcatctctcagccatctagtccaaatattaatctttctctgtgatatactctcagggtagaggcagtggtgccttcctctgtattcccagaacatgttgtctgcaactctaaatacagacatcatcctactattagggttcaagagcatcttttatgggttcatgaaggaatcactcttcgtaaacactggccttattccctaacttcaccagacctgaccttagtgcatgatccattcccacctctcccaaccacatgagaggccttttcctctttatgggtttgcaaaccacaatatgacctaaccaccagttactggccaaaagcattcttgtcacgtttattataaaatccagccaacaagatgctttgtgccaagggaatgttccttttcagggcaaacactctgtccccagggatgttagacaacttccatagccccgtataagcattagctagaaatgagtttttcctagtggcccaacagattccctgagcatccctactctttcacggattcccattgcagtgggattgcatcaaacctctcagggcaaagctgcaaagggaaaagcaaagctagagctctactctggacctatcgctctagacagttagtttctctgtgagggtcagttttatacgtaaggaagaaatggaagattgctccccaaaacggcatcaggttacttatcccaattgtgtggttcagttgctacgccagtgatgagcaaataaacaggaagtagaagcacaactattcctaagctcaagaagcagggaagctcaggaattggtgtgcagcagtgctgcttggagcgccattacgaaggaacaagcacggtccactgggaggtaaaattcagggaatcgaagacacagggggtatgggaaacaaggcaggcttttttatttatcatttgccatgatatctctctgtgaactttcttctcccttttaattttccctgtactttaattataattcttaggcctgacgtggtggcttacatctctaatcgcagtactttgagacgctgaggcaggcaaagcaactgaggccaggagttcgacccagcttggccaacatggtgaaaccccatctctattagaaaaacaaaactcagttgggcatggtggcaagcacctgtcatcccagctgctcaggaggctgaggtatgagaatggtttgaacacaggaggtggaggttgcagtgaatcgacatcatgccactgcactaaagcctgagcaatagagcaagactctgtgtccaaaaaaaaaaaaaaaaatacaaaacttctcagctaatggccaacattgaaatacaaaacttctcagctaatggccaacattgttaccatcataagtcccagcttccctgtcttcctgtcatcatgtgttgaatgtccacttccctccttatttttcagttggagtggattagcatcaccaattcaacatgtcacaagtagaattacacaaacacacataagcaccgcaatcctggcacacacagcatctctgtcctcagacttccccatccttctagttgctcaagtcaaaagcccaggaatcatcattgagccctctgtttctcttatttatggaccatccataagcaaattccatgggctggcccttcaaaataaatgtggaatccagccatttctaacacttccaccattaccatctgaggtcgggctccaacatctttgcaatcctgggatagactcttagctgccttctcccttccacatctcttcttgtcctcccagagtttgtaccgcgcacaaacgctgctagggtggttttaaaaaatatgtcagggtatatttctcccttacttcaaatcctccatttaaaataaatttcacatttatagccaaatccagacttcttcatatggcccaccaggggctttatgctaatggaatgtgcagatgctcctccctgaggagcaccttttaccagggcaaattttctatctccaatgatgtcaggcaattccgacaacaccattctctactacctcttggttttcatagatatttttcctccagattctacaaaaaaagaagatcaagtctccttgtgcaatgatttactctctgatgtatattggtgccaggcacgtgtactgctttcagatgattcaagaataacagcgatttgagaaagctgtccttaagttttctcttctccttgactgtatgacattatttttacaattatacttccaaagtttgctctttccaaacaccacaagacctatgtaatttaagcagtgattttaggggtctctgtatattttatattaatttcagaaacatgctcatgattattccaccaaaactatcaactgttacataaacatctgtccttctatgagttgcaaaataattgtcaccatccccacttaatcaaccatcttgtatccttctttgaccaacttctgaaaaataacacccaatactaaaggcatctccttctattcagggtctcagacagtaagacgttctttccttaaacagtaagacgttttctcaagtcccatggaaagcacttctttgatatcagtttggggaggccgaactctggagtcttcatccgaagagtaaagtaccgcactcagtaatgcgcgtcctgggaaccaagcctaagcagttttggccgcttcctcgtccaggctggcattgtctgtgttcgccagcccctccgcgaagttagctcatttgcggatcaggccaaatccctggagacttcacgcagacgcgggtgcagcctgctctgggacttgaagtccgctggagcctgagcctctgcatcatccgggtggagctctctctgctgctgccaaaggatcccgcctggatgctcatcccgccaccgtcgcccaccccgcagctgcagaatggcagcaactgccacacacctaagcaacttggctggctattcgccctgcagctcccgccagcgcgctgcccaagctggcaatcaaaagtctgggaaagcgcgaaagcgccacgtgcctcgcactccgcccagctgccgcgcagctcctccctggcttccactgggagacaggggactcccatgagaaggaaggagcagggcagtgattgcttagtttatcctgggacgcgggagctgtccccgtggactgagtggcgcggagaggggatcactgagaccgggaagggtcatccagacaaataaggaggggtgcgggtgggcgcgcagtgccctccgcccggccttcagacccacccgcgcgcgcgcaggcgtgtgctctcatccttcccttcccttcactgtctggagtgatgataattggcttccaaagtggatgagagatgagtcatttacatccaatgagggaaaaacagcctccagagactcttcgtccattggccagtgagagtgtcaattcccaggctcctgccgcacgcgggcgagcccttctaggcgggaaaagttcagctgagagatataagagagcagactttccagcacctgtgaatccagagcggtgggcactgacgggcacgtgcaccgtgtggacagactctccagttctatgagtggtttttcttttcccgggtcggacctggagttcttaagaggatggctgacaagggcagtaggcagaaggacctcagcccaaagtcaaggaggttttggatggggagctgggcagccgcccgttgtaattcccttcccgtctcagcttcaaaggccaagagttgtactcctgaaaagatacttggagatcatctgggtgttcctgaatctcaagagggtcgtttgaccctggtgggtcctttccctacccggtgcctttctcgcccgtagaaggagaccaggttcggttaagcagagcagaaactattcactgatcaaggaatggagtaggagagctcctgctcaaagtgcctggggtgtagtgtgggggtgctccttaaggtcttttagggcacgtagttggaaagcaaggattcctggaaagagatggggctttccagaaccagctgagtgtggcagtctcctatttgctgttgccgcccaacactacatgtgcctagcaagctgcatttctcccgtaggcacagattgaggtatggtaattagcaattgaggattcaggttagggtagcgcttctaagttcgtttcccatcttgtagcacggtggttactgacatccagtctctgtttctgtaagcaagcacagcttcaagcacaggttaccttaattggttctggggctttaggaaagcattgaggtcatcctgcggtgacagaggcagctgttcaaagaacttggtgcgagtttgaggcaggggttgtggagtgaggcaggtaaaaatgcagattccatagccacaccccgacatactgaatcagagtctgtgagggtgggatctggaatcctttttaaaaagctcagaggaaccaattcacacgaacaataaaagtttcatctgagccaaagaccttaatctagaaatgagaaaacggggatccccaaaagggttacagggagagggttggaggaaagttagactatgacagttttagggtggttctttcctggccttgggaagttttctcagctgctgctctgatcagtacgcagctgaatgctttaggggaaccctcttcatatatccggagttccctctctgtgcaggtctcccaccagggtctgtggcccgtgacctcttgccaccctggtctctccgctttgtctcctcaaatctagaattccaactggctttgtcttgctgcccttccttgcgacactggcctggaatccttcaagttagtctgctagcgtggattgtaggatgcatctcagttgtcactatccttaattgcatgatgtccagttcctcgcaaagcgttgtttcatatattttgcccatttttgttttgttttgctttcagactagggggaaatccagtccctgttcttccattttggccagaaattcaaggtaatgacttttaatatttctgactactagttccatcatctctctcacttctggatctgtctctattcactgatgttcctagtcattatgggtcatatttatccacttcttaaatgcttgctgattgttttattagatatcaagctttgttaatttcacaactttgggtgccagaaatttttaccttcccatcaatattcttgaactttattttagtaccttgatattttacatggaaaccattttataatttcaaagtttgcttttatttgttaggtgggagcagaactagggctaattttgtcccactgtggaagaaatacctttcagagtagtctctctgatatttcatgaattgtgaaattttctagtcagatttttgtgaactgaatctattccctgtcctgtatgagcctcagaaattgttacatctgctccttttgggtacttctttttcctgttccttttcaacagctttattccactcatgcattgaccaagctgaaatctcaagggatacccactgcagatctctgatactatgtgctcctgtggctctcttctccctagtactctgccatacaagctccagtcagcctggcctcccaaaactccaagcttgtcttctcaactcagggaaactgctagactctgcctgttctcttgcctaagatatgccttggaaactccatacagtaacctaaatagccacagggcttacctcatatgattttcttctcagatatcagagatgaggtcccacacagcctgatgtccaatgattgagagttgttatttcacagatctttcctttttgggttttttttagacatttcatgtggcagaatgaactcaatccttgtttctccatcttatccactagtaaatattagttatattctcttcgaattcatcatgaattccatgaagactgaagaaaacaagtcacttagtgccacaaaagatgacccgaggactagacctgaagtttcaaaggtatatctacttttttacaactcctcagaggagtgatagtctaaccatagtgccatatgaggttcttggagataagttcttaaacaatggtcgttataagcctttctcttaggtagtttaaaatatatttgggtagctcatacacataagtgcttgtggaaagcataatgatagagtatgagttaataatgctaaacgtgtcttaagacaacaagatgactaacaaataatatagacacttaaaatcatggaaagtatagacaggcaaaaataattagctaatgttttctgaggaaacactgtgtgcctggaattgtgtcccatcatatggattatcccatttaacagttaatagaactgtgcagtagttattatcatacttattttacaaaagaagaaactgaagctcaacttgcttatagttgcagaagtaacggacttcaaagcaaggatcttaacctaggcagtcagactacagagactggtttttgacccacactattttgctcaaaatatgcaaaatgataatactaaattgagatataaacaagtgattttagagtacagagagaagaatacttaattcagactaaggaaactacagcagcatcatatgagaaatgatttattaatgaaaaataaatctaaaattgtcaaactcatagatgtagaagtggttgctgggctgggaagagagaaaaatggaagtgttagtcaagggatacaaagtttccttacacaaggtgaataagttgtagggatctgaacagcatgagtgccaatagttaacactattgtgcactcaaattcttgctaaaatgatagattttatgttgtgttcttattacaaaaataataaataagagggcaggaagagactttgggaggtgatagataggtcgatgtcatagaatgtggtgatcatgtatcttcacattcatcaagttgtatacactaattatgtacattaattatgcatttggtatgtctaaaactaatttattttttaaaaagaatgaataacatttcactagtgtatcaaggatgaaggaatggcctgagtaaagtcatgtacacaggaaaacatatttggggaacaggatagctgcatttgatgctatgtaaggagaattcaagaatgtggtaggcaaataatgctttctatactggtaaggtagtgtggtgccaagatcacagtaggctttatatcaataagagcttttcatattgacagtaaaaatattttctacttgtgaaacaataaaatggattcattggttcacctgagtggacattccagaattcagcagagctcttaattcagtagtatacagtttctttgaggacttgtttgtgtgttcagtctctatgttctgcttttcatgttatcccctggctggctttctgcatagtgacaaatacagctgcagtaatatcggatgtgttactctcccgataatgagtctaccctggtttcctgaggaaacttctctttgccatcttattgtcccaacttaagtagctcacccatttcagcacaaaaccttgtgactccgagggcacatatagatattcttaagctgtcatgaattcatttccatacatgtatggctcctaaaaagtgtgagagaggtagaatagctttctggaaaatagctgcagtatctcctacttctttgaaatccatgtgtaggtttttggattttcttctgtaaatagaggagacgcgtttgccgactttatctctgtatcgcttaggaggagttatttaattcactttagactttgttaagttaaatattaatgttaaaatgcccagggctattttgttcaagacagttgccactaatcacgtgattttttttttttttttttgagacggagtctcgctgtgttgcccaggctgtagtgcagccccacgatctcggcttactgaaagctctgccttctgggttcacgccattctcctgcctcagcctcctgagtagctgggactacagggatccgccaccatgcccagctaattttttctattttttaggagagacggggtttcaccgtgttagccaggatggtctcgatctcctgaactcgtgatccacccacttcggcctcccaaagtgctgggattacaggcgtgagccaccgtgcccggcccacatgtgattatttatattcaaatttaaattcaacttaactaatatcaaataatgaaaaaggtgaataatacaaaatctcagttgcactaatcacacgtcaagtacttaagaaccacctgtgacggtagtattaggcagtaccgatgtagaacatttccatcactgcagacattttattgggcaatacttgtttagggcatccaattatagaatagaactacagtgtaaaactgccaaactatttgtctagaaaatagaatgagaggaaaaaatcaaaataaaggaggcaacaaagcaaaggtttataaattgtgaaaaagtggaaaaagtaggtgatacaaaaaaagatgatagaaataaacgcaaaacacgctacacccaattaattgtcttacagattattcgaaagactttaacttttcttgtttcttttaaattcatttatttcatatacagtaaaattcagtctttttggtatatagttcatgtaaccatgcctacagtcatgtaaccatgaccaaaatcaagaagcaaagcagtttcatcacactaaataactccttttgtggttccatcacaataaataattccgcgttctccccactcatcccctattcaccctagtccctcgcaacaactaatctcttccttactctagtgttaccttttccagaacatcatataagttgaacatacactgaatcatacactttgagtctggcttctttcacttagaacattccacttaagattcatgggtgctgttgcatgcattgacagtttttctctttttattgctgagtagcattcccactgtgtgaatgtatcaaaaatctgtttatccattcactcactgaagaatatttgagttgtttcccgtttggggagtttgtaaataaagctgttgtgaacatttgcatacaggtttttgtatgaagattagttttcatttctcttgggttcacctagcagtggaattgctgtcatggaaagtgtatgtttaactttataagaaattgtcaaattgatttcaagatggctgtgtaatttcacatcctcgataccaatgtgtaagagttccagttgtttcatatacttttcaacacaaagtttttctgattcatttattatcataggtatgtaatgacatccttttgtggtattaatctgcatttcactaatgactcatgatttgagcatcttttcatgtgtctatatcatccacatatcttctttgggaagtgtctattaaaatattttgcccatttttatactggttacttattgctgagttttgagagggctttacatattttagaaacaagtcctttgtcatattgcttttctcataacatttgtgataattgctgatattttatctctgtatagcttgtcctttcatccccttagtcctgttttgggagggaaaagttttcaaatttgatgaagttcactttctccatatttctctttgtgaatcatgcttttgttttttacatcagagaattctgctaaatgtaagatcacaaaaatcatttctaagttttcttccagaagttgtatagttttaggtttaagtctgcaattaagtcttatttttatttttttgtatggtgcaatacctggatcaaagtttgtgtgtttgtgtaaactgtgtgttaattgtataaacaagttatctcaatagtggatgattagcgtcttatcattgctgagtcttccaatcttaaacaaggtatatttctccatttattttggtcttgtttaatttcttttgcttcgaggcacctgggagaataggcaaacctggcggatgaaggcagattgggcagtgggggggctgaaggggcaatgggactggtgcacaactctctccaaggccagcagacaaggcaagaattagaaagaccggaaggacaaggcacgagtgacagagaaggttagtgatcctggcatcatgcagcttgaagattgtccagtaaactgtgagtggctcctcctagcagactttctactattacctctgggtttctggagtgtgtctgcactgtcttgcccctttgaccagaaacccttgcttcctccacactccctgaattcctcaaaggacaaacctccagcactggaatctccctccccagacaaaatatctgcacagatgtagtcacgtctccatcaggggtccccagagttacatccccctggaaactgaatggtcaagataataagctattgggacttttgtatgccaaatgcgacagtctgctgggcactttatcaatgtcttatgggagtctcaccacaccaggaggaaaatgttttccaatttagctttctttcccacgcccagccatgcactttttgcatggccatacctaaagactgcatttgcctccttaaggttagctctcaaagctcatggagatcacctataatatgacttataattggggtttgccagccgaatgagatctcataggatgaatatccagtttgtttggtgacggtgcacctgactcagaggagcacaacgggcgagacctgatcccacctcagatgagtttcctgacaaagtttcttcagcagctgcttgggtgtccatttcatgcacttcacttttcctgagctctgtggccggtaagctgagtgtaacttccattttatttttaatagccgagttaagtcctgaagtatttcagccacaaatgctggtccatcgtctgacccaagagtcagggttagtccaaatctgggaataatgtcttttaacaacaccttggttacctctcatgctttctctgtcctggtagggaaagcctcgacctgcctcgaaaaggtgcaaatgaacaccaacatgtaccgaccgagaacaccctgctcaaggcagctctttaaaatccagcattgtgtgtgagtggctccacaagtacctcctagtgcagcccctcagtttaaagaggaaagtgggggaaaaaagaaactccagaaagctttaatgttcttgagtgattcctttacgtaatgagcatggttttaacaactggagatgagcctactttggaaacagcccctcttaccccatgtttattgttagggcactcctttatccactccatgcccaatatgtctcattcccaagtagcaatgagttaactagaaatttaacaattttctacaactttacacttagattatgctttgttataaatttttacacccttcttctgttaaagatgcagaattgggctttaaaaaaaatcattggatcaaataagcccttccctttccacttgactctgggaatgtgagcagacggttcttaagatgttgagttttgtctactatccactgctttttagccaggaattctctagtgatctgaagcaatgcaactgaagaacactttttaaattatgtgttgacaagttgccttatatataaagaggaaaaaaaattacctggtttatattatgccagatgtcagtaacatgaagtcctaatttattgttctcagttgttttcctgcctaatgtgaacttccgtgtccctgagccctcaggagtacctacagcttatggtgcaatgtcttctcccaaagtgttggccaccatttcacccaagggcctcttccaattcttgcttatctgagtcagatttagagagtaccactgtctccccttatcccttacttcatctccaaaccacatactcgtgctatacttttcttctcagtacctctccctgaatggtgagctgccattttaggaaattggaccagataccaatttgggagctttcagtcaaacaacctcaaacccatgtcttcctatgaagaggtgcaagtctctgaagctctcactcacccctgcagtctgtgtagaaaatgtactgtaatccccctggcccccaactgtcattgcctttggtgtgagatattccctatttcctagtttagcttgagtccctctctcctctgctagccaacccccatccagcaataaggaaccaagcgacagcctcctattcacactccctgcctcctttccacacaaccctagggaatacctggattgccccactctgtccacatactgtagcattcattctctatcatcctctcacctgtggtggtttatggatgtgatagagtttttaagattactacaaactagtaaaaaggaaaagcaactcaaagagagacaaagagagaaagaaagatctgttcagcgtctttgcccatttttaatttggattgtttgttttcttgctattaagtttctcattattttaaacattaaccccttatcagatgtatggtttgcaaatattttcttccattccataggttgcctcttcatcctgttgattgtttcctttgctgtataaaactgttttagtttgatgtaatcccatttgtctattttggccttcgttatctgtgctttagggattctatccaaaaatcattgccacaactaatatcacgaagcttttctcccatgtttttgcctagtggttttacagtctcaggtcttacatttaggtctttaaaccattttgggttgatttttgtacgtggtgtgagataaagtctaatttcaattttctgcacgtggatatgcagtttttttcaacagcatgtattaaagagactgccccttccccattcacatgttcttgacaactttgtcaaaatcaatcatcttaaatgcatggatttatttctggacgttctattctgttccattgtttcatttttctgttttgatgctagtaccatcctgttttcattactattgcttcttagtacattttgaaattaggtagtgtgatatctccagctttattcttgttgctcatgattgattttgctcttaaggatcttttgtgataacatatatattttttggtgttttatatttctttcaagaatgtcattggtatttagataggaattgcattgaatttgtaaatcacttggggcattgttgtcattttgacagtattaatttttgcaatctataaataataaatagctttctatttatttgtgttttcttcacttttttcatataactttcataattgtcactacataagtctttaaccaccttatttacatttactcctaagtatttattttttctagcttatgcgaacaggatttttttctttgtcaggtctttcattgttagtgtatagaaacactactgatttgtgtatattcattttgtgtcttgccatattactgaatttgttcagtagttttaacctagtttgctgcagtctttaggattttttatatataggaccatgctatatgcaaacagggacatatttagctacttcctttccaatttggatactttttatttttttctcttacctaattgctctgagtagaacttccattaatgcactgaatagaagtagtgagagtgagcatccttgtcttgtccttaatcttagaaaaatgtttttcatatttcaccattaagtgtgatgttaactgtggatttatcgtatatggtctttattgtatgagctacattccttctatacctcatttgttgagcgttcataatcaggaagtcatggtgaactttatcaagtgctttttctgtacctatcaagtgtcatatggattttgttatttattctgttgatgtggtatttcacatttatggatctgtatgttgaactatctttgcatccctacgttaaagcgcactgtatcatgatgaatgatctttttgacatgttgttgggattagtttgttagtattaatatttattgatgcacctatgttcaatagtgctattgcctaatattttcatttgttgaagtgtccctatctttggtatcaggattatgcttgccttgtaaaacaactttggaaatattccctcttcttcaattttttggaaggcttttagatggattgacatgagttcttctttaaatatttggtggaattcagcagtgaagccatcaggtcctgggcttttttttaatggaatattttttattactaatttaacctcctaactcattattggtctgtttagattttcaatttcttcatctggtggggtttatgtatctaggaatttacccatttattgtagattatctaatttgttggcatataattggtcataatagtctcctgatttttttgtgatgtaagttgtgatgtctcctttttgtttatgattaacctttttttttctgttagtctggataaagatttgtgaatcttatttaacttttcaaaagatcaaatttcaggggttttttttcattgttgtcatagtttctatttaatttaactgccctgatctttatttattccttcattctattaactttgggcttagtttattctttttatagttccttgaagtgtaacattaagttgtttaagatctttcttctttttcactgtaaacgttttgaagcatctaacaagttttggtattttgagtttccatttttgctggtctcaacatattttttaatttccactttaatttcctctttaatccatctgttgttcagaagcatgctgtttaattttcatgtatttgtgagttttctaaaagttctcctgttattaatttctactttcatgtcattgtgatctggaatgataaatggtatgatttcagtcttcttaaatttattatgacatgctttatgtcctaacatttgttctctagcatttcctgtaagacagctctgatggtaataaactccctcagtttttgtttgtctggcaaagattttaatctctccattatttgcaaaaaacagattttcccaggaacagtatttttggttgacacttttttttctatagaacattgcatatatcattccacactctcagcctataagtttctgctcaaaaatctgctattagccttcttggaactcccttatatgttattggcttattttctcgtttgttttcagaatctttcttttctttgatttttgacagtttaattaaagtatatcttgtactcttgatgagactgaatcttatcaaacatcttcaatgttcctatacctgtatatttctctttccgcagacgtggaaagtattctgctattatttcatcagacaagcattctttccctatctgtttctcttctctttctgggacacacatgatatgtgcattggttctcatactgatgttctataattgccaaaggatgtcttcattttttctcatttttttccttttgtgtctctgacttggtaatttcaaatgatgtgtctttgagttcattgattctttattctacttgatcaaatctgctttcaaagaactctatgaaattttcagttcaaccgttgtgtcctttatgtccagaatgtctctttttttatgatttctttctgtttgttgaactttctattttgttcatgtattatttctctgattctttttagtcatccatctgtgttttcttgaaactcactgagcattttaaagaccattattttaaattcactgtcagaaagttcataaacctttattttttggggtcagctattggttattctttttttttcctttggtggtatcatttttctcttatatttcttgatttttaggctgtgcattggtgtctgcacatttgaaaaacaagaaagttattccagtctttgcatactggctttgtctggaaaaaccttttcccagtcatccagcaattcttggtagggtgtctgctgtggtctgcaggtgaacttgttgctgaagtcttcaggcaggctggcctggtgcctgtgtcagcaggtggtaggcttggttcctgggtctgtagagttgggcctgaatcctgtatccactggttggatattttcattgggtatgtggggatgaacataaagcctatgtctataagggcaggcatacagcctataccaataagggctggactgaagcccctgtctacaggggctgacatggctctgatgtgggcaatgagtctgtgtctacaagggctggctaggttgtggaatgggcctagtgtctgggtctactgggatgagcctggaatctgagtcgatggggactggcctggtactggtgcaggattagagcctgaatctgaagaaacgggcctaggatcttggtagatgggagctgacctagagcctgtgtcttcagagatggtcctagagccttggtgcatgatggccagcctagcgtcagggtctgctgaactcagcctgtacactgggtttgcaagagcacagctcggctctgagtttattgcatcctgggtcacaaaaaccagcctgaaccctgaaattggcctagggttggagtggggttggggccagtctagagcctgagattatagctgctagactggtgcctgtagccataggagctggcctagaaactgcggaatggcctggaggccgggtgtgtgaattctggcctagaacctaggtcttcagggctagcatggagactaggtccacgaaggctgcctagggtcccagggctggaggaactggactggaacctgggcccacagaagcagtgctagatactgggtctgtgggcacaagcccaatagtggagtcaactgtgatgggtctggaccctgggtctgctggagcatgtgaccctgggaactggcctcaagagtggggtggcagaaattagctgagtgctaggttggcctgaagcctgtgtctgcagatgcttgccagatacctagctaagggctagtgctagggctgcccacctggaactggggttggcctgaatcctggatttgtgtgagccaacatagttctgggctggtctggaacctagggtagacttggagcttgtgaccacaggggctagcctggcactaggcagtcctggagcccgtattcacaggggccagcctggaggttggatcgatggacactggcctggtcactagagttcaaggggccagcctggccctggggctggtgtgaaacccggagttgtggaaggcagcctggtcctgggagcagtctggagcctggagtcactggggctgggctggtcccagggagcatctgacacctagggcactggggtagatctggcattaagatatatccagaaaccatgtctgccaggcaagtctggaacctgggctgtgggatctgctctggcttagtctgcagctacgagcctggagtttgaggccatagcggcatacctattactgtatttcactgaatcaggctgtgtttccgtcgaaggcaaagttcagtgcccacttcccttttcttcttcaatacaaaggttgcctctctctgtgctctgctgtccgttattgtgggagggatgacataggtaatgtaaaattgttcttcctatgctcttcaattcatcttttcttatttctctgctacacaaagattctgtgttttttcacctggtatccctagctcttgtgaaggtatttttgtccacagatagttgtttaaattgatgttcttgtgtgaggataagtactagaaagtcccattctgacattttgctgatgtctagttgtgtggcatctcatcagatttctaaatagtgattttcaaagtgcctcagcagcatcagagacaggactcctgctaatttggaaagaaagatggcaaaccttatgttaaatgatcttaccaaacacatatatgcaaacaataatgataataaatagagcagacaaaacttttggaagtgacgaatatgtttatggcataggttgtggtgatggtttcatgagtatgtattcatctctatcttcatcaaggtttatacattaaacacatacagcttattgtatgtcaatcatacctcaataaaatagttctacaaaaaaaagaaaggtaaacacaacagaggaaaactactgttggcctatttctcccattaagtatgacttgtatttcagagttctgatggttactgaatcttccagattttctgatgataagtataataagagaaataacatgttaggctagaaaagataaaaatatgtatttgaggattaatcaatcaaattttcccttaacataataggacttgttgttcaagatattcaagccagtaccaggctagagggagagaaaagttcccagatcaaatatctgtgtaaactaattcaactaaagccacaagaggaagagactcatgatgagatatttggaggtacaacatgcaaaattcatcacaaagtggaaaccagcatcttacaaaaaaagaacaacggcttgggatttagaacgtctgggctctggtctcaagttttgcacattcaatcatgtgtctatgcaatcatgtgtctacattccaggacttagtttcttgagactagaccatctctgataaactttctacctgattttcctctctttcagaaagttaggcaggtgctcagatcaactttttcgtcacaaaggaggaaggaagaagactttgggtgtctttcttaaccacagttttatgacatgggtttagagaatgcattagcagggactaagcaaataatgaaagctaaatttggtgtagaaaaatggggaacagaagatgaaagaatcagaaagaaaatatttaggagcaacaaagagagtcctctattgctttgtagtatagcgaaagttcctgtttttctcttctttagactctaagaaaaccagaaaacataagacagctttagagctttaaaatgttcttggatgccccaagacaagaaagcatgtcctgtggatcccacactttcccaattccctgatctagctaaaaccatatacaacttcctgatttccctggaggcattgaacctcatcaccaacccagaacagtttggcacgaattggtctctccatgaagtatctatacatcccattgcttcctctgtaaaagcttcaagattccactttggtgtcaagtttttctacagggcagattgttgtttatttcaaactccagaaaccctcactcttttctgggatccatttaaattggtgctatcaggctttttgaccctaaagaacctgtgtttacttggctcttctatgccttctcaccagcccccagtcagttaaaacacctttcttttgctacagaaaactgcaaccacatctaaagccaccatcagttcaaggtcttctgactgaatgaacaacccctccctcagtgtccagatgtgaaggatctgctcaatcaccaaagctcctgaattaagagtta

SEQ ID NO: 252 - DNA, 590890 bp, Homo sapiens
actataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggcaccaagtgccgccgactggggggagggggatggccacccgggcgaggaaaggaggcggagcgggccgtaccaagtacaccctcggggtggggggtgcgacccggcgagaacgggcggaggaacgcgacgggcgcccacacgcgccgccactctaatggtgtgcgccgtaccacacggaaggcgtgcgagggagagggcgagggtggagcgaggccccaattggcctgaggagctaaatagggaactttggagacagccccagcgctcggagagcgcaacaactacgcgctccataaacaaggaggcggaaaccggccctcaccactccgcccagaagcggggaatcccaaccaatgggcgcggggagtggtaagaagccaatccctggccgaggcgtaagccttcagccaatccgggctgaggggccaaaccaacgggctcgctgttggagggggtgacttggagagcgtaccgagaaacgagtagtttatggaaagccttgggggaaaactagacaaaaatacaaagggctgttttccataggacgtagccctgatcccaatttatttcgtctcctcatcgatcttaagggaaaggggtaccgtcattccgaacttttgggcgacggatccatctcccgggatgaaaaaccaagccaggccgcccgggggctggttctgcgtcggcggggggtccctaatgggaattaaaggcgggggtgattgggcccgggtgaggggagccgcttgctgctcgcgaaaggcccgcgccggctgtcagcgctgccccgggcttgcgacacccaggaggtcatgtccccatcccccgcggaccgtggccctttggccccttggcctggaacctctcctgacggtggcctcgccccagagccatgtgccgggcagcttagccgggtggaaagaacacgcgctggagagccgggcagcctggcccttgctccctaggaagccttatgctatcggatcggatcggctttaccccctcgggtaaatccttcccatcgcttgctatggcgtctgcagccttggcctagacctccttgatcagcatcggctgcactacctttgcatttcttcaggagcccagctagttcgtgcctcagggcctctgcacttgccctttccttggcccagaaaactcttcctcctacctttttcatcctgaagttcttctcagctcacttgtccccttacagagtcctcccctggctgaccacactaatgtacttcctccccaccgttaataccataacacattttattatttccacaccacttaaactctgaaatgatctgatgttttatttttctgtctgcaccacttacataaaaccatgacggcaggccccctgcttgtctaaattttttgcctagaacagcccctggcatgaggtggtaggcaattctttttcttaaattaacgtgataacgtttttgagccttaacttccgtataactgagaaataattggaattaatacttaactaaattgttagataaaggagaatatatgtaaatacccataataggctcatgataaccacatgataaaggtggtagtagtcattattagggcagccccaactggtattatttcagatctcccttctccccaccccatttttcttccctcttggcagatgtctctgattcttcactgagattaaaaaaaaaaaaaaaaatctagctccagcaacttctatcactcttttccaagtattgctgtgtaccacccattttgtgaacattctcatgtacccaaaggaccaggagtcccttctccctttccaagacagccgttggggcctgcgggctgcctctcacccctgtccagatcttccccctctttctctgcagtaggttcttcctttctactttcagcccaaatgggtttgacctacctgggggaggaaacttaatttaaccctcctcaagcactcatttctttcactgccaaactgcctagacaaatctatgtttattcctcccttttcttcaaggatctccttgataagctcagtcacccttttctcagtctttttttttcttctccttcaaagggttgttatagtatgaaatattccatttaaggcactcaacaaaatgcctggcacaaggtaagagccatgataatccactgatcacaaataatcaatgactcctcattacctacagcttcagatcctctctcaaggacatggtctgccctgtgtagcaacacagcacaaacccctatccaggcatgaagcactttctcaccctcagtgtgacttgagtacagcccattcatactttgccttcttctgggacacttttctttattctgtttttcgaatcctccctttcttcaagtaacacgacaagtcttactttaactagtgacaccttctagaacctaggcctgcactcttcaataccataatcaccagccacaagcaggttttttttttgtttgtgtttttttttttttgagatggagtcttactctgtcaccaaggctggagtgcagtggtgggatctcggctgactgcaacctctgcctcccgggttcaagtgattctcctacctcagcctcctgagcagctaggactacaggcacacaccaccacgcccagctaatttttgtatttttggtagagacagggtttcaccatattggcctggctggtctcaaactcctggcctcgtgatccacccgcctcagcctcccaaagtgctgggattataggcgtgagccaccgcacccgacccacgtgtagctatttaaattgaaatataagctagataatttaaaatttagttccccaattgtgctaaccacatatcaaataataaccacatgtagctggtggctactgtattaatcagcgcaaaataaatatttccatcactgtagaaaagttttgttggacagtgctgatctagaccatgaccacagtaaagttaccagccctacctttaactgctgtaagacctctgtgtaagtcatttcatgccttagtgcatactgcccccatatttttagttaacttttccaacatgtgcctttttgactcaactagactatcagttttcagatctgggctgacttctttttatctcccatgatttaatcagcatgaaaaaaagtgtttgttaaaggaaaaagaatacgcagattagaggagaagaggcttcagagttagctgggagagaaaaatagtacttgtaagggcagagatttatgttgcttcttcactttgtattggccctttctacacagtgcctaattgccttaagcctaaactgtgaattgtcaaagaagcacctctagaaacaacagggaaagaaatttagttttcagagcaactgcaaattagtttgtttttttttgttttttttttgagccagcctctcgatctgtcgcccaggctggagtgcagtggcgcgatctcggctcactgcaagctccgcctcctgggttcacgccattctcctgcctcagcctcccgagtagctgggactacaggcgcccgccaccacacccagctaatttttttttgtatttttactagagacggggtttcactgtgttagccaggatgatctcgatctcctgaccccgtgatccacgcgcctcggcctcccaaagtgctgggattacaggcgtgagccaccgcgcgccgcgcaaattagttttctataattgcattttcaccacacaataaggaagaacacacacacacacacacacacacaaaatcccactttagtatcaagtggactcctgcccccacatgctgttcagcctggagaagctttaattgatactcattctggactttgctcttgtcttcccctccactccagatttgactctgtaaaatgtaagtaaacatcaaaaaaagacgggaaaaagaaaaccttttgtctttcagccaaaatacatatttattgtaggaaaattagaaaatacaaacaagtaaacagaaataaaagtcccatgaaagcccaagacccagaaaaagaaaatcagttttaacattcggggtgaatttccacagatttttttcttttttgtgcatacacataaactcatatgcacatttttatgaaagaacgctctcattgtatttactattttgtaaacagcttttgttgtcctcttaacattcctccaacaacaaaaacagtttttagaactgcttttgacatctttttaaaatgcttaatagctgttacactagcttatagcttattcaacatatctcatacatattttcactttgaattattcttagaagactgaaaccagagagagacaagatagaaaaaggaaaaatttcatctcttaaatttgagaaattatatttttaaaaaccttctgcttttatgcaaaacacactttcagataagggtaagaaggactacatttataattctgttaataaaaatgaatcagcgaggttggcaaagaactaactaatttcctgactactctagctcacaactaatataaaagtaaaagtaaactgacaaaatgtgttattaaaagaaattctgaattgcaaaaaatagcatttcttctcatttaaacaaatcaatttttatcttgttttgttttgttttgtgttttaagagttagtgtctcgctgtgtcacccaggccagactgcagtggtgcaattatggctcactgtagtctcaaactcctgggctcaagcgattttcctgcttcagcctcccaagtagttgagattacaggcatgagttacccactgcgcctggcacatttttatcattttcaagtaaaatatatatatctatctgagacatttctgggaattgctgctatgaccagttgaagaaatgggtgaaagcacaactattagcaaaaagtcttaatctgaatattttctacatcttttatgtcacctgtgtggtttggggcccgtttgctggctggattaatgatacttgctcgccattatgactgactcttagggattggatatgcagtattgacagtattgcacttctgtgtccaccatctccgtctttcagctccactgtttgtagaagatagcctctgctcagcggcatagccctcctcactgtggccttcaccactcatgaagtccagggcagttctagtctggttgactaccagttaagttaccccctaatagacttccatgaggacctcattgacttccttgagtatagtttgtaggcactgccctcgtacctgggtgcttagcctatagggggttatttataacttttgaaacctgctctctcaggttttattgtctgagtcttttcctttctggaatctggatgtttttcttaggtttgtttcctgctcactgttggtgtgctttaccagctgtagcaggaagagtgctagcactgtaatcttgtaattcattcaacccctctcagcctcagatgctttatctataaaatgagaagcttggaatagatgacctttaagttccttccagttctaaaattacagagatgccagggcttattaagtaacatgtgaggtgcaacacaaccaaacaggaatagacagaggcatctttcctgttttcgaaagcttggagtctgaatcattacttcctcattatggaaacgtgatgaggtttgtttttttgttttggtttggatttttgatttttgattttggttttaataaatagctacaatttattgagtgcttataacacgctaggcattctgctttaaatgtgggattatctcagtcctcaaagcaaccttttaaagtaaataatgccgggtgtggtggctcatgcctgtaatctcagcactctgggaggccgaggctggcagatcacctgaggttgggagtttgagaccagcttgaccaacgtggagaaaccctgtctctactaaaaatacaaaattagccaggcatggtggcgcatgcctgtaatcccagctactcgggagcctggggcgggagaattgcttgaaccccggaggcagaggttgcggtgagccgaaatcgtgccatttcactctaggttggacaacgagagcaaaactctgtctcaaaataaataaataaataaataaataaataaataataaaatttaaaaataaatagtatttggattattatccctgtgttaacagatgaagaaattgaggcacagaggggattagtaatttatccaagattacacagctgataaagtggtagagctggaatttgaattcaaatctttctgactctataacttgtaagtcattgtacttcaaaaggcgaaattatgctccatgattacttgttaagcatgctatgtccagtagaataaaggaagctttaaccaaacttcattgttttgttttgttttgttttcaataacaaagtctactccacctaccttgcaacattgttgagagaatatatattaatgttgcaaggtaggtgaagtaaacattgttaaatatgtatttttaaattacacatatatttaaaaatatacacatatttttatatatatgatttttttaagtgctcataaaccatgaagccccacagaagtgcagggtgctattatttcctcttatgatttcactttctgtctttcatttcttagcatatgaattgtacttcttttttcaactttttttagtagttgccctaaagttgcaatatacatttacaactaatccaagtccactttcaaatagcactgtaccacttcatgggtagtgcaaatactttataataatgaaatatccctaattattccctccagtataactgctgtcattctttgcatttatatataaactataatcattcaatacatcattgctatcattttgaataaactatcatctgttagatcaacaagaaaaagttaagttttttactttattttcaactattctttctctattgctcttcctttctccatgtagatcagaatttctgacctacatcattttccttctctctgaagaacttcttttaacatttcttgcaaggcaggtctactggcaacaaattccctcaattttcatttgtctgagagagtgcttatttctccttcgtttttgaaggataattccacaggatacagaattctacgttggagggttttttctcaacagttgaaatacttcattctactcccttcttgcttgcatagtttctgagaagtcctgatataattcttacctttgttcttctataggtaaggtacttttctcctctggctcttccaagaattttttctttatcattgaatgctctggcatatttcaaaataactttttcctttctccttccagaagcatggattttttttctctgatattcactgtgagaacctaccaaagctctaagaggtaaaacccacacaagtgtgagaagcttccatgacagcctcgccccactgccccatcctagggtttttaactctcagacttgtccactgtgagtctcagcatttcttcaattacagtttaggttttcctcatgagtactgcttcactcagagatttctgtttctgagatgatgctccagcatgttgcaattctctgtatctgcttatctgaccccccagcttaggaggcagcagtttgccctgtgacctcacttctgtgaagaatctaagaatactggcctcagcaatatggtggaaaacacctctacaaaaaatgagccaggcaaggtgatgtgcgcctatagtcccagctatgcaggaggctgaggcaggaggataacttgagcccaggaggtcgaggctgtagtaagccatgattgtgcccccgcactcagcttaggcaaaaagacaccctgtctcaaaacaaaatctaagaagagtttgttcagtttttgcttgtggttagaatggagtgatgacttccaaactccttacataaactggaaactggaagtcttcctatgtatttgattcaacctgtttatatatcttatgcatctgtgcagggtaaggtttgggttgtaaattgataaagtacacgattcatggcttttgacaacctggaggagactctaggcggtaaactaaagcaagtgtttaaaaatggccttttgaggccaggcactgtggctcacacctgtaatcccagcagtttgggaggccaaggtgggcagattgcttgaaccgaggagttcaagaccagcctgggcaccacggcgaaacgccatctctacaaaaaatataaaaaattagcagggcatggtggcatgtgcctgtagtcccagctacttgggaggctgaggtagaaggatagcttgagcccaggaggtagaggttgcagtcagcctaaatcacaacactgcattccagcctaggcaacagagccacaccctgtttcaaaaaataaaataaaataaaaatggccttttgagacttctggttccaccaagatagagtagtcccatttttcctaggccctctcagaaaaacctggatataacacaaaaaacaagcataggaagactttgaaagttggaaagaagtcagactgcctagggatcccaagacttgaggaatgacatgtggtaaattccctagtttcctcatttcctcctaaatgtcggacaaggcactacagaattctgcagccctgcaccatgaataggcacagacaaaacaaagacccatggaaagcctgttttcctgagtcaaagaatagaaaaaagtgtggcccaacaatgaaaaacctcatcagcttcttccctagtccaaccaaacactgatggaacaactgcattccccaaacctcaacccccagcacagtttcagcagagccaaccaggaagttgatattccactctaccccttaacctatggaagtgggaggcagctctccagttccctgtgggtgactttggtaggtctgactgggagctgaccttttattccctaccttatagaagcagacaatgctccagttcccccagcagattgagcaaggagacaagcttacatccccaatcagaggcatcaaggtggtcgaagttggtgccacactttcactgggatgttgtcagtggagcaataggagagctgaacttccagcccaccatttgcaataagaccatgtgagtcagtacttcagttttgccaagttactgtcagtggggcccagagggaaactaaacatgcctgtgaagaagaagaaggaagaaggaagaagaagaagaagaattattaaataggatacaaatccaaactcttataatatgctatccaaaatatccaggatacaataaaaaatcattcatccaagaaccagaaaaatcacaacacggatgagaaaagcaatcaacggctgtcaaatgatgagataaatcaagtgttcaaattatctaacaatgatattaaaatagcatcataaaatgcttcaacaatcattcaaattctcttgaaacaaaaatttaaaacccagcaaaaaaaaagagaatttattaaagaattaaatgaaaattatagaacagaaaacaagtacaagtaaaattttaaaacttgctgtatgggctcgatagtagattgaagataccataggatagaatcagtgattgaggacagacagatagaacttacccaatctgaacaatagagataggggaaataatgaacagggtctcaaggatctgcatgatatttaaaaggaaaaaaaaattcaaagaatagctgaaaattccccttacttggcaaaagagatgaaacttcagattcaggaaactgaacaaatcccaagtaggataaactgaaagaaatctatgatgctaagacatgtgataattaagcttctgaaggttgaagataaagaaaaaatattgatactgaaaacagccagagagaaatggtgcattattgataggggagaaccaattcaagtgacagcagatttttaacctgaaaccatggagaccagagggaaatggcataacattcttcaagtactgaactaaaagaattgtctacctagaatccaatgtccagtgaaaatgtccttcagtaatgaaagggaaatggagacatctcagatgaaggaaaggtaagagaatttgtcaccagcagacctaccaaaaagaatggctaaagaaatttcctaaacagaaaggaaattataaaagaaggaaacttggaacacgaaggaaaaccacagcaaaaaaatatgggtatatacaataaactttcctcctcttgagtttttaaaatttctaaattgatagtggaagcaaaaattatagcattgtttgatgtagttctaaatgcatgtagagaaaatatttaagactattataaacagggtgataatgtaaagggaggtaaggtttctatatttaaactggtaaaaagatgacaccagtagactctgatgaatatatataatgtaaaacctagagcaaccactaaaaagatatacaaaggggtgcaataaaaacgttgtagataaaggggaaggggtgttattgtttaatgggtagagagtttctgtttggggtgatgaaaagattctggagatgaatagtggtgattgaacaaataacccacaggctcgcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgtaaaaagatatacaaacataatcaaaagaaaacataaatggctatattaataccacctaaagaagacttcagagcaaagaaaattaccagtgacagaattggacattatatagtgataagagggtcaagaagacatggcaattcaaaatatataagcactagacaacagaacagcaagatatgtgaaataaaaaactgatagaactggaaggagaaatagatcaattcaaaataatagttggagacttcaacacccatctatcaatgattgatagaacaactagacaaaatcagcagggatttgaaaaaactcagcatcaccaccaacagacatgatttaatcaacattatagaatactccacccaataacaccaagaatacacattctttttcagtgcccatgaaacatataccaacatagatcatatcctgagccatagaacaaaactcaacaaattataaaaaattgaaatttgttcaatttgttcaattgaaattgaagttatgttctgtgagcacaatggaattgaaccagaaatacataatacaaaagtattatggggctcaggacagttcagaaggagaggagccctgggagaaggctgagctcagatggttggggcagttgggggaaagaagtgagctggctctggagggccaggctactccatatggcaccctgctgggcagaggcagctccatgccagggcacaggacttggtgaggggaacaggagctggacctcagtcccattggccccctggctgggtgccctcttacaggggcccaactgtacatggtgaccctggatgttggcctgggaacctgtgatcttctactacatctggggctgacagaggactcgggggctgagaaggagacatggtctcacgatttggagtagagagaaggcttgaccagaagggactggctgtgcagcaggatagctggaggcctattggctgggcatcctgtctactgggtcctgggccggtcttggcagcaaagtcagggcagatagcaccagcaagccacaaccgtcctgctccacagagcgctagaacagccactcatcagttacagcaggactataacgatgaccaagaagagaagacaaaacagaagagggtaggtagaccagaaagagtgttcagaaagaagcttgaaagaggagaggagagacactcctgagtagtagcaccaacctaccagctagatttgtaacctccaactactactttctggcctcagttttgtcacctgactaagagggttggaataaaacgaatttaagtctcttttacctttgactaggactgacccaggctggcctttcaccagctcctgtccccatttccaagggaagctgggtggggggtagagggtgtggatgacttagtgtggtccatcctcagaccaaaaacccagctaggggcccacacattactgtctgaaacaccatgctcaggtgtgaacaaagatgcttggttactgtggacttttagttccaaggagggctgtgtctttcttaactcaatggaagaatcaaattaggagcctggctgggcatggtgactcacacctgtaatccagcactttgggaggctgagacaagaggatcacttgaaatcaggagttcaagaccagcctgggcaacacagcgagaccccatctcttaaaaaaaaaataggagcccacatcttcagattcccagggctgagattctgggaaactcagccaaactccagagctgatgcaagtagcaaaggaccttttttttggtcactggagcctggaggacagacaagggcaagaggcagagaattccagcctttacaggtcacagagaaagtggaggaggaggaggtagctgatgcctccacacccaggagggagggggaaatgatgagcaagatttttcaccctttcagtaaaacaaaaaaaattatttctcctatttccttctctgagattaatgataaactgtctatcccctaaaagaaaatgataaagactctaattttacttggaggcttagaaatgccatttctacgcaaaacagggagcccataatcagacttgagcggggcagagctttgatagaaaatgttttcctctctccctctatttcttcccctccttccccttgcaaaccaagatgcccgacagctaagaacaatgctcaataaaatgaaataatattttagtcaaaataggccaagactgctcccagccaactgtaaattagcattttgagggcaaatatgcagacaatttgagataatgaagcctgattattcaatccaatgaatgttaactagggagcagaggctccactgccttatctcactcccttcgatttatttttttaatcgtttcacatttgaactctttatttgtttctgttttatgcgccccctcccttcctctgtcacacacacacacacacacacacacacacacacacacacacacacacacacacacagagtctccctcccttctctcctccattcctgcccaggctgcagaaggggaccgttgcaggggccatcagtctttccacccagcctggccttcgggatggggtcagcacgcctcatggagcccctactgtgtgcatggtcctttgtagagttgcagggatttgggggtcaatgtgcactaaacagatgacacacaccctgcttcttagaacaggcctgggtgcaggagctggagaatggcaggtttataaaggaacatgccaggtacatgtggggctcagggaagtgggggtggaaggacattgcctttcatgtccttcaatccaccctccatgaaaggtcaatgtggagcacgccctgtccccaggagtcatggaaaactttcttaaattatcctttgtcccaggcaggactcactgcataatttgcaggacccagtggaaaatgaaatgcaggggaacttgcccaaaaatcattgagaatttcaagatagtcatggcagagcattaggacaccaagcaggggaccttctgagctcggggcctgggcaactgcgcacgccacacacccatgcagctggcctgcctccagcagctaaggggcagcctcaggccagtgggaggtaacataatgaggccttctgaaggagggttgaagcccttctcaagtgaagagagaggtttctgagacgctggggagggtcccagctgactggggctagcccctggggttgcgggttgccataggcaggagccccaatgcctgaacagctgtcagcatggtggtttccccttggaggtacccatccttcagcctagagatgatgtttacttggtggcggaaagaacagctcccaactgggcgaggctccccgctgttacggtgctcacctggcctcaacctcctccttgggtcctggccctgctttttccctcacgagtgtggcctcccagtccctgccctgtccccatgagctcctgcctgggtccagcccctgcagctgcccttccctcggggcccccttaccactcctttcagtgtgtgtagcaggaagtccccgcctgagcatggcctcccaccttgtctgctctgctcctcagcttgccctctccccaccagacctcctgcttgtcgagtgccctgtccatcactctcatcttcccgctgcctctgctcatgctgggccctcacctggggggtcttcagcccccttccacctcctatctcctctccacccatttcttcacacccagccaaagaaggcagctctgccttttaccggatgtgctcttgagtgggtgatttcacctccttgagctttagtttccctgtgggtaaatgggattgtagtggggcctgtctcgtgaggtgagtgagaagaccaaccaagctggtgtaagtaaagccccgaccccgggctggcccacctgaatgtgcatacctgttagcttgcactctggggagcctctgggaagcttcagaatgctacagccagttggaacagctgccctcctagaacttccgtagcctttggaatcctggtcacgcagtgtagcctgcattcttacactgtttcctccacctgatagaagtttcccaagagtagtgtggtgagcacttaggacgtgctccctcagcctcctgtgccaccctccttttgtctggagaggctggaaaattaagagctgcatctcccagattcccttgcagctaggcttctggaagtgaattgggtgatactgatcagttagactcctgaaactcagaaggtggacatgagactctttcctgccctgggtttctaatggctatcaagatagtagaaacacaattgcctttttctgcaccagattcccattgtccatcctctagcttctgggtgtcaagagtcaaaaactgttgttttggtttcagtaatggcttgattctggtccttcctacccttccttccttctttccttccttccttccttctttcctccctctctccctccctttctttctctttctttcttcctttcctttctttctctctccctctttctctttctttctttccccttccttccttctttccttcctttccttcctgtcccttccttcccttcccttttcttccctcccctcccttccccttccttccttccttctttccttccttccttttccttccttccttccttttccttttcctttcttcttttcttttttctttcaagatagagtctcgctctgttgcccaggctggagtgcagtggtgcaatcatgactcactgcagcctcaacctcctgggttcaagcgatcctcccacctcagcttcctaagtagctgggactataggtgccaccacgcccagctaatttttacgttttttgtagagagggggtctcagccttctgcttcagattactagtataagccactgtgtccagctgattctgggtttcttgatctctgtattgcagctacagtggtttcaaactcaattcaaggggtggtctcagaggttgtagtgccactgggagttagttcagaattctggaattccttcctggatgttcaggttagaacctaccattctggcttttccaaaaattttgaaagtatctaattctctgttaagtctctctttggtgggtcagtgcagtggatcatgcctggaatcccagtattttgggaggctgaggtaggaggatcacttgagcccagaagtttgagaccagcctgggcaatataggaagacctcccatttctacaaaaaataagtttaaaaaattagctggggccaggcatggtggctcatgcctgtaatcccagcactttgggaggcccaggtgggcagattgccaggtcaagagattgagaccatcctggccaacatggtgaaaccccgtctctactaaaaatacaaaaattagctgggtatggtggcacctgcctgtagtcccagctactcgggaggccgaggcaggagaatcatttgagccctggaggcggaggttgcagtgagccaagatcgagccattgtattccagcctggtgacagagcgagactctgtctcaaaaaaaaaaaaaaaaaaaaaaaaattagctgggtgtggtggtgtgtgcctgtagtctcagcttcttgggaggctgaggtgggaggatagcttgagcccaggagattgaggctgcagtgagctatgattgtgccactgcactctagcctgtctcaaaaaaaaaaaaaaaaaaaacaaattagctgggtttggtggtgtgtgcctgtagtcccagcttcttgggaggctgaggtgggaggatggcttgagtgcaggagattgaggctgcagtgagctgtgatcatgccactgcactctagcctgtctcaaaaaaaaaaaaaatctctctttggttaaaaatgcccagatgggctttctacattaaatcctgacaggcacaagaataaactaagccatctctttctcctgcacccccactgcacagcacctagtgtaggtctccctcttcctaagaaagccgcatgtcccataccagctgacccggcaccatggctggcctctgagctgcccgagcacatgctggacatttgcctctttgtgcatcgttcatttcctgccgttgccctgctctgtcctgtaagcaggaagctgactcctgcaaattacatttcccttgtccacatgcacagtgccttgtccactggtttcttgttgggttcaaccaatgcaaagcactggtgagaaaccggagggtgagagacggggaaggccagagtatttcctgtcctctctctgcttccagtggcatctattttgtggagccagcttctgccaggcaacacctgcaccacggcctcccagctcccagccattggcccctccacagttaaagctctgccctggcaccccagctcctggagtcatgtaaatactatctccctgctctgactgtctagatctatgggtagtagcagcttcctgaaattgctaatcttcgagttgcctcaccctcccctgttttcagcttttccaacactgtcgtaactgggttctcaaatgaaatcacctctctagtgagctacctggtgagctgggttttcctgacagtgtggttcctcctatctgctacaagtggggttcggggccttgagccacgtcttccctccttgtggacacagtctgtctcccctgcggcctccctggccattttgtcctggcccagcctgaagaaacatctgggcaaaatccttcggggtccctttccccagctgaggagtgggggggcgcaggggaggagccagggcgaacggcagctttcgccaacacctcactgttctcttctcgacatgtttactcacaggctgtctgggaagtgagaatcctccctaatggatgtttcacccaattaaataattaactccaagtgttgctaagcatcctcgcctctcaccttccagtcctggaggcgtcctcatgccaggctgcggctgctgctgagacaaggagcctagtgggaggagccaggagtgggggacagtgcccctgatgcttctgtacaggatgagggagataaatgcacctgagagggaaggtaaggagggctgttcagataggaggctgaggggaggctgagactcacaggaagtggcattagaaccttctggagcctttctattgaatattaagtccttgaaggtttccctctcccccaattcttcccatacgccacagcagggtccttgttccttcaaagaaggggaaaggaagggacacaggcttcttcctaatgggtagtcttgcgttatgaggagttacagagctgagctgctctactaaccagacagtcacataaggaaccccgaggggagaggctaaatacattcatactgtggaatatcactcaaccgttaaaaagaacaagatacattttcctgtatagataggaaaagatctgtaagatactataaagtgaaaaaatgcagataccagtacatgcagtttaatttaagtaaaaataatgtgcacatgtatgcatatacttgtctacctgtggaaggaggactggaactagggacaccaaactattccgaggggtgatatatagaacaaagctcctttcatgaaaaattgaactcacatttctgcagtgtaatcacacattctatctggatttattgtttaattgttttctattgtcaaacatgtctaagttattgacattagaacagagaaactccaacagagaaagggagcacagctacattttttttcttaaagattatatactatttctttacatggatgtcttgattgatttagttattgattcatattacaatggaaggctgaatcaacttatacggctttgaattaattgtataccttctattgatgagtgaataaatagttttttaacattcaccacaaaacatataaacattaacaattttgtgatattttacataaaacgtgcaagaaattctaaatttgaaattagtatttattttatagaacatattatgaaatactttttaaattagtaatcagaaaaaagatgattaaatagtaaaaacaatcatttgtatttttaccagatatcatcacttttaaaagtttggtttatattcttccagatagaacaatatactaaaataatataaataggttattatgtcaacaaacatttatatatatttttacagctggttacccccatgcaaaaacgtgccatatgtaatttttctatctaatatatttgaaaatgtatgttatttaaaagttttcctattgtaaacaatactataatgaatattattaaagacagtcttaagttagcaaagactgaaaggacatgttctctagtttagagtgtatgacattcaatcaagacctagaagacttatgccatcccccaagaatgtactaaaaatcatctgggattatagaaggaattcagggaaccctatctgcaagattatttacatgccagatccagtaatttatgatcttcttggtgtctgtaaagtcataaaagtcacaggattacaccatagtcatttgcttgaaattgcattcaagatatctgcattccattccttagatgctttccaaaataataaaatacctggcaggattctgtgtggaatctcagtcttcctatgtgggatgatcacatgtagcatccttagtgccaaacctaataaaacaagcttattgtttttggttttggcttttttttttttttttttttttttggagcatggttgaaaaaacttatgatacccagaacaggtttaataaatttttctaaactggatattgattatcaaagccaattatatgcctctaatatattgatttggagaatttagaaaatcaaatatttcaaatatatcagaaatctacatactaataaatttaaatgaaaaaatttctattaactaatgtatgtcagcagcttttattgacaaactcattttatttttccaaaggcatacaaagtagtttctataataaacctggcaaaaatagatatctagctagcattagcccaataatacaaataaaatcaaatcttgaaagaaatggaactttttaccattccagatagtataataaatgtaatagtataataaattcgcatagctctataacgcagatttggctaaatatgactctataaaatgacatttaaaagaacagtgttgtatacagcatatggatgacatagtttcttacaattttatagtaaaataataattacctgaataaggtaacatcaatcacattcatttaaaatagttgatttataaactagcttgattttaaaacaaataaaagaaactatctactaaggtaacaatgagtatcaattagagtgtcacttcacaaactttaatgttcatacatatgatggcatcttgttaaaacagagcctctgtttcagtagttctgcaccgacctgagaagctatgcttctcacaaacttcaagatgagattgatgttgttcttctatgaactatactttgagtaacaccagattatgagattattaataattcaaaaaataagcttattttttaggaaaaagtataaaaaaatcaggcattcaaactccacaaaaatactttttaagccatattacaaatagaagctttaaaatacatttcttttctctgcatggtttatgaatcttcatttataggactggctaacattgacacaaagttcacagtgggtattatatccatatatctacataagatgttcagcttctctcattctcagcaggtatggtctcattaacacctgtgattttaaaagcctgagtttctcccagcaagatgtagttttattaatatgtgttatatttatatatctctcactttgctatgttataatgtggaaccaaacctatagctattgctctagtatctgtttacttcataaatattgactgctagaggtgtgaatcctactagggtcttttgcataattatatgagggtaagcagtaaacaaaaatgactgaagaataaatgaaaataataacttagcttaaatgtaaagtaagatgacaagaataccatgaaataagagtcacagaaagaatgtttgctgctgttatttaaatataaatgttattatttttgaagaaataaatgtgtatacatctatctctttcagaagaattgtgaattgtttacaaatatattttctgaaatatcttttttttcttagtactgaggtctgatggtaaatgtttagtaactagctttgtataataaaaagccagatttatggtgttttcagattttcatggtgtaaaaattcccagtggccaatttcaaactactgacatgagatctcggaacatagcattaggaaaagatgcagaaatgggcttttttagaagccagtgcataatacttccaacacaacagtgacttagcagactgagcgtcactttactttaatgattaatcacaataattgtcaactgacattttttatttaatgacttataacatggttccaattataaaatgtggaaaatataagtaaaataaagacaaaattaacaataaatctaacacccccaaaatgattgttacacatatgtatatatcctttgagagcttttattaaaatatttatacttgtatttgttacaaaattgaaaatgtgttttatttcactttggcattctacccaaactgacaatatactataattttctacaattattacttattcctttaaaagtacatacaaaactgaatgaaactctatgctcccaatatactaaaatcaaatgattttattctctatagtttatagtttatattctataaaatctatagaatgattttattctctaaatatacatatttagaatgttttgaaaattattggtcaatgaacattctgacgcagaaatccttgtaaatattacctctgcttctttagggtaaatacctaaaagaggaattattgagccaaaaagtgcaattactttgagggtttctgataagtgtccctaaattgcactcaggaaaatttgtgtaagtttaaactcttaagtggagttgctggagaccctctttcacctgattcataaaacaatcttaattagaaagaagaaacaatccaaatgtctttgaggttcaagtacaccacatactatcgcatttaatttttatagtctttaattttattagttcaatttttcatatttgaattgcctgttagcattctttttcttttaatttatgtaggactatttacataataatgccatcaatcatttttatatgtgtgtcaagtttatcttctattgaataatttatcttcataattttgttcataatatttattgaaattagaatgcataaatattaaacttaaaattatgttatatagtataccatgcatgattataaatattatgtcaaatgtataaagtggtttttgctgtcagtttctgatttctccacccgatataattattttatattacctctaatacaacagattcaattctggataatttggggaacaacataagaacagtagtaatcaaaactaaataaaataactacatgcagtttacaaaaaaagttcacatcctatgaatatatttaaattatacttcacttaaatgtatcatttcactatgcattttctattgatttcataatcatattcctttattccatttttccccctctgctggcagaaagtttctattttctgttggcatttagagtatcctaacatttacaacatgcattcatgatgtattaaactataacatgaattaatatttgcctcaatttacagcaaaatgaagaccttctaaaattgtaactccatttatttttcccttccaacttccatgctatttttataatacattttagtatatgctatgactcccaaaaacattgttattgctattattatgctacattgtaaatattcatttaaatttacccactggaatacaactttgtgtttcttattacttcctgaatctataaactaccacttaataccatttcatttttgtttcaaaggtaaccatgagtgtgggttctgtcttagtgaattacttcagttttcagtgatctaaaaaggtttttgtattatcttcacttgtgaagttttaactgtatatgggattgaagattagaaattattttctttaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgatagagcgagactccgtctcaaaaaaaaaaaaaaaaaaaaaaaaaaaaaaaaaaaaaaagaaattattttctttcagtgcatagaggttataattctattgtcttttcacttacattgtttcatttagcaagttaagagtctaaaggtgttcttttaaaggaaacgtgtttttcccctgactgtccatgatatttttctcttttactctatgtttctgcaattcctctctgtgtcatcaggttttgaattgctttctgtgtttttctgctttggattcatgtttccctttcaattaatagtttaattcatttagaagcatatcttccttgttcttgctctactttcttgagcccgtaattatatgtaagacttttcattaacctttgcactctacaatattttctatccttttctttactatgtttgattctacatattttattctaacatacctgctagatcattaatttccttatcaactgctctcaaacctatcttttgtgttttttatattgtttccttttcacatctgaaatgccaattttaagcattccaattatttaataaaatgtttatattttgttttttatcttcagaataattctactacctgggataattctactagtgatgcacaatttttgttccttagctcagctagttcagattcttgtctcacaaccaggaagaattagacaagtggacatcaaagagtgagtggagtagaatttattaagtgaaaggaaagctctcaggaaaaaagagaggatgtgggggttggttctcctacccaaagacaggaaagttccccaatatggctgagcccagggttttttgtgggctgaatagggagtgtgtgctgattggtttgtgagtatgcagaaaaggttaaagcaaagacaccactcaaaggtgggcatgacaacatagaaaaccaattaggcggctgggtgcagtggctcatgcctgtaatcccagcattttgagaggccaaggatagtgggtcacctgaggtcaggagttcgaggccaccctggcaaacacggtgaaacttcatctctactaaaaatacaaaaaattagctaggcatgttggcacgtgcctgtaatcccagctactcggaaggctgaggcatgagaaacgcttgtacccgggaagtggaggttgcagtgagccgaggtcccaccaccgcactccaacctgggccacacagcgagtcactatctgaaaagaaaaaaaaaaaataggtaaaataggtgaaaaagggggatcaatcagaggaaagcacacaaaacaggaaggtgggtcctcaatccaatccaaagatttacccagcacagtttccagcttgaatgttggatttcacggggaactcatccctatctgccttgggatttgtctgcctcctgtctctatcaatcactagctggccttttctgttattttgctctttttccttgttttctttcattttgttttgcctccttctgtgctaggttatcttttattttatgctggatttatatttgaaaaatttattttgttcacttgcaatactcattacagatacaaagaatggcattgttttatatttttataatttatttaatgcctgacttaatataagacatgctgatttattagatctacttctgctttcggtatgttgtgatatcatacattatgtagtctctggaaaactctacttactttacacatgagagagaaagagagagagaatgaaaaaatcaaataagatcttaatattgttatattatctcaggacctcatccctttgcctcttgagagtgggatgttaatggcttcacattgctcctgattcactattttttgtttgtgccattaagtttgtcaaaactattgaaaacagtagagacctcacttatacagccattgacatttattcctctttttgtaacattatgaatgctaatctcaaaagcacaaagtttgaaaaatcgttgcttttatctttaaattacctgggtcttcaatctttcatccctttggacaagtggaaaattccatacttgtagtttttgctggtaaagtatctgaaactaccctgtggtaggcaccctctgagataaaccctaataattcccgcctcctagtattcacagccttaggtcatcccatctttaccttaagtgtgacgtagactggcttcaaaataattctgagaaactatttcactttcaaaattataggctatgaaaagactgtgatttacatcttgggtactctctctcagatggtctcttgaatggctcactctgtggatagccagctttcatgatgtgaggcagtctcagatggtctcttgaatggctcactctgcagatagccagctttcatgatgtgaggcagagtcttgtggagtaatccacagggtggtggtgttgaggtccaccaaaaagcacatgagtgagtttagaagaaggtccctccaccacctcctttgaaatgaatcttcagataagatcacaaccccaactggcaactgcacagcaaattcaggagagcctttgagccaaaggtgcccaaaagccatgcctgaattcctgatcctcagaaattgagataataaatgcttgtttctttaagatacaaagacttgtgctaataagctatgcagtagtagatagttaacacagtcttctctttcctggtttatcacatttgtgccaaatattctctttgctcaaactcaagcccctacttctaaaaatacaaaacattgcatctcttctctgaatctttcttgaggcaggttcttaaatttctatacctccatatgcacacaaaacacatattcctcctgacatctttctatctttcagaaccgttgctggtgaaaagagtgaaggtcctctgcgtacttttttcctgaattctcatggacctctctgccttttccaaataagggcaatctcctttccttgagtcattgttttcccacaaatcttctacttgactgaagtgttcagggcacataggatgacttcaatatgcctgaatttacaaaagacctttatcttgttttttatttttgattctattacagtatctgaggaaaggagtcaagagattgcctttctgtgttatatgaattgagagaaagttctgttacacacacataaattaataatttaatttttcacctcaaatcttttcttaaaaccaactaactataattttctaattacagaacaacttcttacatcagaaaatggctctacatttctactcagaactctctcagtttaggactaatcttactaactcattaaaagcttactaattcattattaaaatgctctggtttccctttttataagttgttcattacagtccatgtccaaatggaatggacctttctttgtaattctttacacactgtcttaggccagttgggctgctataacaaaaatggcatatactggatggtttataagaaacacatatttatttctcacagttctgaaggatgagaagtcaaagactgaggcactggcagattcagtgtctgggagcacccatttctcatagatgacatcttcttactgcacacttacatggtgaaagggtctagttaattctctgtgttctcttttataggggcactaatcacagtcatgaggatttgacccttatgacctaatatccacccaaagtcttcacctcctattatcatcacactgggggttcaaatttcagaatatgaatttggtggcgggggcacaaatgtgttatgggggacagaccataacacatatatctgtaattgttttattttttcagaaagtgatcgtattatttctgtgacatgttatgccagaaaataatactacctttacgcttgaatcacaatgtagctatcaaatataccttttcctataaaactccattacatagcatttaatatttaaaagtgatatttgaggcaaattattgcctcacagcttaatcctttcattccacattcaaagcatctcccatgattgtcctcatacaacaacaatctgtctgtgcacaagtggattaattcttatctattttatactttaaacacttacacttctaagtgttctctacatacttccgattagactgcaattacttctgcaccaacctaatacaaaataacttgtttttttttaattttgatcccacaggccttaatttgtatcaatcacttttaataaaagtgaggttaagtaatattttttgagtctctacaatttatttagtggcatatacactgcagatctcattctcttatctttcacattagtgatgcagttatatattagaacaggaccttattaagataataatgaagatatttttcactgctccagtggtcacgattggattttcatcattcagatacctaagaacagtggtccacagcctttttggcaccagggaccagctttgtggaagacaatttttccacagatggggcacggagtacagtttggggatgaaactgttccacctcagatcaacaggaattatattctcataaggagcacccaacctagatacctcacatgcatggttcacaatagggttcatgctcctgtgagactctgatgccaccactgatctaagaggagacagagctcaggcagtaatgcttgctccccactgctcacctccggctttgcggccccattcctaacaggccatggactggtacaggtccctggcccaggggttggggaccgctgcctaagaacataaatatggaaatatttttgctcaaatgcacctaaccttcagatggctaaaaaccttttagcacccggggtgtaggattgagagtggagattactggctgagagaaacagcaaaaaacattcctcccattgaaattaaatcactctacaattgggtttaattgctggacctacctggtaactaacaaaaatactaaacataattgattgcctcatcatttgaaaacaagaggtcactgaatcaaataaatggtaggaaaatttagaaccaataaaacaaaacattttggataaaagttatttctctcttagacctgttgccatgagagtcccataaatgaaccagatttatagttagcagactttctcagtcacttataaataatgaccactgacacataaaatgcattcacaagtagatgcttagattaccacaaaggccttaagacctaaaacatcaataatgtaatgagctttgttttttgctacagacaaacaaaaaatacaccctgcaattttataaaaaattcaggattaaagatttatgtacgcttatgactcaaatgtaaccattattgtaagaatgcatggtaagcatgacattgtttcactagtcttgctacatcttaaaattaattcgttcattcatctgtccatccagaaaggatgttactatgatatacagcttctaaatggcccccaaccaatccccaaatcttgtcattgtggaatcccttcctcttgagcatggactagaccatgtaactcacttcaaatgaatgcaatatgaaaaaagagatgttacttccaagactgattataaagggattgtgactttttctctactaggccctattttactctctctcttttttctttttctctccctttctctctttctgtctgtctctctctctgttcatctgtctctcactctttctctctgtcaaaaccctgattctaaggaaaacaggaaggtatgttttagtgaattctcataattttattttggcccagcatccattttgaatataaatctaactttctcatactagaagcaggactcagtcacacttgacagtttccagttctttaaccacatccaccctcagttcccaaatgtgattggtccacatatttgcctgatacaactgctccctggtgaccacttctacttccctatgggacagctagacatagcctacctgactgaccccactgaccctcagacctcacatggactgtacagatatgtcacagtgactacctgtcagtcacagcactacgtcctggaactctaaaacttatgtttgcttgctttaaacccaccacttagaactccctgtgggtaacctatttagataaggtcctggatccaataaaggcattggctgatagggttctctctctctctctctctctctctctctctctctctctctctctctctctctctctcctctctctctctctctctccctccctccctccacactccctgatctcttcgagtggcctccagcatgcagtgtaaatctcaagacctctaagtaataaaatttttattttcatcttgtgtcttgccaaatcgttgaaagaatactctctatcttaaggatcctaaattaaaatacatgctataaacagccctacagagagaggcacatgtgccaaaaagcttatctttctggctaactgccagtaacaaccggagggcagccaacagccaaacaagtgaccttataagagaattccacccccagtggagactttaaataatcacaaccctggcaaagaccttaactgtagctttatgagaattctgaatcacaggtgcacagctaaatagtgcctggattcttaattcagacaaattgtgatataacaaatgcttgttgaataagttcttaagattgggggttattttttatgaaacaatacataaataaagcagttaagtattaatacatagactctataatcaaatgacctgtgatgaatttctggctccataattcttagcttctttatcttagtcaatttatacattttttatatatcaatgtccttgtttataaagcaggtataataatagtacctctcacatcaagttctttcaagtttaaaacccaaatgtacatacagagatcttagagcagtgcctgattcacagtaggcacttaaattttagctactgaagctcatttatttgaacaataatattaagactataaaaagttactaatacactttgcgaaattgagcaggtgacataatcaccttgggtctcggtattctttcattcattcaaaaatatttaataagcaccaattctgcatcaacctgcgtatatatttataataagagggagagaaagcaacaggaataatagtgctgccactaagtgaaagaggaagactgcaggagaaacagatttcagggagaatatacggggcagtcaaataccaagagtgaagttgtatgagctgtcaatgcttgtgcagttaatatgttatcattatctaaggagcattatctaaggagcagtcattctcaaacatttatgagcatctgatatagggcccaagaagttgcatttcaacaaaatgacaaataatactacagctgctgctccaggaatcacactacagtccattaatgtggaatatgttaaaacaataaaaaaagtgagtttgattattattatcatttataataatcggggaaaaaatgcttgtccccctaaatgtaaaaccgttcttggtttaattgagaaataattgctatggttgctgtggaatttagtaaattttataagtataaaatataaccttccaatcaacacatttttcctacataaatttaataaacattgcattgcacgtggaaattaataagtggaaatcttagttacactgtcagttccaaaataaacagacttagcttaaacatttgtttcaggtttaagttactagcgacatagaagttatccctatctatttaatgttgtgcaatgttaattaaaattgtatttaaaaattttttttcaaaggtttattcctactatgtattgactttgtattggaggccgtattaaatttccatatttgctcttacatttttaatatctttcttaggattttctacataaatagtcatttgtaaacaaatgtgttacgctcctttatttccaatcagtatatttttaaacgttttttcttgcttaaatatattagctacggtctctagtagaatgttaattggaagtactgaaggcaaatgtattttcgttcttcaaaaattaggaaggaataatcaattttctaccattatgtatgatccttactgtggaatttttatagatagcctttataaagctatttatatttttctgaaaatatttataacgaataaatttttaattttgtcaaaagctttttctgcacttcttaagatgaccatagatttttttaaattatagcaatgtggagaaaataccttaattgattttgaatgctaaaccaatatttcattcctggaataaaatcttttttatgttgccagatttgatcgttaaacttctataaaaaaatctttgcattatgtttaaggggtactcctctgtatttttaaagttttgacataatatggtctacaatgatgaattcctaaaatgagttttaggtattttccactaattttttggaaaaattttgtgtaaaagtattattttttcttgaaatattttatataatttaccaatgaaggtaattagcccaggatttttcttttttggaagatttttatttattaatttaatttatttaacagacatggtgttattctggttttatgtttcttcagttatactgtagtttatattatttaaagcctttgcacatttcatcaagaatgtcaaatttgacaaagatttattgacactttttcctttttattgttgtaatacttgtagtagagggtagcaaacttttcttctgtaagaggccagattggaaatattttaggcttctcagttagtgtagtctctgacataactcttcaaatctgttgtaatgtgaaagtagccatagagaacacaaaaataaacggatgtggctatgttctagtacaattttttttttcacaaaaacaggctataggcaatacttggttttgagaacttaatatgctgattctaatttagagatatctagatgtataaataggatcaactacaatgtgccctgttgtattacagatattgtcaatttgtgttttttcttttttcctcatccgattgtctagtggcttttccttttcatttatctatccaaagagcaaaattttggtttgatacattttctctatctatttttttggatataactttcttttctaaaagtttgggtgaatatttaaggcatgcgttttaaaccttccttcttttctaatacaagcactcaagatttataatttttctaagcatatagaaggaatttgtaccccacacgttttaataagatatttaaaaatctttttcagtttgaaatattttctaaatatccttctgacttcctctttgattagttagttatgtaaaagtgtgtttcttatttttcaaattgttctgaaattttccagatatatttttgttattggtttctatttaaattcctggtaatgagaaaccaaactctatataacttcaaatctttgatatttcctgagacttttaaaagaatcactcaacatatgttccatctcattaaatgatccatgtatgcttgaaaaaaatgtttatctattgcaccaccataattcagcctggacgacagagcaaaattctgtctccaaaaaaaaaaaaaacaaacccttgatcttatcctttttgagtatagtttttataaatatctgttaggttataaagttgtttaaatcagttttgtctttatttttgtctattatatcaattactgagaaatagatgttaaaaatctctaaatatatttatgagtttctgcatcatggattctgaatatctttattggttttgtcttcattggcattgtcatatcttttaaacaaatttactatttttaaattatgaagcactactttaagacggtgagtggcagcactcaccgtcttaaagtgtattttgtcggatattaatgtgaagacattagctttctataagtggtgtttgcatagtgcatcttaaattttaattttaactataaagtgaatattttatgatcagcatataattgtcttatcatcctgataagctctcattttaattggattgtttggtatctttatattttgtgtgatttgttatatgttttctattatgcctaccatattgttatttgacttccactgttttctggttcataacttttctaaaaggaagtcagtaataattcataatgctgttttctttatttaatgtcatatttttctagctgcttatacgattttttcaacataccttaaatgttccattatattatatgtgcttgaggttctctaaacttattatgtctataaattaatatcttttagcatatttggaaatttttgcctttttaagtcttctaaaaaaaagtcatcaaatatgttgttattccacaaatatctcttctctttctctaggatatcaagtacactgctcttaaattgatatgataaacctcttaaacccttaaaatgatatgataaacttcttgatatagtcccacagatcacaaagattcatcatttttctccctaatggtccctctatgctcttaaatcagatatttctattaatttgtctttacatttgctgactcttgtttctatcatgtttattatgacaatcagttcattcagtatttgtttttaattttagaaattttgttttttaaatataatttgcttttggtttaaaaaatcttattttggctaaattatatattttcatttattatgaacatgttttcatttatgtcatttatcattactatagtagctactttataattttttctgttaagccaatatttaattcatctcaatgtatattgcagttgattgcccctattttttgcaatgtaggtctgctatggtctagatatttatgattcccaaaactcatatgttgcaattctaaccccagggtgatagtattaggaggtgggaccttggcatgtgattaggtcatgataatggagccctaaagaatgggattgctctgcctgtaaaggagacctcagggagatttcttgctccttcacccagtgaagtcgcagaaataaaatttagctctgaaccaaaagcaggccttctccagatactgattctgctggtatgatgacattggacttcctagcctttagatatgtgagaaagacatttcttttgtttataagctacccagttgatggtcttttgctatagcaacacaaatggactaagatagggttatatgtgtttttaaaatcacacatagcctaactatgaaagaatgaaaaaatatatattcagtaaacaaaaacagccagaatggccataatgatatcagacaaaaaagactttaagccaaaacatgtcacaagagacaagaagaacattatataatgataaatgggccaattcacaagaaagatataactattataaatatacatgcatccaacatcagagcacaaaaatatataaagcaaacattgataaaactaaaaaaagaaatagcaagacaacagtagtagcatatttcaatattccattcttaataatggataaaacaactagacagaaaaacaaaaaagtaacatttaacttgaacaaaactctagatcaaattaaccaaagacacatatagagaacatgccacccaacaacagcagaatacacattcttttcaaatgcacatagaacattatttagaatatatcacatttggcaacaaaatatgttttaacacatttaagaagatagtaatcataccaagtaaattttctaatacatatggaatgaaactagagattgatagcagaagaaagactggaagattcacaaatacgttgcaattgacaacacattcttgaacaaccagagtcaaaaataaatccaatgggaaattaaaaaacatcttgagaccaactaaaactgaaacacaattcaccaaaacttatgagatgcagcaaaagtagtagtaagagaaatgtttatggtaataaatctctatgttaaaaacgaagagagttatcaaaccagtaacctaactttacacctcaaggacccagaaaaacaaaataagtccaagacaaatgaagaaggaaatattaaagcttagtatagcaataaataaaatagagacaaataaaatgataaaaaaatgaaaattagttttttttaaaagaccaacaaaattgacaaacctttggctagactaaaaaaaatagataaggctcaaatgaataaaagcagagttgaaagagaagacataattgatgccacagaaataaaaaatgacagtaagagactgctatgaaaaattatatgccaacaaattgagtaaccgaaaaagaaaatggaataaaattctgaagcaaaaaacctaccatttgtaatagcattaaaacctgaaatataagaaaccagatttatcaaaatatgtgcaagatatttacattaaaaactacacaatattgctcatagatattaaagaagaccaaagtaaatagagaccatgctccttggttgaaacagaatattcttaatattccaattctccccaaaatgatctatagagctaaggcaatcccaatcaaaatctaagctggctttaaaatagaaactgaaaagccattaagaagttcttgtgagtgtggctggttggtctagggctatgattctcacttagggtgcaaaaggtcctgggttcaaatcccagaggagcccaacttttagttcaaaagttcttgtgaaaacaaaaataatctagccaaaaatattcttgaaagaggaagaaatttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagaaagaggaagaaatttgaagatatacacagtctgcagccagacacaaaaaaattacatattggatttttcctttttatgaaatgtccagaaaagagaaatatataaagaatacataggcctgtgatttcctggtctgggagtagaaaggatactgactgtaaataggcattaaggtatttgtttaaagtgaagaaagtactctaaaactggattgtagttatcattgtgtaacaaatatttgtgaaaacaattgagctgtttgcttataataggtgaattttatagtatttacattatacatttataaaactttttaaagtatttttaataaagctgtgtcattaaaaagaccaataatctgccattcctaacatgtttagtaaaaaaacatgaaacacgcagcataaggattttaaaaagatacttttttgccaggttaattattttattttaaaagcgaagactatttttttcaaattaagttagagaatcacccaacattataattctctgggaaaatgtgaagttgtgacttataagtaaaaaaacctgaagaccatgactccagaaaaagaaaatctaatgcaaagaaattctccttactccaaattttgagtcccacacattttaaagattttttttcaaatccttttatattaactaatttatgatacttaatgggtcccagattatataaaaattcttattctatttgattccaaaatctgatggagcacagaaaacaaccaccacaatatcgatgagaagaaaacacaacaagatgttatttaggaatatcgggggaaactttattacaaagctgggaaattgaattcattttatattaagaatttaataagctcttctgaagatgaattcatttcatgaacatttcagcttataaatataaatacaattattctgtgaatggtacagagtgaaaaatttaatgattgtcttgatagtgatttaaaaattatataaaagtatataaacatctctatatatacgtataccacacaagcgttgagttgattttactgtgaggcatccacattaacatttaaaattcaaaaaacaattttttcaggcatataaatggtttaacatttgtttccggaaattctaacaagtgaaacttgacaagaaaacaaaaataagtgttgtgattattgaaagaaaatcaacatatacttctatttgctggtgatatgattattctattgaaaagaactgttcacgtttaaatgaatagcattaatgtgatacgcacaaaatagtaagcttatggcacagaacttttttgagaggccaatgtagaaaacaaattgttattaccctgatgatatttttataagagaaaacccactaatgtgttgattgaacagaatttctatcaaaatctcaatatacattttgatttaataattcaaaaaatatttacaaatactcaattagaggagataaaaatagattattcactgaatgaatgactttgatgcaactttctaacgattcagggaaatttaaagttagattcctcccccacatttactgaaaactaaatttatttcatagcaagtatatatatatatgtggtaagagaattattacaaatatagaatattatatgtaaatatgtataaaagtttggctggagaagaactgcctagttgtgacactaaaagtggagacaatttaggaacctatttaaatatgtaacaattaatattaaaaagcaaataattttttaaaaattataataaatgcaaataaaaagcattactatttcataaagagctcttacaagtcaataaaaatttaaccggtagaaaaatggataaaagttcactgaaagtaatctctaaaataaataatttgaataattaataagcatctaaagaagcattgcacatcaatacattgtcaaattaatacattttttaaaatgacaagctgtcacatttttctgttcaataatcaaaactaaaaatatgttgcaatatccagcagtgactacaatgaactgatataggcactatcctacatatttttaagaaataaaaactcgcaaattttctggatgtctacttgctaacttttaaaaacatttagcaaatggaatgtgcatttgttttactaaactattcctttcaatgaattaatcctaaataaataataaaagtatgacacagttacagggatctttataagttatgtttataggagcaaaaattagaactatacaagatgctaaccctctattaaagagtcatatttcctccatacaatggagaactgtgagcccattaaaacctgataatgtcatgatctctaatacatagtcaagtgtaaaaataggtagcaaatcaaaattatcttctctcaatgtacatctgtgcaagtctgtatatgctcacatgtgtgtgcataaatcagtatttcatattaatataaaatatctaggtgaaccacatgttgaccgtggctttgcattgggtttatttttatttttgtgtgtgttgttacaatagaatttgtataacaagaaagaaaaaagtaaatatgttaaagttaaaatatctacaaagtacaagaaatatgaattaaggaaaagtagagaaatggaatcctgagtcttataaagaataacaagaataatatctattgtgacccaaacttaaaaatttccctcttttgaccaatttctcaccctgtgtgttattagtcttcttttgatatctacctctaatttatgttggattaactgaggtaaagacacagacacatttctctgtgtcatttgtattctggcacctctctctatttggctcaacattagactgtcattttcattttctcaggtaattagtgataaccgtgtaccaaatattaaatatataattcatgacaattacagaacaatttcctggggatacaaaatatctgaaatataatttaccctctctgagtgttgccagttgaataaaagagtttaaagttattatgttgccttggctatgtccttatttctgtcttgcaatgcaattcacttttggattcttgcctgtattcctccaacagatcaagcaacacctaactaatagcgtaagaatctggccctctaattcaattcttgtacattttctggaaattaaacttgagaaattgacttctattgtagacttgatcttagattactgtccatgatctctggagtttttactcttgccactgggatcctaaatttgtccccttcctagtctatcagaaaagtacacccagcacattggggaataataacaattaattaaagacagaggataaagcctattgagacataatacttcctctatattaatgacttgggaaatgtatttttatgtaatcaacagaagcattgagtctctattacctaaattatctttatttgattagagacattactaagaaccttaagctttgtaataattgaacccaatattttcaatatgtgaaaagtgactttagtccttgaatattatttatttttgttatggctacacaaatgtatgcccaaactgtattctaacagatattgtggtaattatttgataacaattacaaattgaatggttttcatttaggaattttaaagccagttggagtgaaaatgtcctcatcttctctgggacaggtaaggaagtaaccagtaagtttgaaaaatatttggaaagttacatttaatttcgtaatcagtgtattatttcctttatgtttagcaaaatttgttggttcttgtaataagtttggggtcttcccccaactgcataaagatacataaattgggatttttgctgactcaagaaaccttagccaaatttcattgatatttcttcaccattcctctattaacaaagtttaaaaaaagataagaaatatgaactcaaagtatacttttatgattactattttttaaaatcacctatttttgtgactgctttattgaaacactgaatcacttcatgtatctgcctagtgactcaaaaagtgttattacaattcactttaaatgaaagtgccactcacaatcttgataattaatgcaggtaaccggctgtgtgagaaagttaacatcagccttaacctcatgcactgaactgtttttcacatgtcagataggcatttcattttgaggaaagccatgtttttgttccttttgtggttggaatttataattaattatacaacatggagatgctgtattttaattataaaacattttaatgtggaacacatgagacctaggatacagaatgtagcaatcaagttgtacaacaaataatcaaacctctaattatgaaagctacagtggttcctgaaatctaaaagcaaaagtcacaggatggtttatttaacaatagaatttattatattttatatcttcttcaaagcttactttgtttttcctcttataggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaatcagaataaaacttgagatactcatcttttgtataacttacatgaaattgtaccaagtgatgactttttaaatacagttctagttatttcatatttctactcaagtaatgtggtttgctccataggagttatttgaaaataaacctcttttcaaatgctcaaatctattattgttctgtcagttgtgcaactcataaatactctttcctattctcttcaaaacacagaagtaatattaaaatcagtgggaaatattcttagacaagtcattgatacaaaatattaaacatatataaaaagtaaactttaatattcaccatgtatgttattattttatattcaattttataatttgttaacacacaaaagtattatgtcctgaccatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctacgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagtgacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagttgcagggctatatataaaacacggccatctggctcaacaatccatgaagctgattaagcaatacacaataatgtagttaaatgacttgactcactagttaggaccagaattcaagttgcaattccctgtgtgattcttttcttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatggtgtccacaactgtaggtttacctaccaaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcacacttttaaaagcaccctataactctaacactaccttgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcagatcacaaggtcaggagatccagactatcctggctaacaccatgaaaccctgtctctactaaaaatacacaataattagccaggcgtagtggcgggcgcctgtagtcccagctactcggaaggctgaggcaggagaatgacgtgaacccgggaggcggagcttgcaatgagccaagattgcaccactgtactccaggctgggcagcagagcaagactctctcaaaaaaaaaaaatttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaaagtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttcaaaaaaaaaaaattttgtctataaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacctttcagtttgactttgaaggatcactttcccctgtcattgcgcccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggtttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttctttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccagtgcacccggcccagttttttcttttatggttagttctttctgtatctagtccaataatttttaatttagaataacacactgtattaagccttataaaaacaccagtaaattccaagatctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaattttttttgttcttcaccttgtgtatgaggagcttaagttgaatactctaatgggagaaggaatttgttcactcgttgaacttctcgttcagttggcaaggtaaatttgtttgtaggttagaaactgccaggaagtcctgagatgactgtcttttccatgatatcatatagggaccttgtaaatacgtttctgaaatctgccttctcagaaaactaggacatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgcccttactgttttagggacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatctttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgctttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccacgcctggctaatttttctgtatttttattagagacgaggtttaatcgtgttacataggatggtcttgatctcctgacctcatgatccacccacctcggcctcccaaagtgctgggattacggcgtgagccactgcgccaggccaccaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttggggcccagttgttggaacagagctgaatcctggatgtttcttttgtttttttcacctttagggttagggcaaaatttttggttagattcttcttcttctttttttttttttttttttttttttgagacagggtctcactctgtcacccagacgggagtgcagtggtacgatcttggctcactgcatcctctgccttccaggctcaagcgattctcctgcctcagcctcccaagtgcctgggattgcctggggttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtgctgtggcagaaaacatgaagcattttggagaatatggaaaaacgttattccttttttttttttttttttttttttgagacagagtctcgctctgtctcttaggcatgatctgggctcactgcaacctccacctcccgggttcaagtgattcttctgcctcagtctcccaagtaggtgggactacgggtgcgcaccaccaggcccagctaatttttttcgtatttttagtagagacggggtttcaccatattggccaggctgttctttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttctttctgtgtatagttctgtgaatttcagtacatgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgccatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttgtggtttctaccttgtcttgtctcgtcattctctaaatacatcaaagaacaaaagtgtttaattttgatgaagctagtttatctgtatttttctttaatggatattgctttcagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctgtttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcttgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtcttttcctcctgcccttctttttctttactttacgttttgctccgcttcatggtgagaagtgcttcagagtccccccatggctccaaaacagacatacagaatgaagattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagacttcttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtagcatgtatcaaaattacattgttttaaaggcagtattctatatagtattccattgtatggatataccacaatttatcatttcacctgatgatggacatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttattttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatatggagcaaccgaaactctcatacattactggtgggactgcaaaagtggcacagcactttggaaaactgtttggcagtttcttgtgaagttaaacatacacttatataagacaaattccaactgcttggtatttacttaagagaaatgaaaacatatgcctacataaagacccgcatgtatgtgaatgtctttggggccaggcgcggtggcataatctcagcactttgggagaccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcgacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagacgtgaatgaatctcaaagacgtatgctaagttaaagaagtagcacgaaaaagactacatatcatatgattcattcacatgatattgtaggatagacaaaactgtagagcaagaaaacagatgaattgtttccagtgctgggtgtaggaggaaaggattgactacaaaaggaacgagggaactttttggtatgatgaaagtatactatatgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcgagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcggtttctgatgaatcctcacagtatttaaccagaataactgtaggtaagttggtgcaatgttgcctctggaaacaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatccatatgcaggttctgcagggccaattgcaggacttgagcatgcagggatttgggtacacatcgggtgtcctaaccaatcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagtggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctgctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaatcaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaaaatgaggatattatatgggatgtatgttaaaaagtaaagttttaatgaatattaaaagatgtttttgaagtcttatctaaagtatgttctaaatgaagtttctgacaggtttttttttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctctttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcgtgaacccgggaggaggagcttgcagtgagccgagattacaccactgcagtccatcctgggtgacagagcaagactccatttcaaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtagtaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccacttcgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtccctgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaatattaatctgtatttgaatgtcattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaatagtgaaaactggctgggtgtggtggcacatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaacaaaaaaaaacttactaatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagatttttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatttcggctcactgcaacctctgcctcccgcattcaagtgattctccagcctcagcctccccagtagctgggactacaggtgtgcaccactgcgtctggctaggtaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccaggcctgctttggaaaacatattttctctgtgctagtatagtcatgacacatcagcctatatatcctcatgttcagcaaatgcacgttaactgcttttgaaattattattataataaatctgttactcaggtgctctcatcagatgttccttcaggtacagaaactgaggagaaagatgatggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccctgatacattgtaagactcacatgcctgtgacattccagagctattctcttgggacacttctattttaaaattctctcctgttcttttatctgcttgtctctatcatctatcattcatctgtcactgttttctagttctctttactttttttatggtactgttttgaggggaaccgtcacccacacttagccacaggctgctgaagatctgaattagttgtgatttccctattaactgtttcctctccacaagtacccagttattagtcacctgtgaataaaaagatggagtgacagaagttgagtttagagcataggatttatgagcatggcctctagagccaggcatggccatgctgtgctgggtgactggttaaattactttacctcttgttgcctcagttgcttcatctgtaaaaataggcatacttcatgggatggtgctgtgtatcaagtgaattatttttacatagcacttagaatactgctcaatacatagtaaagctcagtgcagtcagccattattagtagtagagttcattgattctaagatgcaagttttttcactttttaatatctctgaaatcagatgtgtatttcagtgaacaggtgtcatagtttaactggcagtgctttctctttcttagtttctcatgaaataatgatacatcttatgagtggcatcttatattcaggggatataatattgttctcattataattttgttacttgtgcaaagttgaagtgaattatgtgtaagatttcctctaaaaaaattctatgggttgcaacagactcttggctttgaattttcctgatcccaaattaatgtggcggtcatgttcccagagaatctttaagacagcaaaatttttctctccagttagctagaaaagcagttatgtgtgtccagttaaggagggagtatgcttatgaatagctttgtctgcagagaaaatgttcgtcagttgtcagcctctgaagggatatttctgtgtcttcagatataacttgtataagcgtttcttagttataaatgccttacttccaaaatttctgttagttttttttaagtggatatatggaatgttaagctattttaacagaggaacaagttgaagagtggtatattaatttcacagtagagccgacagaaaccattttaaccttgaacatacctgatacataatggtattagtcctataaacctagccatcatgtaagtgaaaccaatctgtatttcccttggagacaccatgaaatccattcacctctaacatagggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttgtttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttacacagtacaccttcttttgaaatacttacagatgatatttcaattgcgctttgctttaaacattttcacatgttggtttttactttaattacagattactccaattgtgtcagcaaactatggctcttcctgtaggacgaggaatgtttacctttttttcgtaccatcctgttccaacagagccattgcctattcctaaattgaatctgactggtatgttaaattctgggctcaatgagaaaggaaagtgattaagtacatgcattaagtgtagttctttaaattagttaaaacaaaagaaatgctccctctatccccagtgattttaaattttcctaatagctgctatagtggttatcaaagctcaaataccatgtcaaactaaaccttgagagaagcagaatatagttcgttactcatttttgctttttaatgaggtgatttcaagatatacaaagtcacttggagaagttcagaaagatataattgataatgatgagactattgaattttaaataatcttgagtataatatgtaaaaatatttagttttaaaatgtcttatgtcatagtttaaacagatgatcattgtataaatcaagaaatgtcctaagcaaaaagagaaaaaatggtcacttgcagtactcccactcttctgcatcactccttttaacattttaatatatatgtttactaagtttatttccacatatttataattttatatttgtttaattatcagaaaatttaaatctattttagatattttttaaaatttacagtgaacatccttttatatctagcaaataaatgtatgtgtttataattatgtgtatgtattgtatacacgtgtttttaatcgatacattcatttttatttgcttcagagtatttcattcagtggatataccatagtttatagaagcagcctggtattgttggaaattacagttttttggtattataaacattgttggggcgtattcgtcctatgtatttaggctaaatgcttagaagtagaactcttaggacagcaagatgaatggttttaaggaacatgtcaaattgcctttctggttggtgcaagtttttatttctgctatgtataactgtagttatagtcttgattacaatgagttttttagtgtatgtccgcctaatgctgatttgaatgtgttctaaaggtgacaattacatagttgaaattatcattgaaactctattatagtatatatggttttgtgaaacctatacaaaatgtatgtgtaatgtatgttgtagtagtgtatagtatatgtagtagtatataatgtataatttaatatatgataaatagtacataatatatgcaaacataattgtacagtattttaaattgcatactttaaaaaatccagagttccactcagatttgtgaacagcttgtgctttgagcagcatgcaggaaatgagattgactaagtgaagaacacattcccatctccatatcatgcttattctgagccctaatctcactgagggacatagtgagcagagttgcttttaatatttaaattgtctcagaggtaaagcacctatggcaaaattttaacaattattgattcttgatggaaggcatggtatatagatgttcattttagtagtctttccaactgtttatatgaaagatttcatataatgagtgcgggttaaaaaggaaatctaatgcaaaattggcaaatgttaaaatgtattcaatctgggtgatttagcactcaagcgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtcttttgcatatgatgaatgaaagtttcagaaagttcactcagttttttcatattgatatgtctgccttttttgagaaagtgcaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactctgcatctacttaaaatttattttacataacatcttagaactctttaaaaatggtacttttaaagctgcagtgaaatggataactttatgcagtaattaaaatatttatgttaattattttatctgtgacttaagacagtattcaaaatatatttaaaaagattcagtgtttgctgtgtataatgtagatcaaaaagaaaagaatcaagaaaaaattcgtagggaacatatagcattgtgaacatataatttacattgttcttaaatggaccataaaagtaaatctagtgaatgcccttttgaagttcactgggtgactcaagtctataaaaggatgctttttacaaaactatctctaagcattttaaacaatagcatataattagatatctatatctgtatgtatatagagagagagaaaaaaaagagagaagggggcatatataggtaagagctgtagcagatttattaaggttcttgtgtctttttttttttttttttttttgagatgcagtctctgtctgctgcccaggtgggagtgcagtggcatgatcttggctcactgcaacctctgcctcccaggttcaaatgattctcatgcctcagcctcccaagtagctgggataggcacgcaccaccaggcctggcttttgtcttttcttaagatgtcatttttccttaatgtccaggggaaaatataggatagaacatttgaaattaacatcaatgtcatcagatgttgggatttataacttgtatagtttaacagtgatgttagtcttcattttggtttctaagctctctactgtttgaaagaaagatttcaaagcagtgattatcccagtcatctctgtataatgttaaattggtatcagttatctcattatatagcctcatacattttagcaaaaaggacaatgaactgtttagacagtgatggtttttccagttccattaagtttgactcacatgtacaaaagttttaagtggtcatagagacctaacattccaggcattatggggttaatggttttgaatgtagaaaatgtaagtaatcttagtctcaaagatctaaatttaacaatcttggttttgtgaatttttattctctcagtgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttagccaatgagtatgctggctttctcgtggctctgggtttgaatgggtaccttaccaagctggcgactttcaatatccatgactacttgaccaaggtgagacctgtgctcccagtgcctggctttgtgccttgcctggctattgtagtagctcctaattgctctatttgctcttctttcttcattcttgtacttctaagtccatttgtctcatagtacgtggaataatctttctaaagcataaatcagagtatgtcacttctctggtcaaagccatttaattaatgatctcccattgcttttttttttttgagtaaggcagggtagaatttaatgagtgacaggaaagctctcaacagcgagaggggacccgaaggtgggttgccagccacgaggctgagtctagaggtttttatgggcttgaaatgggggaagtgcatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgttttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatctttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccgggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaaaattcccaacaccagagggcaaagggggatcgaccattgctcttaatatacattctaggagctggtgtgatcctgttcacttctccagccctaggtggtaccactgttcttcgttttttttttttttttttttttttttttgatgtggagtctcaccctgtcacctaggctggagtgcagtggtgtgatctcgtctcactgcaacctctacctcccaggttcaagcaattctcctgcctcagccttctgagtagctgggattacaggtgcacactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttattttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctatgggtttgccttttctggacctttcatatgaacggagtcatacaaaatatggtattttaggatgggcttctttcacttagcctgataattttagggttcatccatgttgtaccatctatcagcaatacattcctttttattgttgaataaatgttttattttatgaatgtacattttattcataagttgatgaacatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaactgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcctgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatccggctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattgggtccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaaaattttttttttttgagagagtcttgctctgctgcccagcctggagtacagtggtgcaatcttggctcattgcaagctccgcctcccgggttcacgtcattctcctgcctcagccttccgagtagctgggactacaggcgcccgccactacgcctggctaattattgtgtatttttagtagagacagggtttcatggtgttagccaggatagtctggatctcctgaccttgtgatctgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttgtgtgatttttttctttaatttttattatttatttatttatttagagacagagtctcgctctgtcacccaggctggagtggagtggggcgatctcggttcactgcagcctctgcctcccaggttcaagcaattctcctgcctcagcctaccaagtagctgggattacgggtgtctgtcagcatgcctggctaatttttgtagttttagtagagatgggatttctccatgtcggacaggctggtctcgaactcgttgacctcaagtgatcctcctgccttggcctcccaaagtgctgggattacaggcaagggccagcacgtccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacataatatttaacagcttaacaacataagtaagtgacctccttattcattatcatcattcgaacatgtttcaccacatgtgatgtgtggatttgaaagtaatgaaaacaaaatgtaagatatttcgttgttgttgttgctgagatggtgtctcactctgtcacccaggctggagtgcagcgacctgattttggctcactgcaacctctgcctcccaggttcaagcgattttcctgcctcagcctccccagtagctgatattacaggcacctggcaccctggctagtttttgtatttttagtagagacagggtttcaccatgttggccatctggtctccaactcctgacgtcaagtgatccacctgcctcggcctcccaaaatgctgggattacaggcatgagccagcacacccggcccagatgttttaacaaaaaaataaaactttttttttgaatactctttcctttttccctttaaaatttttttctactacttggtaatttttttggtaagactcaaagtttcacagtatttgaatatcattgcttataaagacttaaattggcaatttaaaaagaactattttgggccctttttttttggtaggtaaacctacagttgtggacaccatttattatagtgtcataactttctgaatggagttatattccattcgtatgtccagtgcaacttgctagaaagttaactctaagatttttatgagatgagattttgagaagctagtttgaactgtgttgcttttgtttttacaggacggcctcctggtcctgaaatggaatactgcactgacagagagtcatactccttagctgctggcttggccctgggcatggtctgcttgggggtaagcatagcctatgccttcccatgcttcagttaggacatctacatgttgagacaaataacgttgacacctaaacctgaatattgtcccttactatgacttaatctgctgcccagctctattgtctttttggatatttttcaaagtaccagatttgcaaattgagagaaactgtggtcaagagtgggactttaagatttcttttcctccagcttgcagtgttcatgaacaaactgaagggaataaagttttttttttttaaagcgttcaagacatagaatgaataagtgacagcccactatgactgaaaacagagaatagtgaaaacgtatatgatcgggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagattgggggttcaagaccaacctgaccaacatggagaaaccccatctctactaaaaatacaaaattagccaggtgtggtggcgcatgcctgtaatcccagctactcgggaggctgaggcaggacaatcgcttgaacccaggaggcggaggttgtggtgaatcgagatcacaccattgcactccagcctgggcaacaagagtgagactccatcttaaaaaaaaaaaaagttatagtggaaggaatttttttcatgtgtgttctgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccgtctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgagtcaagtcatttaactacattattgtgtattgcttaatcagcttcatggattgttgagccagatggccgtgttttatatatagccctgcaacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtcactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttcataaaatttcttttcactcgtctgttattgtcttttccagcatggcagcaatttgataggtatgtctgatctcaatgtgcctgagcagctctatcagtacatggttggaggacgtaggcgctttcaaacaggaatgcatagggagaaacataaatcaccaagttatcaaatcaaagtaagtacacagcaaagtaatagatcaaaagtctggaagctgggaagttaattggaaaatactagtgttcatactgacattggtaaatgtgttaattttaagcatagttattattcagaggaattttataataatttagaactcttttacatgcataaactcttctttcaataggaaggagataccataaatgtggatgtgacttgtccaggtgctactctagctttggctatgatctacttaaaaaccaataacaggtatttctacccactcacccttcctcccgcggtgatagtgtgatatcctccctgaccttggttgtaaaattcagttatctcatgtgtttctttcccctgtgctggattaagctgattttttgttctttcaagtactgtaagtttttgaaagaaaacttgcagtatttgaagttataaagattttacctggaaataatgtatttggctattttaatggtatttgacaatatagttttcaatttctgttcatttctgttttgtagttgatgtcagtaacacccaaacaatgcccatgtttgttttcattaatttagcatattgctgtgaggactggttaagccagaaatacttatcatttagtgtgatcttggttaccatgtaaaacaatggtttttgcctacttcaggagcttttgtaattaccaaaccgtctaccttcctaacttgctatattaatgctgacgcttgaaagtaagatctttggcatttatgcttacactttgcatgaggaataagttgagtacaagacgttatgtcatgtcttaagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggctcacgcctgtaatcccagcacttcagaaggttgaggcaggaggattgcttgagtccaggagtttgagaccagcctgggcaacacaggctgttctccatgactgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacgtagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggttttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgttcggagcatgtttaaggtaggctaggccaagctgtgttgtttggcaggcaaggtgtattaaatgtattttctttttctttttttttttttatgagatggagtctcactctgttgcccaggctggagtgcagtgacaccatcttggctcactgcaacctttgcctcctgggttcaagctattcttgttcctcagcctcctgagtagctaggactacaggcgtgtgtcaccatgcctggctaatttttgtatttttagtagagatggggtttcaccatgttggccaggctggtctcaaactcctggccttcagtgatctgcccgccttggtctcccaaagtgctgggattatagacatgagccactgagcctggcctaagtgtattttcagcttaaggtattttcaacttacaataggtttatcagtacataaccttactgcatttgcatatacttatttttcaaaattctcaacagttgggaactgattcttaaattgttctgtttattattatcattgttataaaatgtatgaactttacttgctctaattaattttatctctgttgcatttttaagacacttgctcgatgcctgattttgtgggatgatattttaccaaattccaagtgggttgacagcaatgttcctcaagtaagtacatataataaatattatatctttagtagcataaaattatgatttcttatgggatttttcaaaattctgtaaaatattttttcttatgaaggcaatattgatcattaggatacctcttaaagacctaagaacttccattttaagattctgtgctgcacagaccaccgccttctcttttagcctcaggtccctagaaattgtagtttttaaaaattaaatatgaatatcggtgttgcgtgggagttaaaaaatgaaaggaaaaaactaaatatgtttgccagaatactctaaaaaagtgttgatatttttgtcataattaagtgcacatttctaagatgctattttacttcgtgacaattttagatctcctaataactcttttaattactttatatcatatttattcgataagccaagtatactagttaaaaatgaacagatttttttggtaaaaactgaaaaccgaatattgtaactagccactgcccttagacaactgtccatgtctagtggtctcagtttctttatgtagattgtttctttcagtattttcagaggaaaaatctcaaagattgaaagaagttaatatgaacacccacatcaccaatagactctataataatattttactgtataaacatgtttcatcacttatctatccacttatctattcctctatctaatccaacattttttgatgaatttcaatgttagttccaaacagtaatacactccatcccaaaattgtaccatatatattaactggaattggtatttacattttttccttttaagataaaatttatatatcgtgaaatgcacaaatgttaagtatcctattggataagatttgactaacacatagacctgtggaaaccagcctctatcccttgtgccccttccctctttgtgcattcacctgtacccccaggtaaccaatatgtattttgtttatctcccaaaatatgttaatttccagatgtagaactttatattaatgaagccacatatggcatatacccttttgtataagacttctttcagcgttttcaagatattgagtatattaatagttcatcctttttattattaggtggtacagattgagtatttcttatctgaaatgcttgggaccagaagcgtttttggattttggaatactcgaaattatacttactggttgagcatccctcatctgaaactctgacatctgaaatacttcaatgagcatttcctttgggcatcatgttaatgttcaaaaaggtttggattttgagcattttggattttggattttcggattagggatcctcaacttgtgtattccatttgcaatcctattaggtggggctggaattactgaggcatagggtagatggtatatttagttttattagaaatgataaatcttttcccaaagcggctgtaccatttgacacattgaccaacagtgtttgagagtgttggctgttgcccatctaaccgataattaatggtgttagttttttaagttttagtgctgctgatgaatacgtaatgatatctgactgttgtttaaatttgcatttctctgctgactgttaatgttgagaactttttcattggtttattggtcctccgtctatctttttttgtgaagtgtctgtgcatgtcttttgcttattttttaaaaaaatttgtatttttattactgcgttgctggagtttttttaatgcattctagaaacccgttctttgtcagatttctttttttttttttttgagatggagtcttgctctgtcgcccaggctggagtgcagtggtgtgatctcggctcactgcaagctccgcctcccaggttcacgccattctcctgcctcagcctcccgagtagctgggactacaggcacccgccaccatgccctgctaattttttgtatttttagtagagacggggtttcactgtgttagccaagatggtctcgatttcctgacctcgtgatctgcccgcctcggcctcccgaagtgctgggattacaggcgtgagccaccacgcctggcctgtcagatttcttttgcaaatatccctcccaatctgtggcttgcatattcattttcttagtaataattttaatgagcagaagatattagaatgttaaataatgtctgatttgtcagttttttcttatggttattctctattcctatgaaaaaaaccatttgtctaaccccatcatgaagataatcttttctgcttttctctaaaagcttccaaagttttagttttgtgtatacttacataattcatttcaaagtaattttgtatatgatatgaggtacatgttgaggttgtctaccagggaagctcatcagagactcagcacccaagtttttaattgggagctgacatgtaggtaaggtactctctgccttgtatgtacccaagttccagattctcaggagaatgtgtgttagcctaaaccacgctgtttgtagttcaagcacggtaaacacagatatatacattttgttttaaagcaaccggttaatttacttggaatcagattgtcattctttcttggttgctagctctaatcttggtgcacgtctttatcctgtgggctgttggagtctgccctgtgcacacatggttcatggatcaggcagacatttgcacagaatttatatacagagcttggggccctgtctctgtggctctctcctttgtcatattctgtcctcacctcccaatgggtgtggtattttcctgtatcctggttgttaaggccaagaaggttatgagcttttaattgtagcttttgccatctttcttggcgcagatagacctgctttcagagcagaaaccgcagaaaggaaaatgtatctagtggtgttcctctcttccatggatcgactctcccctctagaatctgcttgcgtttgtcctcactccagtgtcttgaggtcaggagttggtgaattaagcccacctgatttttagaaagaaaattttattggaatatggccatgcccatttgtttacttattgtctgtagctgttttttgttacaaatgcatagatcagtagttgctggtatttactatttgacccttttagaaatagtttaccgacccctgccatagatagtttggattttatattttgtctagggtttacacttggtgtatgagttgatctgataggaatttattcatctattatttgaggaagtagaactcctaggtttgtttttatttgtttagttcttccagttttgttaatcactgatatgaaagaggtgaggaagaattgttttaaatgactcgctcatttgttaccataattttaactctagcatattcagatgtcagagattttagtttttttgaaagtgctctttgaaatgtatattgtaggatgaaatactttttctttcactccttcattcagcacatactcatgaatcctctgtaaatgcaaggcacgtgctaaactctgtaatacattaaagatacatcagacatatagagtgttctcaaaaaactttagtttattaaatgcactaagttcagcttactgagattaaacatgtgtacaagtaactgtaattccaaagtggaaagtataaattcatgtcagagagtggtcttttttgcggcctggtgtggtgactcgtgcctgtaatcccagcactttgggaagccaaggtgggcacatcactcgaggtcagagttcgagaccagcctggccagtgtggtgaaaccctgtctctacaaaaaacaaacgaacaaacaaaaaaacacaaaaaacagtggtcgttttttgtttttatgaaaatatggtttttggacttttagtatagaataacatctctctcttttttacttcagactttataatgttatatttggtctttattacatcagggatactgcaaataggagagataacaatttcacagttctcctgattgatatttcctatcagcttccacttttctctgggttctcatctggagctacattgattctggagcagggttccttgtagtgagcaacctagcgttaaaaggaggatttttttttttaaaggtcactttgtaaactgcttgtctgtttgaacttagggcatatgtaaaataacaactagcatcttcatagtactttttctttcataaaaagctttacatacagggtgcggttactcacgcctataatcctagcgctttgggaggccaaggagggtggattgcttaagcccaggagttcaacaccagcctgggcatcatagtgagatcccatctctacagaaaaatacaaaaattagccaagcatggtggtgtgcacctgtagtcctagccacttgggaagctgagatgggaggattgcttgagtccgggaggtagggctgcaatgagccgtgatcgcaccactgcactccaacctgggtgacagagggagaccctgtctcaaggcaaaaaaaaagaagaaagatattttaagtctttgatttggtgatattcagtacataagaagactgtattataagtgccttctaatatttatttattttattttattttatttttgagactgagacagggttttgccctgttgcccaggctggagtgcagtggtgcgatcttggctcactgcaacctccacttagcaggctcaagtgattctcgtgcctcagcctcctgagtagctgggattacaggcccagctaattttttgtttttcagtagatacgggtttcaccatgttggccaggctggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttgttacagctagatattctgtgtatgtttttcggtaaattgttcattacctatactaaaaggaaaaggatgtcttttctaaacaatagttgtaacatagctgataaacatattgacagtttagcttatcttagcctagtgaataacctcacctgtggtaggtatgttggattaatgctggaaacatcccgtaaagaagaagtctgattagagttgtctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctatttaattattattattattattttttttttttgagatggagtctcactctatcacccaggctggagtgcagtggcgtgatcttggctcactgcatcctgcacctcccagattcaagtgattctactgcctcagcctcctaagtagctgggattacaggcgtgcgccaccacgcccagctaatttttgtacttttaatagagatggggtttcaccatgttggtcaggctggtctcgaactcctgacctcgtgatccacctgccttggccttccaaagtgctgggattacagtcgtgagccaccatgcctgcccttaattattattcttacttagcccatcttagatttgaaatttgattacattcaatgagattaaaatataggcttttgagtgaaacggtttggtaaagcttactttgtataaatatagccatgataagcagtatgttattcttcagattattaaatatttgtaatgagaacattgatatctaagtattcttgctttctatattgacagattataagagaaaatagtatctctctcagtgaaatcgaattgccgtgctcagaggatttgaatttggaaactttgtcgtaagtgatgtataatgcaaattagctatcctagcgtctatcagataattaaattgaaatataccatgtgggagtaatattgtccttgatttaagtaattatgaatcccacatgtttctaaccattatttatcagatgttcatgacgttggttaaagctctctgaagtacagagctcttgccctcaaaaagcaatattggagatttaacttgtatgtatttgttttttatcctttccattaaagaaattggcaacaattttaaaaattgtttttgctgcatatgaaactgtaggcaaggggcaaacttcatgagtaaggtgacccgatgcttctgctgaaaaaaaaaatacatagaaatctgctgactgagggcacttcatcattcccagaaagatataaactagcttagagaactggaatatttattgttacttatttcaagttaattttaaagtaaaataatgattattaaatttcttgtcacctgttttcagccaagcacatgtctacataattgcaggagcctgtttgtctctgggtttttgatttgctggctcagaaaacttaccagcatttaactgtttggtaagaagtattttagtttactgtgttctttttttttgtttgttttaacaaagctttaagatgcttcttataacttggaattttttcttttgtttttctagcataaatttgccaaagattttatgacttatttgtctgcacctaatgcttctgttgtaagtctttttatcattctccttgggaataaaattaaacttgaaaaaaatttactgatgatccagttacttatgtgttatcagatatctctgctgtttttttaaatgtagaatgagagatctgaagaaccattagctcatctttttatttttgttttgcgatattaacttaggtgagaatatgattaccctggaaggatgcacaggtatctagttcttgtgacaagagaataaaaaaggccataatattcacgggttgtcatacctcatgtaattctgtctcagtattaaatattgggaatttcctttttaaaaaatattagtacttagtaaggattcagttgcttttgaggcattgcttctctgatgacaagactgagagattttatttcctggtaaaagctacatggatttatgcaacactatttataatatggaaaagttagaaacatcaaaaaagtctaaaagtagttaattaaatttgattatggtttatttatatattcttacacagtggagctaccaaaatcacgttatacaagaattttttgtggctgggtgcagtggctcatgcctataatcctagcaactttgggagaccgaagcaggaggatcatttgagcccaggaggttgagatcagcctgggcaacatagggagaccccatctctacaaaaaataaaaaattagccaggtgtggtgacacacacatgtagtcccagcaacttgggaggctgaggtgggtggatcctttgaccccaggaggttgaggctgttgcatcactgcacttcagcctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgtgtaggtaaaggaaaaattcagagaaaaagccaaaacgttaacaccagttatctttgggtgtgacattccaagtgattgttatgtcttgatattcaatatttgaaattatttctgttgaacttatatttcataatcagggaaaatatttgtatttacagatttttttttttctctgagacagcgtctcgctctgtctcccaggctggagtgcagtggcgcgatctcggctcactgcgagctccgcaccccgggttcacgccattctcctgcctcagcctcccgagcagctgggaccacaggcgcccgccaccacgcccggctaactttttgtgttttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttatagtgatgtcatctcttcacctgacagacaggtcctcataacctagaaacttgtctgagcgtggtgctgctgtctctccccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctctgttcttcagtgcattactgcttgtgcccacctggttaaaaattttaccattctactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctagtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactgtaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttgtatttatctatgttaaaatttttatttgtggtaaaatacacataacgtaaaacttatcaatttttaggtatgcaattaagtagtgttaattatattcacactgccgtgcaaccaatctccagaaatttttcatcttgcaaaactgacattctatagccattgaacaactccctgtttgcccctcccaccagcctctggcagccgccattctactttctgttttgatgaggttgactgctccacattggtttagctttgtattgatttctgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttctccttctccactactctgcagtaccacatctattatataagttaagtgcctatacacctgtgtttatttctgggctattaggttttgctggtctgtttttctgtacttgcaccaatactccattgtcttatgagtcttggtatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaaggctgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttctttcatatcgaattgatttttctaccattctgctactgcttttctagtgatttttggtttttaaatggtcatgtatactctgtaacaacatttaaacttagcatagctacaccattatgtttctacccaaaatttctaacattagtatcttaatatttatctttgaattttggtttatcaaaagggtacaaagaaaatggcttattccatgcacatgccaaaatagatgtatctctttgcttaaattttgaaatctcttctttctaatccattaaatatataagcatatataatgaattataagtccttatttaatactccaattattttaaaagacagggaaagagatttgggtatatgtgtgtgcatgtttgtgtgtaagaaaagtatttatactcaatagttttagaagtggttttatgtgatgtcctacaccatctttatttcaaaatattttttagaaaaactctgggactttagattaatttgcctgtttgctatactaaatttgagcaacaataaagtaatttaaggaaaattttaatagaccctttaccaagagaatatttttaaagtctatgaaactttatcttaaaagtgtatcatattggtgaggaaagaatttatatttagaggaatagttgtttatacagtcattgtaactttttttttttttgagaaggagtctcgctctttcgcccaggctggagtgcagtggtgggatctcggctcactgcaagctccgcctcccgggttcacgccattctcctgcctcagccttccaagtagctgggactataggcgcccgccacggcgcccagctaattttttgtatttttagtagagatggggtttcaccgtgttagccaggatggtctcgatctcctgacctcgtgatccgcccgcctcggcctcccaaagtgctgggattacaggcgtgagccaccgcgcatggcctcgttgtaactttttaatgataacttttgccttttcatttagtcagtcattctaaaggaatcatcatgcttcacagaaacagaaaaaaactgtttaaataccaattacaacattctgtatttttaaaactcagatttataattgtatatttatatacataggcatatacataggcatatacattaataaaattggataagaaggtggcatacttggtacatgactcttcaatatttataatttctaggactgcattcatggtcttcactactctgctattttatgttaaaaccttgcttcaagggttgaaatttaacatttatgggatattactttggctttaaatagtgatgatcttgaaatggcccaaggactaaatgaaaagtggaatgttcacaccactgacactcttgtattatgagggcatcttatcagtatgccttactattataccccagtttcctgattctcaagaatgccttgaaagtatgtgcaatataatcaataacatctgtccccaccgaacttactttgcagttactctttgagcacatcaaattcttccattgccgctcttctctgtgccctttatccgcacttcccagctcacagcactgacaaccggtgagtctagtgattctgtcttcaatgtgatacttattaagttctctaaggggatcatttggttgtattttggtttcatggaattatttccaaattagcattgttttgttcttcaacttagttatattcctggctaaatcttttaagaaaattatctcacaaagtattagaccagaggataactttggacacctgatgactgaccagtcttccaccattctcagatctatagaactgctctaaacccaaaaggagatcaagtaaagttgtctttagggaaaaaatcatcaggtaaaggatagttgccaagggaagttcaggatactttttttgtgctctaattatttaattccaagagaaaagtttgtctgatttagtggcaatgtctgtatgagtttctttttttcctttcacatagatgccgagaaattgtgtataaatgacatagacgggacaagaaaagcaaaatacagcaaaaaaccagagacaatttagaagtggcagtgagcggtagaacttcaaaccatgtagaagcagttaaaagctctgtgttttagggtacgaggaaccaccaacacttaagtttccctagatatagtttgagacatagcagatctcttgcatatgggggcagagaagaaaatagcccctataagacacctgagccctgtgctcaactgaaggcatcccatgttgtctccccagagacaggtcaagagccctttattgtttatgggagaagggtcaggagcacttatcacagtaacctaagccatcattttaaactacactacaatgtataaccaacgacagaagaaagatagctgttttacaaaagtagcctaatctgaagaccacactctgatggtaggtgcagcacaagaatattgttaagttaatacacttctgacatgtggcctcatgcctgtcatttaggaaagattttttgagttgttaaagccaattattggctagggtacagtggagagccacactcacatactgctggtcatagctatttggcttagctattgtaaacgaagccattttccattggtgacaagaatctttttttttttttttcgagatagagtctcgctctgtcgcccaggctgaagtgcagtggcgtgatctcgggtcactgcaagctccgcctcccgggttcatgccattctcctgcctcagcctcccatgtagctgggactacaggcacctgccaccacgcccagctaactttttgtatattttagtagagacggggtttctccgtattagccaggatggtctccatctcctgaccttgtgatccgcctgcctcagcctcccaaagtgctgggattacaggcgtgagccactgcgcctggccggtgacaagaatctttatgtaatttgttagtgtcattttttctgatctttattgattttatttttaatagatttatagaaataaatgtatttgagtaagaagagggaagttactgtctataaagctttttaaaattgaagtctcattttatccttctttttttttttttgagacagagtctcactctgttgcccaggctggagtgtagtggtgcgatctcagctcactgcaagctccgcctcccaggttcacgccattctcctgtctcagcctcctgagtagctgggactacaggcgccagccactgcgcctggctaatttttttgtatttttagtagagacggggtttcaccgtgttagccaggatggtctcgatctcctgacctcgtgatccacccatcttggcctcccaaagtgctgggattacaggcgtgagccactgcgcctgggcgatttttttttgttttttcttctgagatggagtcttcctctgttgcccaggctgcagtgcagtggtgtgatctcagctcactgcaacctccatctcctgggttcaagtgattctcctccctcagcctcccgagtagctgggattccaggcatgtgccaccaggcctggctaacttttgtctttttagtagagatggggtttcatcatgttggccaggctcatctcgaactcctgacctcaggtgatccacctgccttggcctcccaaagtgctgggattacaggtgtgagccactgtgcccagcctatttttcttttatgagatcttaaaatatgaaaacttttttgtttttacattctaaaatagaaatcttaaagtttaaaaaactgtttgagaaccccaaagaaaaatattgccatacccacatagatgtttgatgtactgtgtttcaaggacgtgtgtatatgtatgtgcaagtatgtatgtgtagaagaactttgctgtctgagaagaattgacatcctgtcttcccccttcttccctatcaatccttaaggaaaaagaaaaaaaaatctgagaagataaaaacagatgcctatgttgagtagaaagggatttttgagagtgattgattttataagtggtcagtttgatagtaaatattttcatattatgatactttttacctccctgtaaaacctcttcactgtgaagactaaagtaaagaattattgggtcaaaggtcagttatataaaatttttaaaagataatttctccattactttttaatagaatcttatctgcctttaagatttctgttcatttgaagatattacttgagcttctgtcctgtcttagcttataggcaacagcagattgcagagctcatattgtcacagttgtttgttacccactctctgtcttttttgtgaacaggtatcatctccaggctctccggcacctctatgtgctggccgcggagcccaggcttctagtgcctgtggatgtggacacaaacacgccctgctatgccctcttagaagttacctacaaggtatctctccctatcatttacttgtaattttattaccactcatccgtctttgcaggtcataatatttcaaatgtgttgtccagtaaaaggtgataagtaatgaattgaactttcataaaaatggaagcttccaaagttattgtatatcctgccaggccattcatgctcatttatatgatctgggtatcactttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttatgccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtgttcgggagttgggtccaaggggtcaattcaacagaatggcatagcgttaaagatagctaaataaaagcctctgctttcttcatgtattgtagcagataagaaagctgcagcaggaggaaaagtcagaaagaatagagcaagtcttttcttagagatctttattgatagcttaggtggcctcagaacatgatttacattcattttttgtctggaaatggagcttgttaccttccagatgcctctttctggctgttattgtttcctctgagaaacataggtttcagtttgtcagatgagcatatttttcagctttgggttgactatgtttacgtttatcttgacagattaaagtaaaaggcccaagatactgggaactgctcatagatttaagcaaaggaacacaacacttgaagtaagtacattaaatttctcaaatttaccttttaggaagtgaatagaagtatataagaaggtataaattatagattattatctggaatgtgactcatcaccctttaatctcattcaagactatatgtagggtatgtcttctgtaaaacagtctgtatctttgaaacaagacttgtgttagaaaatgaaagttttaatttcaaactccaaccctaaatatttatttattgagaaacttgcactgacttccttgtgacagtaatggacttatctcttggtatattaacataagatttagtttaagaaagtgtattagtccattttcacactgctataaagaactacctgagactgggtaatttctaaagaaaagggatttaattgactcacagttctgcctggctggggaggcctcaggaaacttacagtcatggcagaaggcaaaggggaagcaaggcatgtcttgtatggcagcaagagagagagagagaggtgcaacacttttaaaccatcagatctcatgagaactcactcactatcatgagaacagcatgagggaaatctgcccccatgatccaatcacccccaaccaggtccctctcctgacatgtggggattacagtttgacatgagatttgggtggggacacagagcctaaccatgtcagaaagtaaagctgatttgtacacgcacaaaagaactttattaatcagtgtttatcagaccacatcttttgttgcatctctttaccattcttttgctagaaagttctcctaaatttaagattattgtagataatatatactactcagccagtttattttgggtggaaataatcacgtgcagttattttagagtgttgatacatttatacctaaagtagcatgtcagttaagcctttaaatttcaaggaagtttaacaagcatgtaaaagtttttatagtttggtcccaatgtgaatttttccagactgtatattagctgttttctgtattgttctgtccttagatttgcagcattattttcttcttgctgcaaaccaattaatagatatttagtacctcatgtaccctaggcatagagctaggggatatagggaatacaaagaaatgttagacaaaatgttatcttcgaagctcataattgagccaatagtcaaagtgcctcctcatttaacaagttccatgaatctagacaccaaagaaaaacagaactttattctaggctttctcatagggactgatttaatcttagacacagtaaataatcatttaccttagtggaaaatggtaaaagcttcatctcctgtgaacatggtattgggaaaacactgtttccagccaagaactgccagtaataccttatattaaattcattctttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgctggcttcctcgcccattgctataaacttcaaaggtggatctgcttcctttttcattgttgcagattgtaaagactgactgtggctctgtttgctttttatgtgataaaataaataataaaatataatgaatataaaatactgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatctcggtgaggataaactgatgacagattcagacttcttttattagtttgctttattatttgcacagtacttgactgccagtgcagtagtgtttgaaataaggaaatagttacgataaatgagggtaggaagcaatctcattcccttggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccctaaggaataattagacggcaaaagtggggcaggcagactggatgagtggcagccagaggactgagttagcatcctttgttcttccaagtacggagacagcagtttattttaattcaactcatatttcattttagtcagttacttatgaccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagcagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataacccttctttttattgttcatacacctgttaccttcaagattccaagggtgctgagcagatttttctttatttttttgttttttgctttttgagacagggtcggttttttctgttgcccaggctggagtgcagtgacgtgatcatggctcactgcatccttgacctcccggagtgaagccatccttccacctcagcctcctgagtagctgggactacaggcatgtagccaccatgcctggctacttttttaaaaaaattttttgtagagatggagtctcactatattgcccaggctggtcttgaacttctgggctcaaatgatcctcccaccttggactcccaaagtgctgggattataggcatgagccactgtgcctggcccagatctttgacttaatccaccatagagacaaggaaagattggatgcatatatggccttcagaaaatttctcaacctctccaaaatgtagtttcctcatttctaaaagtgattataatagaacctaccttacagtattgttttgaggattaagtgaaataaccttcccctctcttttttattgaatctttactatacatgggacactctgctaatacttaaatgtcatttaattatgaccctgagaataggtattttatcattctgggcttacagatgaggaaactgccactgagagatgtcacatgcccaagatctcacagctagtaagagctgggctgtgcactccaggtcacgggtctctaataaagcccatgcccacccttaaccccagctggacttgactctgccacctcccctaaacttgttctggtcagtgttttttttcttgcagctttgttactcggtttcctttctggatcctactcttcccagcccaacccaaggcatagctctgtgatgtcctatctactcattttgtcctagtttggtccattcctctcttctgtagcacttactatccttaactgtctcttgggacttaatttttttttttttattaatgtttaatgttacatgtgctgtggcttttttaaaagattgtagtgttacttttatgtcattcattataaaacttaagaatgggccatagtagtgctatacaatttgtttttgaattgattttggaatatactttgtgctacaaaacttctgattttctgcagaaacaggaaattctggatctcttttcttcagtactctatgaatgtgttacccaggagacctcagagatgttgcctgcatacatagcaatggatcaggtatggatccaaaaacctataccaattctggtgaaatttgtcctgtagttcaagtaactcactgaatagtgtggtaaggttcctagtgtccttccttttagtttcccatttgcttttggaaatttaagaaaggaaaccatataaaatttgaaagctctcaaaaatccaaaaagcttgggctttatgttgacaggagtgccccttggggggctgtcttcctttaagggttcccattcctcccttttgtctcccctgactaggagaggaggggagcactcccttcctctctcccatcttatttttgcctccctcctggcaatgcctctttgtagaagtctgcatgtgagccgttagtgaacagaaccctagcgatggcagtactgtgaaattagacctatgtgatgaagcttgcaagaggttacagagtccatatgcagttatctaggcattggagttcatttttaaatttctcttgttattgctattttaaaagagcctaaaggggtaatgcagaaaataatgcttaataatgttcttaaaggatcagaccaatttattcactttaggcaaattagtaatacatacaccttttcagtattatcatatctttcagacccagatttggagctaagccaagccagtagttttctaacctggcagaaatttgccttggtatcttaaaaatacagatcctttaattccatgtctcatctattgaatcagaatttctggggtgagatccagaatctagttttaaacagctctttaagtgaatatagtaagttcacagctgagcatctgagactcagtgtctaagagaaataacctttaatgataaaaataatttgctaaaaagctgaatggaaaaatatatttagccagaggataattcccccaaaccagaaaacacacagtgttaagtaacatcattaaaaaccaagttccaatataactaagtaggcccagaatgccattattgtctggaatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatctcaagggcagtattattagtagtgttcttcttgccctctaccccctgggatctctgccatgtcattgtacccagcttgagtttcccagaggtgactggctatgaccttttgggtcttggttattcggagctgttgagccaagaatgagctcattcacctttgttacttttccctgcaagctcctcatgtagggccatattgaaggaggtgagccattcacctgtacccagtgacggcgcctctgtgggcagactgcatcaaaacacagaatggaccaccccccgaccctttataattcggagccacatttaaaaaatactcagtctacaactctgatgaagagacagagcactctttgattaaatagattgttgtcctctttcctcttcaaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaaggtaatagtagcattgtagcatagcgctcttgtgcttttgagatacattcggttcaggcttttctgttgtaactttgttttttcattggtaagcaagataaatctgagtataagcaagaatggctatagatttaacgtttccagctagatgaattagactttgattatctactttagcttctttagtaaaatacatctgacccaggcagataatatttatagcattttaaataccacttggtgctcaggaccttgttctctcttccctagcatcagatcacatttcctttccagtgcctctgtctcctgtttcctaggggtgtggcctgttgccttcctgaggccagcagccatcctgtttttgtactggcaccacatgtacatgtagaagttgacgtgtgcttgctgagtgagcttgttgtaccaactcagttttgaaaacctgggaccgcacagctatgtgatgtcacagtggtggctttctatcagcaggatttgtgattgcaaggaaattgtagttactcgttaacagtgtagaagtgattctgacttacatgaggcaagcgatggggcctttagatttatggaaatgtgtctgtgtgttaaatacacctgaaactgattttcaggagtagactccttgatcttttcattctttttagttcattcaaatgctcccagtaaatatctgacagttgcttgctttgggttaatactaaccttagtaatagtagtagaaacaattcttgctttgattagtgaaaactattagtaatcaatagaccctaagcgtttgaatataattcagtttaaaactatccacctgtaacactaggaaataaatttctgaaaaaaattaaattgtaaaccaagttgtgagggatatacttggaaagcctgattgcagactctccatgtttatatttaaaagctgcattgtatttgtcatttcctgttcagattcaaagatcatataacttcataattttttggatagtcatttttatcctcatttttggggaaaaacatgttatttcaaaggttttcgtgtttcgtttttattcaatttaacatttgatcacctatggcagacctttgctattgataataaatacttccttaaatctttgcagattccctgatttgcacatttcatataatgtatggaactttggcagtgattagaacattctctaaaacagggccctgattgccttgttgctctttagcgcatttggtggtttccagcattgctgtcagcctccattgaatttgacttgccacacagatttatcaaaaatgtgtttattttttagtgaaaaactagaatttttttttaaaacaaaacctcttaaatatatagtctcctctcttacaagcactagcagttggcattggggtagagaacaataaattaactgaaaattggaaattgcattcatatttgtgtgtaaaaatcacagatgcatatgtggactttcaggatcactcactaacaactcattagatctgagataacccattgaatcactacactaatctgaaaatgcagccaatttatattatataaatgtcggttttgttttttctttttttgagacagagtctcgctctgtcaccagggtggagtgcagtggcgcgatctcagctcactgcaacctccacctcctgggttcaagcaagtgtcctgcctcagcctcctgagtagctgggattacaggtgcatgccaccacacccagctaatttttgtacttttagttgagacggggtttcaccatgttgttcagtctggtctcgaactcctgacctcatgatctacgtgccttggcctcccaaagtgctgggattacaggcgtgagccatggcgcctggcctatataaatgttttgtacagtatttatctcctcaaattataattttgggcaaagaaagcgggtttcaagtttaagaactttaaaaagttttattaactttttcatattttgttatggaaatttaaagaatatacaaagtaagtagactagtgtaataaaccacaacaccaattttaatagttgccagcattctcctatttttgcgtcatttgtaccttcacccattgccacactcaattttccaaattgtgccattttactttcccaccagcagtggattgcaatgcaatttttggcattgtcctttttttttttttttttttttaagacttgtcaagtgcagtaggaaagcaaagtaaacccaaagcaagcaaataaaagcagaaaccaatgaaaccaaaaacagataagcaatagagaaaatcagtgaaacaaaatgctggtagacatgagaaagtcattgaagagaggctgaaccaccatgctctccttcatgatgagctgttcaaagaagaatctcatctgttctcccttaacctttctccctctgctgcctcccccaaacctaaatgtttccacctcccagtagactgacatcctcacaactgtgttcagtggagtctacagttttcatctcactccatctctacaatggtgaggcttttagctacattttccttcttgaaatgagcctcccttgactttgtcatagcacactttcccaatttttaaaaaaaatcctctttaaaaattctcagtatttgtcaccatttcactgtcactcctttgttgacccttttggaagtcatccttgctcctttccctccttcccttctctgcgatagctgacccattgctgatgcctttcagtcctcatcatagatatttcttgaatttgtccacattttactatttctacctagaacagaatgatgattttgtgcctggaccactgttatagcctcctaaatagcctccttgctttttctcatctccattccaaccatctcaatttaactgacagaacagtcttttaaagaataaactgatgtaacactcctgcttaaagcttttcaatggctcctgattcagctgtgaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtttgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgcgacaaggggtatttcggggagacaaccacagtgaccactgcacctttatagcactcatcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaaggtaattgcatatctaagtcttatcttcagtacctctgttacctacccctttacgttctagtttctcagtagttactgcccctagtttgactttcctcttcattaatgttgcagtgtcattgttagggactgttttggagcaaaaaagaaaaaattatcaactttatatatgaataactttcatttttattcagaaaaggatggattcttcttcacagagccccaaacactgatctatactaataaactaaatattccatattattctttactaattgatttttttattaaagctatttttctttattttctaggttttcagttgggttttttagaatcacatataatcttaatttctaatattacaaagctttacaactaataaatacctaattttgtgtttgaatttttttataatagttttaaaaattaatagtattatcacctgattgtatttttcagaatacagaaacagataaaaaaaatttatccattaagctgaatactaagatatgatgaattctaagcacccaatttttctgagattctcaaaaaaaatattttctgataagggcaaagattgttccatttaatcatttaaacttgaagtttaattacattactagttttttgctgttttgcaagcctctgataaaagtttactatctagagacttctggttatggccatgatggaattgcttgtattggactcacttgccctcaaaaacaaatataaaagctaaaaaaaaaaaaaataagaaaagggaagtacaacagggagagctttatattcaccctagcttctcccccaaaggcatttgccagttcatagtacaagaagtagagtgccagcaaaaagcagcaatgctgcagggctgaggagccagaggttgggtttgtgattgcccaagagcctagaacttgaggaacacagtctcaggcaggagagaacgatagaaatcataactcagactctggatatacctttcccttgagttacttaatgatattttagccttcatatacatgggataagacttcaagagatctagcagaagccacaaggccaaaaatgtaagcaaaaatgtcagcagcagcataggactgaggagacaaagggtggaattcaacgcttgttaaagtgaagtggctctgatcagcatcccagctcctcaggtgaattaatacatggccaagccctaagcctgctctagcctaattttagatctggtctgcttcagtttcactccaagcagacttgacctacaattagcctagagcagaactaaggtgatctgtgtgctttctccccacctgacagaagaaaatgtaaccttcataggagaaagaaaacatacccagagcccccacaatttttagtctacaggattcagtgttgaatcaaaaattatgaaacataataataataaaaaaacagataatagaaacagacttatgtgtgattcagatattggagttatcatactggaacttaaaataactatgtctaatgtttccaggaaaatagaaggaatgatagggaatttcaccagaaacctggggtcaataaaaaagagttaaatggaaattctagaactgaaaaatatagtaactgaaatgaagatctcagtattggattatttgaagtgaactggaagacacttatctgctggaagacaagtagaaagtaaacaaactgaagcacagagggaagaatggttaggaaatacagagaagagtacaagagacatgtggaaaccgtgaaaaaaaaaataaacatgcatggggttggaataagagaataagaggagagaaaaaatgagttagaagcaatatttgaagagacagaagctaagaattttgaaaaatggtgttaaatattaacccacagtgaaccctaagcaggataaatacaaagaaaaccatacctagtcacattaatagtcaaactactaaaaggaaaaggaagacattttaaaagtatagacttcttttcaggccaggctggacaaacagggttgttcaatggtcaactgtattagaaccagtaaaataccacttagatagtatttgaaggtagacaggcacttttgcacattatatttaaagaatttatatatatatatatatatatatatataaaattaaacaatattagtagtttcacatgtagttataggtcactttctgaagtctagaatgggtaaattctatcaaatcatatacaggtttgagtatccttaatctgaaatctgaagtgtttgaaatcgaaaacgttttgagcaccaacatgatgctcagaggaaatgttcattacagcattttggatttgggatttttggattaagaatgctcagccgaggctgggcgcagtggctcatgcctgtaatcccagcactttgggaggccgaggccggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaagaattctcagccagtaggtgtaatgcagatattccaaaatctaaaaaaatccagaatccaaaacacctctctcttcggaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaactcatacctaagggagaacagcttttagaacattgtcgatgaaagcaaatatcagctttaaaagagagaggacagaaagactgcagatggtctggaagcagcatttttaggccatctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccatggctcaaagggaagtgctgcagaaaaacatttggctgttaagtgttttggcccaaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctgtgcccatcttttctacttagatagatagaaataggtatcatcgcttccatagacataattaaagaaaccatacaatttacacatacactcagagtggtggttctttccccagtagacgctgacatctgcgttcctcccttgcaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttggtgggaggccagggtgcctgtgggcagatgggtcagagtgtgggccaggatttggagtagaagccagagcatgtgaaaatccaaaccaggaagacttcgttgcctcccgcatgcggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacatcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatattggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattatatgaaatcttaaaataagttattgattgattgaagcagagtctccctctgttgcccaggctggcatcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtatgagccactgcacccagcctaaaataaaatttttatactaaattcaataaaatatataaataactggaaagtcttaattctcagtgcttgccttgtctctgtagttaagggacctgtcacactcaggcactcttccttgtgatgctgtaggccatgtgctttaagaactcaggcacactagctcattaggggagcttaacataaggatggaggttggaagctagttggtgccactcgtgtttctttcatttgtcttacgttcgtttttgtgcatatcaagaatattttagaccaggcgtggtggctcacgcctgtaatcccagcactttggaaggccaaggtgggcggatcacctgaggtcaggagtttgggaccagcctggccaacatggcaaaaccccgtctctactaaaatatatatatatatatatatatatatatatatatatatataaattagccaggtgtggtggcacatgcctgtaatcccagctactcgggaggctaaggcaggagaatcacttgaaccagggaggcagagattgcagtgagccgagatcatgccattgcacttcagcctgggtgacagaggaagactccatctcaaaaaataagaatattgtaagtgctgcttactgtaccaattcagaaattagggcagtttcatcagctggaaatgtggataaatgtatgcaactctaaagttgaaggaagatgcgttagcaaatccatcatggttagcatccctagctgccatctgcctgccccgttggatctagagaagatgaggtcaaacctttctcactccatgttctatgcaaatttctgcaaatccacagagcagggtgtaggtgctgtctccaatgtcacttccctccaaactccctgctctgttgcactaattcatttgtggttcatctcactgtgccccatgcgtgggctgaatgtcagtcagcttggcatcttcactgcctccttttgtctctccttagcttccagctgttttccctatgtagtgtcagatgagagtcttccagtgggagatgcccatgcagggcctggaggatagaggaggaggtgaagcctttactctcctgcactggctacagcagacacagggcagatggcatactcctgactgcaggaagctaataccagctgtggcaggtgtcaccactcctgagtttctggaagtttacaggagcttctctgtcctctgcttccttcattttcctgtttggatctctgagcaaaatccatgaccccttgagggatgcaatgctcagatgtaaagtcgtccccatcctcgagtcccaccaaaaccacccactgccactcagggactaggctttgcttctagaatttctagccctctggttacctcctctgagctcccagtgctgttcacttttccattctcaaatcctcagttgttctctaaaatgccagaatttctttgcaatttcctaacccctgaacaaactcacctgggtggcaccaatctcaaagctgcagcagtgggtctcactatgctttcagtacaaccttacataagttcagagaaagcctggactgaggaaatgaaaacctgccctgctgctcatcaggctggtgattctttatccaatccactggtggtgagcccgtgggttgattccatgtctctgctattgtgaatagtgctgggatgaacacgtgagtgcacgtgtctttttgatagaacaatttattttctgttagatagatatactcagtaatgggattgctgggtcacatggcagttctcttttacgttctctgagaaatctccacactgctttccacagtggctgaactaattgacactctcaccagcagtgtgtaagtgatcccttttctctgcagccttcccagcatgtgtcattgttttacttttttaaaaaacaatagccattctaactggggtgagatggtctttcattgtggttttggtttgtatttctctgatgattagtgattagtgatattgagaatattttcgtgtttgttgactgcttgtatgtcttcttttagaagtgtctgtgcgtgtcctttgcccactttttaatggagttgttttttgcttgttgatttaagttcactgcttctttgttgtgggagggggaaggcggggatgggcgggagctacaagaaaagaggcatcccctcagacactgggttaaagaaggaagaggctctattcagctgggagcattggcagacttgcgtctcaagaaccgagctctctgaagaaagagttcctggcccttttaagggcttacaactctaaggggtccacgtgaaagggtcatgatagattaagatctatagatagcacatgtggttagagtgcggggttaatctttttcagcttttacttcctccttctcttcagagacaggagacagtaagagaaatggcctctctcctcattcccccctttgagaacctcactcactagtgggagttctcactttcatcttcactatccaggtcttcctgagagacagctgaggtcttttgatgaactaaggtggtaacggagcctcttagtgactggagaaatatgggtaatgtacaggggagtaacatgcaggttcctaatactattattattcctattataagagttttaaatcctcctagagctggaaaccattttccaaacaggaatccaggatcaagcctatgccaaacctgcacgggcacatgtgccagctttgtcatgtctctaactatcctcatgcttcggctatgcatggaccagtcagcttctgagtgtgactggagcagggcttgtcgtcttcttcagagtcactatgcaggtgttgtccgggcttggtctcgcctcccaagtctcagttggccgggagcgtccgcagacttgtgtctcaagaactgagctctcatcttttccttgaatgacctgagagactttgttaacatttgtggccttctgagctcccttctttaacccttccagaagggcttccctgtatgggtttagcctttgcataccctgtctttcatttgggtcccagtgggggtctgttcctggtaattggatcctcacatacttttgggggttttggtaatcagctggaacatgttcttccacccacttagttgctgcttggagcactctcctttcatctgtgttaaagaggtacatgagcaactggtggcaatcagctcaggtggggttgtgggtctggataatagtttggagcaaaccaattatagcttgaggcttttcagtataggatggggtattgtttttcagtataggatggggtattgtttttccaattgaggagatcgacagaggtgaagggtttgtacacaaaggcatgcctttccactatatgcccatcctcatctacccagtatactgttgctttctcatgggcatttgtatcccagttctaggcctcaaatgggctgccaagggaggggtttctcctgaggtctcacatcctgtcttttctaccctgggtggcctaggggtatgtaggccttgggaagctcaggcgcagtggcctcaggagtgggaggccttcattcttggtgaaacggggggccactggtgccatttcttgccatgaatcttctgatgttgggtcggacaggacttcaggagctgactcccctcagcgggtggagcaggattcttctttggctgtctgtccctttgctactagtactgctgctgcctgtcctcttaacgactgtggggggtctaaaaccagctgtaaccaagtgtctatgtacggaaactggtctgggtgtcctggcttaccagttaccttgtgccatacctttgaaacaaggggccagtctaggcttccttctgatggccaacctacttctaatgctggccagtctatctcacacaaagttctaagttttcctggtgtcatagtaactccatagtccccattaaatcctttcttgaaatttttcaacatagttcctagtggagtgggcttactttgcgttccacccatcttcctcctgagacaaaacaacactcacaccacaagaaggaaagtctgaaggggtcactcactcatcttgcctgtctcaaactcaagcactcattcactttcactttcctttttgcaaacaagttaagccaaatcaaaatcaatattgagatcaaagtgccaattgcaatcaagtcaagtcaaatcaaaatcaatactgagatcaaagtgctgataagggcacattgtgggtgatcaggcgacacttccactcaaatggagcgggcaaattcccaggactggtcctactgtattccagatgtccagactccaagtgccggttccttcccggtgttcagctgctgcattgatcctccatggggccctgccgtgcactgctgtgatgaggcattccaccagggcaaatgcctacccggcagtgctctcaggatctgcattgctcaagctggctggagtcccccacagggatgctccgcagggcaggccaaagctgcctaaggggctccctcaactgtccattaatcacctcacttctgggtcagggaaccaagaaatgtagcaggacaagccgcagacaaaacccctcagacaccgggttaaagaaggaagaggctttattcagccgggagcattggccgacttgtgtctcaagaactgagctctcatcttttccttgaatgacctcaaagactttgttaacatttgtggccgtctgagctcccttctttaaccaggtgtctgaggggttttgtctgcagctcgtcctgctacagtgacacttagcctcagtctcatttccagtagggtcaaactgatgacctgacatacttattttctgtgctctcagctgtgtctaaatatccctgtgaaccactataaattcatgggcaatcaagcgtggcccaaaaatatgaccagagtggcgcaaacctgcctacaatagcccttgaagctgattgaggcagtgcctagatgccctgcaagaaggctggtgacacctacccctgtctgaggcatcttcctcatgtctggtagatgctctcttcctgctcctcccccattgtccctggggctcctcaaggctctcgaggcagccactgatggccaggttctctgtgggagttggctctcctgtcagccctccttccttctctcttttgcccacattccctcctctcctgtcttcccccaaaattcaaaaactgtttttattcctgctgcatccccaatcattcatctggagactcacaggtggtcccttccccatcccctgagactccttgggagaagatagttcaggatccgagacttggtctagtacaggaatgagtgatagccaccctgagtgagtgccttcatggctctctggagttccaggcccttgaagcggagcttacacttacccagagtgcagcccatgacagtgtgaaagagcactggctgtagccaagcgttagggaccaaatgcttccaagattccagagcgttggtctagattcactgatgtcatcacatcattccacgaggaatggctctttggtttataaaaggcactcaaggaaaaggccatgagcctcacagggaagggggttagtgtcccagcccgaatgctggagtcacctgctcttaccccaacatgaccttcacgtggggcctcatcttgtgttcaatcaaatccattaatgatttcaaatgaaaatgttacattcacatagcagaaaattgagaatatgcaaaattaaaagttgattaacctctcatctatactacaaagttacaaatattgtttatttttattgccttatttgtgtttagtatcatattaaaatttaaaaatgtaagctttaatattttgagataatcatagattcacatgtgattgtaagaagtaacacagaggggctctagatacccctcatcaaaatttctccagtggtaacaacttgcataactatagttcaatatcacaataggaaattgagtttggtacaatccattgacattgttcagatttcatcagtcttatatacacttgctagtgtgtgtgcattttgttctatgcaattttatctcatgtatacacttgtgtgaccaccaccaagttacagaacagttgtattataagaatacttcctattactttttttagaacttcatcttccctaatccctggcaaccactaatctttacaaccttataattttgttatttgaacaatattgaccaggcatggtggctcacgcctctaatccgggcactttgggaggtcaaggtgggcggatcacttgagctcaggggtttgaaaccagcctgggcaacatgttgaaaccccatctctacagaaaatacaaaaattagccaggcgtggtggtgtgcacctgtagtccgagctacttgtagagccgagttgggagaatcacttgagcccaggaggtcaagcctgcaatgatctgtgtttgtactattactggtggtgaatccacgtgggtctgcagcaacctcagttcttgcctcctcagaagaaagaattcgactgaagagcataaggcagaagaagagactggggcaaattttagagcaggagtaaaagtttattaaaaagctttagagaaggaacaaaaggaaggaaagaacacttggaagaggcccaagtgggcgacttgaaggacaaaagtgcagggtttgttggggtttggtatgcaggcatacttctggggttttgtgttccttctcccctgattctttctttggggtgggctgtctgcatgcacagtggcctgctagcgcttgtgagaggagcatgtgcagtgtgctgactggagttgtatgcatgctcacctgaggcattcttcccttaccagctgaatgcccctaggaggtcatacaccagttaaactctgccatcttgcctcttagtctgcatgtgtgagcctacttgttcaactcctgagattttactgggaagctactgatcaccaggttcaggtgttttctatttatcaggaaactgcctttctctggcactggctgtaaccaattattattttagagagacagttaacaactgcttgaccatcacctggtggttgcctaacattcctggtttggggttgtgaggggctctctcctgccctgctcagacctgaccagctacctactataacagcaccactgcactccaccctgggtgacaaagcaatcctgtctcaaaacaaaaagaaaacaaaaatgaaaagcccccagtattacctaaatggaaccagccagtatataatctgggattggtgtttttcacttagcgtaattcctgatatccagccaagttgttgcatgaatcaatagttaattcatttttattgcctagtggtgctcccagtcatatgataagggcacattgactttgtaagaagctgccatactttgttctagagtggtcctgccattgtacatgcctgccagcagtgtctgagtgatccattttctccgcattgacagtgtttggtgttatcattattttctagtttaaccatataagactgtggttttaactgaagtatcttttcaataacatcacacagttggcaaataatgtttatcctttgcccatgtcttctcattattgagccataatttttaaagatattttattgggtaaacatatttacataacagtaaatgccttaattgtctttgtatattctaaatataatttctttatcatttatatggcttgcaaatattttctcccattctgtattttttttttttttttgagacggagtctcgctctgtcacccaggctggagtgcagtggtgagatctcggctcgctgtaacctctgcctccggtattcaagcaattctcctgcctcagcctcctgagtagctgggactacaggtgcatgccaccacacttggctaatttttgtattttcagtagagatggggtttcaccatgttggtcaggctggtctcaagttcctgatctcaagtgatctgcctgccttggtctcccagagtgctggtattacaggcgtgagccaccacgcctagccctgtctcttccttccttccttccttccttccttccttccttcctttcttcctttctctttctttctctttctttccttctttctccttccttcctttccttttctttctttcttcttcattctttctttctttctttctttctttctttctttctttctttctttctttctttctgtctctttctttctttgtctgtcttcttttctttctttccatctctctctccttccttccttcctttcctttcttccctccccttccctcccttcccctcctccctcccctcccctcccctctctcctcacttcccctcccctcttctcttctcttcttttttctttctctcactacattgcccaggctggagtgcaggaacctagattcaaagatacaattttagcactctgtaaccttgaactcctggcctcaagtgatcctcccacctcagcctcctgagtagctaggactataggcccatgccacaatgcccagctcaaggagtgatactttgtcttgtgcatcctctgtcttgcctttccacttagctatggcctggctagagttcttaatgagagaagtctgctataatcctttctcccaaagagcctcctttatacactacatggtcactttcttccatatacgagagaagagtaagcttgctctctcacatcatcattaccaaatctcagctgggcaattaaaggaaatacttggatatttacttatccaaatacttggacaatttccaaagtagaattatcacagttttggctttgagaaagaacttggtattattgcaggtattttgggaacacttatataatattttctattatacttcttgagaggggttggttatttagtgacatgaattaaggcattataatattaaagaatggggcatcaatttcattggtaagtttcctcttcagcagaaaagagataagaatgttcatttatgcataaaagaacttgtcaaatgctttttttttcccatcagttaatatgatcatgtaatttttcctccttagtctgttgatatggtgaattacactgattgcttttcaaattttgagtcagccttatatccctggaataacttagtcatggttaagaaaaaatatatattgctgaattttatttgttgacattttgttaaagatttttatatatatcttcatgacaaatattggtctgtaatttttaaaataccgtttttatctggttttggtatgaggttaatattagtttcataaaataaattaggaagtattccctgactttttttttgtaagagattttgtaaacttggtgtttaaacttttaaaaacatttgttagaattctcgagggaagttatctgaatctagagatttcttttatgtcagttttacaattacaaattcaatttcttaaattatctatttcatcttgagtgagttgtggcagtttgtaagtttcaaagaagtagttcatatatctaagttgacaaatttgtttgtagagttgtttatagtattcccttattatcatttaatgttttaaatatctatatcccctctttcattcatgatattgataatttgtctttgttttctttgttagatttgctagaggtttattttattaatcttttaaaataatcaactcgttgtttcattgattctctactgtgtttctggtttcaattatattagtttctgctctttactatttccttccttctttctgttttggttttcttatatttatttattttagagacaaggtttgctctgtcatccaggctggagtgcatgattatagctccctgtaaccttgaactactggactgaagcaatcctcccacctcatcctcctgagtagctaggactacaggtgcatgctgccacacctggctaatgttctttattttttgtagagatggagtcttgctatgttgcccagtctgatcccaaactcctggactcaagcagttgtcccagttctgcctcccaaatcactgggattctaggtgtgaggcaccttgcccggcctgttttggttttattttgatctttttctaatttttaaaggtggaaacttagattattgatttgagacttttcttttcttatgtaagtatttaatgctgtgaattttcctcttagcactgctttgggtacatttcacaaattttatgtgatagtttcattttcattcagttctatgtattttaaaaattttctgagaaattgagaactttctttttgacccatggattacttataattgtgttgtatagttttaaagtgtttgaagatttttcatatgtctttctgttattgatttctagtttgattccattatggtatgaaaatatactctgtatgatttcaattttaattttgttgagatttgttttatggccctggatatggtctatcttgataaatgttttgtgaacatttgaaaagataatgtgtgctgtctgatgtcactggggcaatgttctacaaatctcaattatattcttttcattgacactgtttttgtgttcttctaaatccttgctgattttctgcctagttgttcttttttattatcactttttatttctttatttggtggttttgcctagttgttctatcagttgttgagagagagtgttgaaattttcaactataatgtgatttctctctttctccttttggttctatcagtttttgctttacatattttgcagctctgttatttgatgcatgtacatttaagattgctatgtcttcctggtagattgactcttatcattatgtaatatccctttatgtctctgataatctttttgctctgaagtctgctttatctgatattaatagcaactcctgctttgttttgactgatggttacatggtaacatggtatatatttttctcatccgtgtatgttgaacttacttatattcttatatttgaagttaatttcatatggatagcatatagttgggtcatgatttttaatccactctgccagtttctgttttttaataggtctatttagacaatttacatttaatataagtatgagatattaaggctaagtctgccattttatctatctgtgcttatttgtgtgtttatctcttttttttctctgttttatcttccttgctttcctgtggattgcttgaaaatattttataattccattttgacttatagtgttttttaagtgtatttccttgtatcaattttttagtggttgctctaggtgctacatcctgtacatgtaactcaggaaagtctatttgagttgatgttttatcagttcgaataaagtgtagaaacttcatctccctttagataactttaccctatcacattgataatataattatcttaaatagtttctttctatatctcgagaagtatattagacaatgttataatttttgcatcaaccatcatagtttagaaaacttgagaagctaagtgtagcatatatttacccttattttttctctttttgtcctttcttactttctgctattagaagattctttctatcatcatttcctatccatctcaagaaatttccttagttattcttttagggtaggtctgttggcaataaatcctgtttgttttcctttatttgacaatatgttgattttccctgcattcctaaaggatatttgtgctagatatagaattaggggttgacaggtcttttctttcattacttgaaaaaaatctgtcacctctagtctctgttgtttctgatgagaaacacattgtcatttgaattgttttcctcttataggtaaaatgtcatttcaatgttttcaagatttcttcctttagtttcagaattgtgattataatgtgtcttagcacagattcttttgagtttgggatttggaatttgctcagctactcgaatctgtagctttttgtcaaatttgtcatttttcaaccattgtttctttgaatactttttaagccccatactctttctcctctttttcttggtttttgatcatgcaaatgctagaccttataaaaatagtcccatggatccctgaagctctttccccctgccttagtatatattctttttctggctcagattgggtaccttctatttttctatattcaagtccattgattcttttctctatcctcttgtttctgttcttcagccatattgctaaaatatttattttgtttattgtatttttttcaattctaaaatttctatgtggttcttttcaatatcttttttgctgagacgtttttattctttcatttgtttcaagcattttcataattgctcactgaagcttttctattttagcgagtgttctttgacattgtgttggcagaggggaaaagggcattgccttcttagtgccagatgggagtggaagtccaggttacccatttggcaccattgacacctatgctgggaaggggttccttgttactgctaggtagaggtcagagtctaagatttccatgtagctttcaccaacactactgagggggaagggcatgcttcattaatgccaggcatgaatgaaattcctggatctcatctggttttgtccaacaccattctggctggcgtgggatgggtagggtgctttgttgtagccaggagaggatgcaagtctagattctccactcagcctttgctaacaagtgtggggctggagtcacatttttttcatggtgtttggctgggggtgcttatgttgtagacagaagttttctgccttgttaggctgacttttttctggtcctttggctggggaagcttttcttggggccttttttttttttggctgtgcctgttggtatttctaggttgctgcttctctggcacccagtttgagacataagaagccaaaaagaggccaggcacaatggctcacacctgtaatcccagcactttgggaggccaaggtgggctgatcacttgaggtcaggagttcaagaccagcctggccaacatggtgaaaccccatctctactatagatacaaacattagccaggcatggtggcaggcacctgtaatctcagctatttgggaggctgaggcagaagaattgcttgaattcaggaggtggagattggagtgagctgagatcacaccactgctgtgctccagcctggatgacggagtgagtgagactctgtctaaaaaaaagaagccaatcagagaacttataaccatgtcattcatttcttatgtcctgggatccttattcagtttgtcttctttccatatttcaaagtctttcatgcttcatatataatgtccagtgtttttgcagcacttagaaggaggaatagagagaaatttatctactccatcttgtccataaccagaggttcaagagagtaattttattttgccattaaattttgagtgtctagaggccattactgttagcaaactttcttcaacagagggagtgtttaccctgaaagctgcatttatataaaaaataaggtaccaaaaaattaggaagaaaaatgcaacctgagagtatgtgataacttcatgtacacttcttttctcttttatttgttcactattatacctaaaagttatgagaatagagaataacattaataacgttctgacaatccttggaattctaagagaatataagacatccctctcttattttaagaaagcatggaatactgatcagcaaaaaaagaaacgacttgggtggatatcaagggaattattctgagtaaaaaaatctttgagggttatatgctgcatgattccatttatatagcattattgaagtgacaaatttatggaggtcgagaacagatttgtagctgccagtttagggaagagggtagggagagggatggctgtggctatgaaagaaatagcatgaggattccttgtactgtgttatctgtggtggtggtggtcatacaaatctacacataataaaactgcatagacacacacacatactggagtgcatgtaaaagtggtgaaatatcaatagacgaaaggattgtatcaatggcaattttgtggttgaggccagacactacccagagacttcagtgaccctcccctgctggtgatattgtactatatagtcctgcaagttttcaccattggggaaactgggtgaagggtgtatgggagtctctctagtgtttcttataactgtatgtgtcagtctacaatgaattcaaaagaaaaaagttttaaaaagcaaagcaaagcattttgctattttgtactttcttcctctgcagactgccctactcacttccctggtgcaaagaggaaatggacagtctaatgtggcttctgcttaatagtctcttgtgtgcatagagaacctgttttttcccaattgtgtaagagttggttgttcttttctccatgaactattgtttgggctttgagtgagtgaggggagatttggtcctattctggagttacaagagggagaatctgacttatgtaggcaccattggtttccactgctgtccttaatgcccttctgaataagccaggtgattttctctgcacagtcctgaggctacatccactgagactggctctgtacaaagatgctaaacgccagacactccccagatacctctgtgccccctcccctattgatggagagcagaagagatatgagtctttcacggaggctgacatcacatgcagactttggcctcaagtctttgtcacttgccaaggacagaagaaataccgtgaactagaaagcttttgtgagtataaggaggagaaaaaaattagccagagttgcaagatgctttatgttgtttcaagtttgttctcatctctaaaggtaaactataggacccacctgctggggcaggtagatgagataatcctgcattagtgaactgtagcatctgactttcatagagaatggttttcttagtagaaattggggcgcaaaaaaatgaatgcagttatgggaactttgcgatgagatgcaaaatatctgggtagaaagcagataaattaccctcatgtatgtattttagtataaagtggacatgattactaggtaaaatgcacagaatttctcagttttcattgatggtatgaaatgtctcacactcaaatgtcagtaagggccagaagaaaatgtaaatataaggagttagtggataaacaataatagaaagtatggggcattgtcaataaactggagatcttggattcaatatgaatgttttcaaattcaaatttttaaacattgtgatggctggataatcacatctgaccacagatggtcagcagctgcttcaatataagttgtgcttggcttttctacatcatgaacccggaaattaagcttttctgtatataacaaaagcacaaatatcaatggcgtaaacaagattaggtcacctgcttctcgttaggatgtagaaagacatgaaaactttcctcctgtggtgatgacaagaatgaaccacataagaatcgtacgttcatggggctttcaaagattggaagatgtaaggaagctctgatgaactgaattgtagagggcgcgccctctagatgagccgagaccctggagctctctggggcaagtgcctgaatgagttcaggtgggaaaagtagcagctgcctacaggcaggaggctttgcagggttaagaaggagcatcctgcgtcaggggcaacatgtggctctggaggagttccaaatgcaaatatccatctctcagcccaacaactctcttccttacctggaattttgctgggaaagtggcattggagaaggggttggtagcagggagaatacagacagccttacacatctctgtgaggcttgggttctggagccctgcagaaggtgaacctaaaggtgaatccaaactgtctgaaacagtagccactccccagcttccaaacatgaagaaaaggtaagaatcctttaattatagcaatgcaagaggctggggttgggctaccagagtttcttacattagatgtaaagtggtatgatatgaattcaagatagagattgccagactggataaaaaagcaagaccaaaccatacagtatttacaaagatacactttaaatatgacacagatacattgaaagtaaatggatggaaaaggaaaaacatggtaatgtccagactcaatgtgagagggaactcacacagaggtgtggctgattttggcattgggaggtgtgactcattggcattgggaggcatgggccattggcactgggaggtatggtccattggtactggaaggcatggcccattaggactgggagttattgaacattgggactgggaggtacggctcaatggcactgggaagcatggaccattggtgggaaccatggctcactgcactgggagatgtggaccattggctgggaggtgcagctcattgccctgggaggtgtggaccattgcacgaggaagcatggaccattgcactgggaggtgcagctcattgccctgggaggtgtggaccactgcactgggaggtgtggccactgcactgggaggtgtggactattgccctgggaggtgcggaccatagcactgggaggtgcaggttattgccctgggaggcatggatccttgaactgggatgcgtggaccattgcagtgggaggtgtgggctactgggggccatgtggcatttgagttatggcagaatgggtctgggaaagagaattctgggctaagagagtcttccgttctttcttgtttcctcctctggaaatggctacctcttcttcctcaaaggaagctgaggaatgtctgcagcaggcaggctgtgtggggacttctagaccacaaaggcctgtctctgtgacagcttaggcctggtggggtgttcatggctgtgaacaccccggagagaacatggctgtggtctttaccagccctccattcctcttcccctcatagatctgtgagagaaaaggaaaatggatgtgttccttcgttttaggtagaagggctttgaggactggagaacgcctagggagaaaggggtgatcaaaatataccgttgttccaggatgtaattataaaaaactgggctccaaatatgaattcaggaatacttggtccccgtgccaatgcagccaagcccctgcacggtgtgggagcaactcctggggttggtgggaggcctggctgatgcatgatgggtctgaaaaccgctcaggctttgccaggtatgtgtcaggcactgatggcggcgatcggaccggcctaggttggcttagcgcgccctctagtgggagaaggtctaaagagcaaaatgtgagcatccttgccacagggcagaaatgatgctgaacgtgcacgccacatcaaaggacatacgtgcttaagggacttgtgcttaacaattactgtgattagtccgttctcacgctgctctaaggacacacccgagactgggtaatttataaaggtgttttaatagactcacaattccacatggctggggagccctcacaatcatggctgaaggcgaagaagcaaaggcacgtcttatatggtgtgtgcaggggaactgccctttataaaaccatccgatctcgtgagacttattcactatcacgagaacagcacgggaaaaacccacccccatggttcaattacctcccactgggtccctcccatgacatgtggggattgtgagagcaacaattcaagatgagatttgggtggagatagagcaaaaccatatcagtcaccatcttaaattgttaatacattggaatttgtttatgtctgttgtaaaaaaggccagtcgcttagctatttcatggcggttttgaggaattaccaccataacttatgggagagtgttttggtaaatggttacataagtatgaggaattttaattttttcattagaaataatgtgtggaatttataggacaatttattaagaagcttaaatgtatgtatggtcgttgattaatctaggtccatttctctcctagagagctgtcaatagagattgagtgtgtggtaaggcttcctcctcggtgggccttttagtgataggatggtcaagtgaggaagggctgtgctcctgcggctcctaattctgaattacatttattgggccatgcagtctggtttagtgcctgagtttatgtatgggaaatgaattccatttctacatgctgggtccttatcagagcagaaaaaagaacccacgctatgcagatacataaatgtcacccacatgaacaaggcactgtcttcagtatggcatgaagggggcagtgatgaatgggcagctggagaggggagcgtgttcagatgagacaggctggtgcagacatctggggtcaaccacagcagacactaaaatgcagtggggccgtggtgagggggatggaggggatgtgggaggtgagtgggagctgagggaagaggagtggctcagaatgcagtggggggtctgcgagaggaccagagagggaggaagcctctccttgggaagagttgggggcaggtcaggagaggttccaggtagagtcagaggtggctgggctggggtggtgaaagccacccttatcctccctgtgactcttagggtcattgcactgcttttctgcttccagatgagatggagtagcagggacggcgtttatcctttcacctgacataattaacacaggacaaaatagatgaggaaaaaaacaacaaagcgaaactgttgccatcagacagcgcagagctgtggtccctgagagggagagacagacaagaggagtgctaggatttccccagagggtgtggcctggacactttccaagctgtggcccatggatgtggctgctgtcgtggtggggtccctccggggaaatcactttgtcagtgaacagcaacatccttttctgatttttctagtaccacgcattgttttctcccattgtccaacaaaggaggcaagaatgcagtgtgccgcattcctcctgcagcagcgctccggtggcgtaccttaacctcgcttttgttttttcatgtgttggctgagtcagtgagtgtgctgtggtggacctctgccatttgtagctcctcaaatcttcagcaccctcttcacagtttgatagttccccacagtgtacctcctgccttctaatgagtctccaaatattccatttcacagccatccttgtttttgaggtgcaaacatatgatttaggtccagggatcataggcacccactcaaggctttgatcccaaacagttcccatggctggggcagagtgcggtggaggggcaggggcaggggctgacagctgtggcagaggcttcctgattcagctgcctccagatggggccagagcggctgcccctcactgcattagatctatggtatggcactgggggtctctttcttcagcattcgatttggtatgttatcttttttttttctttgatcagcttttcattatctctattcacaagtcgttataatattgctatttatcagtttaatgtaacacatatgataaaaacagatgataaaaagtatcatattaacaatgagaacattattggctgggtgcagtggttcacgcctgtaatcccagcactttgggaggccgaggagggcggatcacctgaggtcaggagtttgagaccagcctgaccaacatggagaaaccctgtctctactaaaaatacaaaattagccaggtgtggtggcacatgcctgtaattccagctgctagggagggtgaaacaggagaatcgcttgaacctgggaggcggaggttgcggtgagctgagatcgcgccattgcactccagcctgggcaataagagtgaaactccgtctcaaaaaaaaaaaaaaaaaaaaagagaacattattttacacaacccatttactgaatatgcagcctcttgcaacaataacatagtggacccaactctaccctctgaatggaccacttttatgattctcctaaaaagttttgagttggatatagtttcttgttgcttctctctgtgatccgagacttaagaatgagtctctggaaacgcagcaattggaaccagacctccccaggatcaaagaggacaggagtgggagaaaggacgcaggacacgactcccaccgtctccagcgctgcgccgtatgcttgacctcagagcatgcaggcactcaatgtcaagtgtgcagccacgtctatatcctgcatctcaagtgctcacaactgtgacaattagcagatatgggagagaggaggcatatcatggaggaatgagtcagtcccaaaaattacatgaacatttctgaaatttcaataccaagggttaacttctaaagtactagtgtataaacagaagccatatagctagccatgaactgaaatgcatgtaccatacagtgaaggagctcctgtgcatacaaaaccacccacgtctcatttatctctaattttaaaataactcattcccttgctggatatgcaagtgagtggtggagaaagaggtctatctgcaaggctggcgggggttaaggatttcattgcttccaaaagacgtgagcaagagaactttattactcactgaaggggattcttccttctcagccaagatggtcccatttaaatcacttttgaatttcctttcaagcttcaattgtgcaaattctagttgtggttgaggatcgtccccaacagctttttgagttattccttggactcttcctttttctactatgttttcatgaataattctagaatccatatttatatccagcccaaggcttctttcctatagaggtgtcgttgagttgtgagcttcaaagatctgatcatactgtttaaaagcaataggcttgggagtccagatgtcagcttctcagatccattttcacagtctgatggtgtctgctagcaattatcagtgcctgacccagaagcggtctattgcacctcagcttggaggaaaaagtgaaggcacatgcagtctgggaaaaaaagagaaaggaaggaaaaggcaggcaggcaggcaggcaggcaggaaggaaggagagaaaaagaaaggtggtaggtttctatgtactgacttggatttgtgtactgtgttccccaggcaattctaatccggactgcattcccctcaatgtctctaaagctgtcacatttgtaaatgcttactgcagaattttcttttttttcttttctttctttttttttttttttttctgagacggagtctcactctgttgcccaggctggaatgcagtggtgtaatctcagctcactgcaacctccgcccgtgggttcaagtgattcttctgtctcagcctcccgagtagctgggattacaggtacctgccactgcacctggctaatttttgtatttttttaatagagacggggtttcaccatcttggccaggctggtcttgaactcatgacctcgtgatccacctgcctctgcctcctgaagtgttgggattataggcatgagccaccgcgcccggcctgaggaattttcttaaatgaatttttaagttgtttcatatcaaaaaggtcagcatcttcacctggtcctttactcatctgaaaagcatcccaaactttcttgtgctgatgaaattgagtataaactgtgtctcaaagggctgcgtcatagggatttgcatgcttctcacacagcagaaccaagtgctgaatgagagagtcctttctctgccggaaatttaaagtctgcagttgattttcagacaaaaaatcccaggctttaggattgttgtcatttccgtcatggggatcctctttctctcttttctttctttctttctttctttctttctttctttctttctttctttctttctttctttctttctttctttcctttctttctctctctctctcttttctttctctttctctctttatttctctctttctttcctttctctttctttctttctttctctctttcttttctttctctctttctctctttatttctctctctctctttctctctgtctctctctctttctgcctttcttgcctttcttgcctgcctgcctgcctgccagcttgcctgcttgcttgcttgcttgcttgcttgcttgcttgctttctttctttctttctttctttctttctttctttctttctttcttttcttttcttttcttttcttttcttttctttcgacagggtcttgttctgtcactcagcctggagtgcagtggtgtgtgatctcagctcactgcaacctcgaccttccgggctctatcgatcctctcacctcagcctcctgagtagttgggtctacagcatgtgccaccacgcctggctaattttattttttgtagagatggggtctcactatgttgcccagtctggccttgaactcctgggctcaaatgatcttcctgccttggcctcccaaagtgctgggattacaggagtgagccatcacacccagccatgaggatgtttgagatgatcctcttaataaactcaacaacagtctcatccatctctctgtcatggcccacgtcttcagctacctctctcctcctgcatgctatctttgtcctataataaatcgttcactcctgaaacctggtagaggggattctgttgtctataacccccaccagtgcatttctatctaacggttaggaaaacctccttggctgggcacagtagctctcacctataatctcagcactttggaaggccgaggcaggcagatcacctgaggccgggagttcgagacgagtctggccaacatggtgaaaccttgtctctactaaaaatacaaaaaaatttagttggctgtggtggtgtgtgtctgtagtcccagctacttgggaggctgaggcaggagaattgcttgaacctgggaggtggaggttgcagtgagccgagatcacaccattgcactccagcctgggtgacagagtgagactctgtctcaaaaaaaaaaaagaaaagaaaagaaaggaaagctcccaactaaacactcaatggcctgctcataacaggagacacaggggaggtagtccagggtgggcgagtcagccgttcagcagcatcgtgaagaagccagttccttccaccttctactcattgttgtgcggcttcttcccctttgcgatctggtgctgcattccatctctagtcttcgggcatcactacttttccctgtggtgctcaacaggccatacagggcagctctgatgttggccaagtggaactgatgtggtcaggagacacaaatccattgagaggaggcagcttctccttggaagcagaatctccctttttatatccatgagaaacagccaggagagcaggaagccaagggctttctccttttctgttgcatgccagcgccctctttggctatgagcagcaggtctctctcccttcaccactgcatttggatgagactcagaggctgcttttgctgtcatctgtttggcttacttggtaagtttctgtgatttgaggcttgtcaccacttgtagagtttttgcttgatcgtgtgttgtttgtccagctttggttaaggccgcttaaaaccctgacctttggagactttgtgtgcaggattcctatttcatcattgtcgtgttttgtcgcaaagtcaggtttgcatcttggagagctttctggtcccccttcctgagttttgtgcccagttttgtggatgagtccatcataaatcttgtggatgaaatcttccaggtgcttctggacttttctgttcttttgcttcgcctgtgtagtgagagggagaagtccaacattaaatgagccctatttttacccaacgtctctttctccctgaccactctgtgtaaaatgcaatcataactcctccttcctgaccagcacttctagtcctctttatcctattttttctttctccatagcgcttatcaccctttcctatgccatctctgcctccagatctggaatataaagtcctcagtaggaaatacctttatctcttttgttcaatgaggtattctaattgctcagaatggtacctgacacatattaggtgcccaataaatagtttgtgaataaatgagtgaataaatactcaggatttttaacaaaagccaccaaagaaaacatgcttaatttattcaggaggtggaaatcttgggtgggatgaattccttatgagacctgcgagaagcgcaggtgatagtttgtgtgtgtgttcgttgtgcatttttattgatataaaacagaagcactggaaagtgtgggaagtgcgcatgtcatgaggatgcaggcccttggctggcttgtttatttcaggggtggttaggcattgtcgccctgggtggaggggtcagcgacgagccctctgaggccatcctgtgacatcccctgggcacctcctagtgtttgtcattcccgacgccccagggccagtgtccttggccttggagatctcaggctctgctggtttccccacctccctggctgtccctttttagtcctttcccacctcctgaccagacactgaacatccttggggctggtctccttcatttcttgctatattctttttttttaaagacggaatctcgctctgtcacccaggctggagtgcagtggcatgatatcggctcactgcaacctccgcctcctgggttcaagtaagtctcctggctcagcctcccaagtaactgggactacaggcatgagccaccatgcccggcaaatttttgtattttttagtagagacagggtttcgccatattggccagggtggtctcgaactcctgatctcaagtgatcctcctggctcagcctcccaaagtgttgggattatagacgtgagccaccgcgcccggccactatattctctttctattcaatttcattcttccctgtgcctctgcttaccatggggcacccacttgcagaggatgcctgattccatgccctggctccctccttggtggcctcatgcatctcaaactcaatatacccaatgctgtgctcagaccttccagctcaaatgcgctctgtctcagacatgctgcaaccatcctcctgggagttgacacctccccaccgtatcccctcacatccagtccctcagcatgttcccttgatcctaacttctaaagtgtccttgaacctactcacttctacctcccatgtgcccaccagacccagccccaaccacttttcgctggggtaacctcagtagaatttacactggtctcccttcattctctcacgcacacgacaaaccattctgtaccctgaagctggtatggtttttgaaaagctcaaatttgattgtgtctttaatgagttcccattgctctgaggtcagtgtggcatctttcatggggaaggtcatggccagcccccttccccttctcttcctatgttccagccaccatgacctgctgtccagtggtcatgagctgagtccctcatacccaaggcttttccagatgctttttctctgctggaacactgttcttgccttgcgttgctagcaaagatccccatgttcattaagcgcctcttaaatgtgacctctccagggaagcctcctccactcccattgcccattgccctggctcagtcagaccactctgtgtcttccttgttggtgctctctcctcttgtcattaaatcgctccatgtttaatgtctgtatcctccacttgactgtatgctctacaagggcagggtctaggctggcttggatgttatgctgctgaatctacagggcgaagcataggaggtgctcaataaactgaatagattttgaatagatgttcactgagggtaatactgaggagtggggttgttctcaatccttactgtagactccaaatgccagtactgttgggcgttgcttcctctgaaacactccttgaagctctgagtctcctttggatggttttacccaactccactcgtgcctccatcccttgctgcctctccagacatttgccttccttgtcattttcaggccgtcagctacagtgactgggaatgtgtgccacttggctctcacactcgcctctcactgtcgtttttctctcacgggagtttatcatctattcttctcatttccttgcctttctctctgcagcaccgataaatcatcagtttcacctgaacttcagaaagaagccattccttaattttggcagaagcacgatggagtagaaagtgaccaagtagactgacttctgatcatgtctctattgtgacatgccttcatgagctcccattgttcttggggttaaggcctttaatatatgttacaaggttggaatcactctggggaaatggccgaaactccctgagctttgtttcctcaagaggaatgtgaggtggattggattaaattccacctacaaccatttccatctcttacatttccagaatttgtcccagaatcatagaagcaaaccttgttcagagaggccatatccagctttgcaaaataaaaaaaaaagtcactgtgctggtgagatgggcctcaatcctggtcacatttctctcttctctccagatatctatgcttcctccctctcctgcctccccagaatataaacagctccctgagggttgaggatgttccttcgtcccactcccaacctgtcacccccaacttccagatttctttaaaagtcaaagagaaaggaaattttcaggaaggagatcatgtctaagagctttttattagtctcatcttccaatttcctgtagactcaagcttctttctttctgtcgtgcggggtttaatatccagtggctgtttgacaacagcaccaggaaatggaatttccatcctgattctgcctggaaccttgggcaaagtgcccaaaccttctgcctcactctcctcctgggagtaacagtccccaccctacagccttctggggcaagcaacagagacctaatatgaaaatggaaccagagagttctgatggatgtaaagtcctcaataaatgcatgcaggtattatttgttaatttttgccataggcaggctgcagcccccaggcaaactctgagtagaaggagcctataaaaacaagcctcctgcttctctctctctctctcatttttttttttttaattttttttttagacggagtcttcctctgtcgcccaggctggagtgcagtggtgcgatctcggctcactgcaaactccgcctcccgggttcatgccattctcctgcctcagtctcctgagtagctgggactacaggcgcccgccaccatgcccgactaattttttgtatttttagtagagacggggtttcatcgtgttagccaggatggtctcgatctcctaacctcgtgatccgctctcctcagcctcccaaagtgctgggattacaggcatgagccaccacgcccagccgcctcctgcttctctcttgaagcctgggttctgctctggtgtctccccagctcattgccggttgacggcacattgggctccctgtcagtcaggttggccacgtgaggaggagtcaatgaggcactgcttcctgccaagctgaggctgcccttcttataataaggaggtgagcctgtctcagggaaggttcttttcctaaatttcaggtgggattctaaacaggacaccactgatttttttaaaaatgaacctatcaagacatgcattttcatgggtgtaatcctgtttgaagtggtcacatttggggtttttatgtacttgctcctattactggtgaaacttctgtgaatgggcttcagatcatgaacagcctcagtggtggcagagtctcatgatttcaagttaccttatagttgagaaatagccccgcagggtaggtgatggcgtactccccacttgccattctatctggaacccggaaggtggtcaatccatattcactgaaatgaaccaagaaatgagactgtggctataaggttgaggatgttcatttgcttgtgaagcttctaaacaagatcttccaaacagttaagagaacacttggatatctttatgatggtgtgtttgctttgaaaaataaacatgaaagagaaccattatgttatagctccgctttctagtgagtaccccgtcaaggcatcatatccctctgtgtagcaatggaaaggcatttaacccaatgattgaacctctctgtgcctcagtttcctcatctctaaaataataatagaacctagctcatataactgttaagggggatcaaaggaggtaaaatgttgtgacaaaagttgcataacacagtggagtgtatttcattcattcccaagtctgaacttatgtgtagaataatgccacaatctatggccctgtgtcctgaaatgcccttcctccaggcccttttggagcaagagctccaaggggctgttccctcagataataacctaggtgattggaaaccttgactagggagcacagacctggaggtcggttccagtgtgggacagttggtcatatttcccactcaccctctgccatgcaaagtgggtgaggcagtggctctggccagttcattggcaggtggcaaaaccttgtctagtctttggcattgggcatgtgataccatcgatggccagtaggtggcacaagttgtccatcactgccgccagctttgctccattgggtgctttctcagaaggggaagatctatttctaatccagtcctggctttatggcaatgcttaatcacatggaagggaacatgcaataactactggtatttctgtaaacatgcatgctaagaatcagctgccatttggaaatgaggatggagggaacactcagtgagaggtctcctgaggacaatctaaaaaaggaaaaccttgagggttttaaaattttagagccagttaacctttgtgactcatggagagaaacgtttagaacccagaaggacaatgagaatacatcctgtggattgtaacctggtccaaggtccaccttgccctctccaccttccttcagctgtgaagtttaggaaggagagacaagatccccttgcatggagtcagcttacccacttcatgacccccagcagggccgggctgcaccttctgggctgtttgcttaattttttattcttttgtcctggcaagttgcctgcttcttgggtttgtcgtttccctggaggaaagtttatttgaatctcattctacccttaataaaattggcaccagataaatacgaagcggatgaagagacacattgcagcaaaacaaaaagtggaacgtggtcaacaacagggcgatgaggactttaatacatgtgtacactttctaaataaaaaattttcattgtagtaaaatacacataacataaaatttaccatcttagccatttctaagtgtacagttcggtagtgtcaagtacgttcacactgttgggcagctaatctccaggactcttcatcttgtaaaacagaaactctctacccattacacaacagctccctgttcttctctcccccaacccctaacagccaccattctacttcctgtctctatgaacttgattactctagtgtcaaagaaaagaatcaaactctgtaagatatttgaagagatttattctgagccaaatatgagtgactgtggcccccgacacagccctcaggaggtcctgagaacatgtgcccaaggtggtcggggcgcagcttggttttatacattttagagaggcatgagacatcaatcaaatacatttaagaaatacagtggtttggttcagaaaggtgggacaactcaaaactgggtcggggggacttccagcttataggtaggttaaaaaatattctggtttacaattggctgagtttatctaaagacccgggaccaacggaaagaaatgtctgggttaagataaaggattatggagacccaagtttttattttgcagagaaagccttcaagtggtaggcttcagagggaacaggttttaaaatgtttcttatcagacttaaagtctgtgttgatgtcagtgctggagaggtatcatgaggcatgtctgacccctgctttccatcatggcctgaaacagtctctcaggttaaattttaaaagagccctggctgagaaggaagccctttcagatggttgcaggggcatggggggatgcttagaattttatttttggtttactctaggtacctcatataagtggaatcacactattttgtcttttagtgactgggatatttcagcataatgtccacaaagttcatccatgttgtagcatgtgtcagaatttccttcctgtttaagctgaataatattctattgcatgcgtgatggttaattttatgtgtcaacttgactaggttaaggggtgtccagatagctggtacaacattatctttgggtttgtccttgaggacgtttccagaagagatgagcatttgaattagtaggctgagtaaagaaggtccgccttcgccagtgggtgggcatcaacccatctgttgagggcccaagtagaataaaaaaggcagaggagggccgggcttggtggctcatgcctgtaatcccagcactttgggaggccaaggcaggcggatcacgaggtcaggagatcgagaccatcctggctaacacggtgaaaccctgtctctactaaaaatacaaaaaaaattatctgggcgtggtggcgggcgcctgtagtcccagctacttgagaggctgaggcaggagaatgacgtgaacccaggaggtggagcttgcagtgagctgagatcgcgtcactgtactccagcctgggcgacagagtaagactccgtctaaaaaaaaaaacgcagaggaggagcaaattctctctttctcttcttagctggagcatccatcttctcctgccctggggaattggagctcctggttctcgagctttctgacttggggactcatcacccttagccccgcaggttcccaggccttcagctgaacgttggtcactccaatggctcccctggttcccaggccttcagattcagcctgaacgacaccatggctttcctagttttccagcttgcagatggcatagggtgggcctctttggcccccttaattggatgagccaatgcctgtaataaatctcctcttatgtatctgtatatattctactggttttgtttttctggagaaccccgactaatagagtatgtacataccacattttgtttatccacccgttcaccaacagacactcaggctgctgccttctggccattgtgcataacactgccatgaacatggtgtaaaatgcctcttcaagaccctgcttccaactcctttgggtatatgcccagaagttgaattgcttgttcatgcagaatttatttttaattttttttgtgtggaacagccatactattttccatggtggttgcatcattttacatgtccatcaacagtgcacaagggttcccatttgtccacatccttgccaacatttgttattttctgtttttcttttttcttgatggtagccatcctaatgagtgtgagatggtgtgtggacacttcaagtttgctctttctagggctttttctggagtgggcaaggctccctgatcccttcctctgaaagtggtgttactgtaaaggtggcattttcctgctggtcatggtggcacgcgcctggaatcccagctactcgtgagactgaggtggaaggattgcttgagctgaggagtttgaggctgcagtgcactatgattgctcctggaaatagtcactgcactggagcctgggtgacatagtgagaccttgtctcaaaaccaaccaaccaaccaaccaacccacccagacatttccccttctgccctcccctcagagctctgcctagagagcctgctgagtgtgggtacttctgggttggtgtctccaccctaggaacccacttgagagtgactttatttggaacaatcttcagtcacaggaatcttctgggaagtcaccagaccattgctttgaagagtacacagcctcagaccctctggggacaggagcaaggcaggctgatttattaaccacgctgcgtcacccttttgccctagaggttagatggtcccaggagcccccctcgccaagacactcctcagagtgggggtaggagggtgggaagttctagatcctcagtctggccttcaaatattccattacattgccggggacatggcgcacccacatttatccaaaggacaggggtctccagaaatgtctgcccgcaatatcctttggttacctccaaaacattctcttgaagttgtttaactgccatacattgttgtgggccggccttttattcccagattcacttatttaaaaaaaaaaaaaaactctcgagcatctctgaagagagaggttatatggcagatgcaagtcagcagaaggcagagagctgagaatggtggggagagagacacagggctcacggtgtgacaagcttcttggtgagtggtcaagtgcgtaatggccaggtaggcggctggtgggatgtgctcaggcagaccagcgtctgagtcccaggctggtcactaatttgctctgcgtccttgggcaagctccttcctttctctgtgcctcagcttcctcatatactaaatgagggtagtgagagctagctcagagctgttgggaggtttaaatgagtggatgatgtaaatacaagtgtcaggaatagtgtaggtgctctttagtgttcacccactgctgtggtttgagtgtgtccaaagttcgtgtgttggaaacctaattcacaacaccaacagtgtttggatgggggaccttcaggaggtgattaggtcatgagggctctgccatcatcaatggattaatagtgttaccttaggagtgggttaatcattgagggagtggtttcttgattaatggataagttcagtcccctttctctattgctccctcctgctcttttgtccttctaccttcccccatgggatgacacagcaagaaagtccttgccagatgcagtctccttgaccttggacttcccagccttcagagctgtaagaaataattttttttgttttctttttaaaataaaccacctgtatgtggtattctgttacaggctaagatactttctttctccactagccacttgctcagtacaagttgagagaagagtgttgtgaagcccaagtttaggcagagaggagcaggttagggcaagtgagcaggcagggtttgtctctcacccacctgcatttagccaacagctaccagtggcagccactgggctggtggacatgttccctgccacggagagaggggagtggtccagctgcaaggctctagttctgggatctagtcttggtgacggaggatcctggaaccatctaacctctggggcaagagggtgacgccatgtggttaataaatcagcctgccttgctcctgtccccagagggtctgaggctgtctactcttcaaagcaatggtctggtgacatcccagaagattcctgtgactgaatattattccaaataaagtcactccctggcaaagggataagtccctacccaggagctgcccaaatttttttttgaaacggagtctcactctgtcacccaggctgcagtgcagtggtgcgatcttggctcactgcaacctctgcttcccaggttcaagtgattctcctgcttcagcctcccaagtagctgggactataggtgcccgccaccacacccagctaatttttgtatttttagtagagatggggtttccccatgttggccaggctggtctggaactcctgacctcaggtgatgtgcccacctcggcctcccaaagtcctgggattacaggcgtgagccactgtgcccgacctcctgcccagatttctattttattcttgcactcagctaacagcctggctgcccagaggcaggtacaacttattcaagagcaggagaattccaattttattatttaaaaaatcacataattaactgagtattacaagctttgagatgtttgttggttaataaagatgaatgggctatttgaggtaatggcttttaattaaatggaagctaataactttggtaagtttgtccgagtagtaatcttggctaacagtttgaagtttcgtacaataatcttggctaacaatttgtagcttgccttgcactgatttcatagcattcattgtttacaacacgcagaacacccactttacagatgggaaaacggaggctgaggctaagggcacaggaaggctgtggggggattgcagtccacagcagccccgggggtctcaagggcatattccttttaatcatggcttcccacacaacatgcatccctaattctgttcacctgacccctgactaaagctcagctttagggcaggagatttaaaatacaaactcattatatctgcaggtgtgggctgcagggagggcttggagatgtagaatcctcctttgctgccatgtagagagaggaaagactgcatgcaggcccagctctgctactcacggcctatacaaccctgcacactttatcccagagcttaaatcttttcccttcttgcagctcttcttctgttaagggacctagagcaggacataatcatctgttcttcttatggaggggctaaggaacaagaaaaatggtaaggagcaaaaaatggggccaggtcatttgacaaggaaccctgggaaatgcaaaagttgtatattctttgctgagttggagcattagtgacctttctctcttttcttgtgaatttacaggagttgcaaaggcccagcacctccctgtggcttttaaaaccaggtatgtgggcaatgctcagcagagactgaggaccatggccggggtgccctgcagccctttcatgccgggcagctgcagcctttaatttgggggctattgtggtattgttggtattattcagggtttgggcttcaagagaacctgtgatgatttctttgttatttcacagaaattggtctgaacggttggcatgtaatgcggtggcactggttctcctgtgtttgcccaaaaccttgccaggagaaccaggcagtggacgggtgtgtggtcagtgtggtgacctgcaaacaccactgtccacacctcatgctcttgctcaagaattttcccaggctccgtgcatgtgtaaatttgcaaaaataacaaagccaaccttcattgtttgttctctaaataagaagaagcttcgtggtttgtgttcgagtgaaacagcaagggagaattttgatcctgtggaatctggccagaccttacagggttgaggggtctctgcactcacatttgccgtgttcctgtccctctgcctctcacctttgaatgcctccctggggcagatgctcccggctcctactcctcggatcctttgtgtaatttctcacaaatttctagagctcacatggaccttcctttcatagtccaggaacacacagggttgatcctcgaggcctgtgcctctctccgggcacccgtaacaccctgctccatgtttgcttcaccttggagtaatcaccttgcactcaccccattgtctttgggggcttatgttttgtgggtgatagagtgcatcatctatgaggtaaaatcttttatgtgtgtttgcttattccgggatgcactggtggccaggctgtgctcattctggctcactgagggtgtgttatcatcctgccatggaccaccctcttctagaaggaacagaacatcagggtctccctcccagccccctgttccaggtaaccacagcgtactgcaggaacaaaggtgtagactgaaagtaagttaaaggacagggctgaggcctatagactgatttttcggagtaaggaggtgggcccttttgaaaatattgagatataatttatataagataaaatttacggctgggctaggtggctcacacctgtatttctagcactttgggaggtcgaggtgggtggatcacctgaggtcgggagtttgagaccagccccacacaaaaccctgtctctattaaaaatacaaaaattagccgggcgtggtggcacgtgcctgtaatcccagctacttgggaggctgaggcaggagaattgcttgaagccgggaggcagaggttgcagtgagccgagatagcgccattgcactccagcctgggtgacaagtgcgagcgaaactgcgtctccaaaaaaaaaaaaaaaaaaaaaaaaaagataaaatttacctattttaagtgcacacaatgaattttggtaactgtatgcatttgtataaccacccgacaatgagatacagaacacttcatcacccccaatagttccctcaagcctctttgcagtttctcccctccctttggcctcagcaaccagtctgtgagtctagttttgcctttctagtctttcatgttaatggaatcaagaagtgtgtactcttttatgtctggcttcttgcattcagcatattttggagccttgtccgtgtcactgtgtgatttctctttattactgagtagtaatgcattgtacagaggtagcacaatttggtttttcatttaccagttggtgaatattcgagttgtttccagttttgggcaattaggaataaagttgctataaacattaatgtacaggactttgtggggagttctattttcatttctctttggttcatattcaggagtgggtttgctaggtcacaggatagacatatgttaaaactttgtaagatactgcaaaactgttttccaaggtggctataccatttgtattcaaaatcaacacttttagcctagagcatataactggccttcctgaaatccatggatatctatctgtgcaatggttttagagacattttattgcctcccacatgtaattaagttacttggcttttaggcaaaagatgataccatgtctatggatgagatgactctagttttgaactctgggttttgcagaagagtttgcattatcctcctcctgaggaaagcagatacatccgccacgatgcatgtgagtcaggtcttctgcgtgtcctctgaatcaggttcgcatgtgtgcctctaatggcagtttcgagttcatcctgtgttgagataatgcctgaaggcgagaggaaaaaatatctgtggttgtcaaatcgggtggaaagtgattaatcatggagacatttacggcatgctgaactgtttcgtttcctgacctttgtcccacgtgcgttaggggcaggcggggtcaagtttaaatccaagatgacaagtgtctgaggctaaggaaggtttctgctgaatacttggcttagagtcaatggctccatgtttcacacctggtgaaaaccgactcgcaattgaaagaaacagcatgggagtgtcaaacacttgctgacttggccttgggctagagcttcttgcgagggttttagaactgacacaccctttggatgtgctgggggcatctggtttttggtgcctgagtcacaaatcctggaatacatttgcccacagtgtttccataccattggaagtgcattatggctgcttctcttagagtcctttaacctcttcctcaagagccagctttgtcaacttgatgtatctcatggcaggcatggactcatgcctgtgtgtcccattgtatccccagatcatgggatttgtgggattcagccagtgtcatttactaatcactaggtccagggccaagtttaggtgaggttcactccatctaagctgtgttttgggggagggagggtctctattttttcatttagagaagtgactagacactagaaaatgtcacagagtaaacgtatggactacagcttgttttctgaaaaggtttagggatcccgtgttagtattgaaagaccctttgaggcctcatcccctccacccagtgggcacacaggcctctgaccttcagcgccaagtctcccttgaggtcagcttctcttcatctttcacttcttttctcttcctttcacccctgctggttgcagcgacaaggtccctgccaactgcggtgtgcacactggcgggccttcacctcccttaaaatccagctctcgaaatgtctgcaagggagcagcctgcaatattacctaatttgtctttaatctggtattcctagaataatccagagaatagagtggcctactgtacacactggattactcaataaagaacatgatgggaaacggcagtatttttctgttttaaaataagtaggtttggagggagctgggaaactgcgggctttagttacaaaatgactataattgtgggagacgtattttctttgaatgttgaaacacattggacaggatatacaatttagaaataatttacagttagagaaaggccctttcatctgagagggggcacatcttctgattggaaaggatggtcccaggggatgagggatcgggccccaggtgagcttcatctttttctcttccaacttcagtgtggccaaacagagcggaaagtcatcacgtagaaggacaaagtctgtgtttttttgtttttgtttttgttttctctcatgagagaagcaggcaagtgctgcctgagaaggtgaaggctcacctgtggcaggcttgcttcaagctggctgcagactgaaggccacccagaggctttggtcaccaagggtggcatgatgggtggccttctccttgctcatgcagctctcaccagcaaatttctactgaatgcccactctgtgcagggtactgtgccaagcacgagggatgccaggacccggaagaaagaactctgttagagaaccacagctgatagctgccagtcagcagtaaaggttcaaagcttggcctggccaaggagctatcacggagggctctgtggaccagggtcttgtagtgggagtgtgtcagcagagtggaggggttggaggagtgagcccaggtatgcaggggtatggatgggccgagagccttgggcctggcctggctgaaggctgtcctgttgaggcactggcaagtgggcttgggaggcagacggatgaccagacacggccccacagagatcagcccaaagcgcttggacccagggcatctgggatggttcttgaggtgagcgcatgaagccttgttttagacacatacactagaggactccagcctccctgcaagccctcctcctctctctctcctcactgttgaggcgagtgctgtgtctgccttagattccttctgcaggcttctgtctgcctgccagcagatgcctctatgtctgtcagccctcagaatgtcaggcacatgcactacccactgtgtgtgtggggtgtgtgtgtgtgtgaacatgtcagatacccacacaggctctccactgttcagtgtgtctccagtctgggacctgggggtggaaatagtcaccgtctacatccatcttcttctgcttctctcttaggcatttccaattcaacatacaccagcctgaactctttatccacatccctttccagcatgctcttcctccagcccctactgaccccatcacaggaaaaagccattctgttcttccagttactcagggcgacagcctcggagtcatcatcgatgtctttttcctctcacacctgacacctgacctgtggccatcctgttgactctccccttgaaatacatccagaatccagccccttgtccccactccagcactcacagtcacattgcacctggtctggaccccagcaagtgctgccctgtgggactccctgcttctccccttgctccacactgtctattctctgtagcctttaagaacaactcaggtcatttcactgtcctgctcaaaaccatcaaatcgtttcccgtttccttcagaatgacattcacagtcctttccgtcacagctctgcgtggcctgtggtgcctctgtatcctcatctctgacttagtttactccaccccattctcctccttcaccagactcccaggcactccttcacgagcagcatgcacctgccccagagccttggcaccagctgctttccctacccagaacactctccttcccacatcttcacagccagctgtttcattccctccaagtcccttatcagagaggctttttcagtcactttgagtaaaacagaaacctaccttttcatcattcttgaccccttaactaaacttgcttgagtttttgttgttgttgtttgctcgttttttacttattaccacttgacatcacttttgtgggaatccccttgcttttatggaaatatgtaagagtaaagaacttcatcttattttccgattatccccaggtcctagaacagtgctggcatttggaagctgttcagtatttgctgaataaatgaaatgaattatgctgtgattcactgtgtgtttggaggtgtttggagggactggcatgggaggattggattctacggtggtaatagtgacatggcatgatgaaggcatggagtagaggggcggccacagaaatgcaaaggaaggatgactgagggagaggcctctagctcggttgttgcaggacagggatgcttgactggcagtgccttggatgactcgttataagagctgtactccagactcaggatatgctttaaccataggttttcagatttctcctggggtccagtcaactcccatgccagtcccttgttccatgatcccaggccctgctccaattccttaactcttattctgtaaccgtaacccaaatggctaagcctgaggttgcaggctgacctttagagaaaaagttgaactttctctttaaagctaagtgggaaaaaaacaatgacggataaaatgtaaagatgtacaaaggtaccagtttgtacctgggtgtttgaatttctttacattttgctgtcagttgtacatggccatttgaaatgagtaatttaatattctgctgatttttaaatacatagatcattttcatggcactacatagtaaatctgtgctttgcttgtctgctatctgtgtgtttaggttcacaccagttctggtcgtgaagctatagctcaggcattatcatggacttcctagaagctgccttgccagcaaggagcctaagaggtgttcagaaaaattatccaaaacttggaaataaggaaagaggatgactctatgtcctttaaagtccagatcagagcattgtctattagatccactcaaggattatttaaatctcaaggagaatgtaactttgcttcacatactgtttactagtaactggctgcctgtcaacttgtgggagataagctggatacaattttgtccagtacagatgcaaatgattcccttcccttcccttcccttcccttcccttcccttcccttcccttcccttcccttcccttcccttcccttcccttccctcccctcccctcccctcccctccccttcccctccctccctccctcattctctctttcttttcttttctctctttctttctttctttcttctttctttctttccttccttccttccttccttccttctttctttctttctttctttctttctttctttctttctttcttctttctttctttccttcctttctttctttctttctttctttctttctttctttctttctttctttctttctttcttctttccttccttccttccttccttccttctttctttctttctttctttctttctttctttctttctttctttctttctgtctttctttctgtctgtctgtctctctgtctctctctctctctctctcattctgtctctgtctcattctgtctctgtctctctctctctctcattctgtcacccaggctagagtgcagtggcatgatctcagctcattgcaacctctgccttccgggttcaagtgattctcctgcctcagcctcccaagtagctgggaccactggtgtgcaccaccacgcctggctaatttttgtatttttagtagaggtggggttctgttatgttgcccaggttggtcttgaattcctgagttcaagcaatccacccactttggcctcccaaagtgctgggattatagacatgagccaccgcatccagccagctcttttatgtttaaatcggccaagcgtgatcgatttccttcaggttcaaaagattacccaaacattacagttgtattgtgccatagaacattaaccagttttgtatgtaacttagcaaacttttttcagcattctttctgacatacgatacatctgtgttcctcaaatgctttgagaatcagcttttccatcctatgggttccctcagtaatgagttaaagaattgtgcttgctacctgtatgagggtatgagagccaagttcctaatattttgaaaatgatgttttgatggaggagataaaaagtctcctgtgttagctatataaacccaaacctacaaaatgatgtcaagtaccatagaatgtatacaaaagacataacctactcctcccaccaatttctattttattagcatgcatttctcaggaaagactgttcaaaaggtaaggagagaataccattctaccattctgccaattcaagttagaccagctatttctctttgcttattcacttcctgttttctcttaataaatttatttaaagacaatttattagagaaaaagttgtcttacaaatgcgaattgtaagttgtcttactgatgtgatccagcaatccgtcctggccggcaccctgccaggtctgtaattaagactgggggtttgctctgcaaggacacattctccacctttgtctggggggctctgtactcagtcttgcggtttgtctgtggagctgaggtgctggttgggaatcaggagacgtcagttccggtctcagcaaagctgctgcgaggtgcggggcagaggcctggtttacctggtataccacatgcccttgacttccctgtggtaggtgcccctgattccgctccagctcttgctttgcatgtaatttacactgaggttgcaaacaactgcttattcctgtgggacttagttttttccttagggccaatctgaaaaacttacctccttagttacatcctacggatttgcagacaaataggggaaagaaatggaagaaataagggaaaatgttatccaaagttggaaataatagaagattactctatgtgctttcgatgtcatactagaagaagccgctttaagtagcaccattattctgaatggagaaatctgtggttgctttagtcatggagactacatcacaactagggttttccttttatttttgagatgtgtgtgatgggggaggataggggtacagcattctagaaatggcctcattttgcatttccttaggtccaaagttaaaataactttctgttctaagaagctttaaaagtggttcatggaccaggcacggtggctcacgcctgtaatcccagcactttgggaggctgaggtgggcgtatcacctgaggtccagagattgagaccatcctggccaacatggtgaaaccccatctctactaaaaatacaaaaaaatttgctgggcatggtggcgtgtgcctgtagtccctgctacttgggaggctgaggcaggagaattgtttcaacccaggaggcagaggttgtagtgagccaagatcctgccacttcactccagcctggtgacagaactagactcagtctcaaaataaagtggttcatttctttctaaaatcattaattgaacattaaaaaacattggtaagaaaaattgaaccaagaaggttttgggttatactgtaggtcagtgagctttaagtttctgtgtctctgaagctacatggctggacgatagctgaagtcagtgccccgagtgaagcctgaagaggagctgatggatttttctggtggggaaggcctgtgactgcactcagagagagctgggccaggcggggtgaggcacggtcactctgagttcacagacccactctgatccttgaatgggtctgtcctgaaataatggggaatcctggaacatgctgctttgtgtagacgcctttctcctttgcaacttttaaaggtatttgtcccctgggtttcatttgaaatgcttttttcttcttcttcttttttttttttgccagatgctttcactaggagcagtatccagaaagctatgtttctaacctaccttgttgtttgcctcttgggcaaatgggtttgtttaccttattgactcagttcagtggaaaatattaccctgattgggatggagatggggctgctgttctgaaataactacgcaagtttacctgttcaggtgggacacagcttcttgtgttagtcacggatgaattttgaaaatttatacatagtgcaataaatgctggtttctttccccttcctcactccttcctggggcctatatgtgtgtatctctaacacacatacacacacacgcaggcacacacacactcatacacatgcacactcacacacaagaggatacgttgcatatacagctcaatgctacaaagaagcccttttaccagaagagcacacgggaactccgctgaagtttgacagggtgattgtcttgtggctactctaccctgaggccagagcacagtgagggcctccctcctgcccccagccacaccaaagagggggcaggggttcacagggagcaaaagaggagctttttgccatcaccatgagacggtgaccacaggggcctggctcgaaggtgagggtggggctggtgactggtgcctgtggattccagagtggttggcctacacagcctactgagaggtagagcacggtcctttgcgtccctgtggactccgagtgcctgccatggtttggaaggtccactgaaggctgagtgctcagcggcgttgccagccagctggatgcatgtaaacagcattgtgaatggagaacattctttcaccttattcttgcacattcttctcccctacttagcttcttatccttcctatctactcatctagctagcaatccctaaaattaaatcatttataaatgagtccgatgagggtctttttttgaaaactggatttagtgaataaggcagacccctgtttttggatagggctttgcctcttgttattaaggaggaataacttgttcccaacttggttggtgaccccagctgaggaggaacaagtggcagatgagtcccagggaagacccctagggggaatggctggaggtagctgtatcagggatgaaaagggtgggggtggtgatgaggggaacgcagcccttcatgcaaagaagtgggtgtttgaaatcagtgggtgactatttttttggcaatgtgggctccttaggtcatacacagtggccttagaaagccagccctgcctctcttccctcaactgatggtggatttgtgtaatgagatcaccgtcttcttgaaaaacacttccagggtagctcattacaaagcctcgcacagtgttcggagcagggcgagctgcaaggccccgggctttccattctgaaagagctgtgggtgtcggggtggctgccagctgtgagagctccgtgggtggggactctgtccctcaaagccacgcactcaggcttgcccattctagtgtctctgtgggagacaatcaatgtaatttactctattaatggaatgaaggattacaataataaaatctttttcaaggaatgcaaaaaagcatttatcaaaattcaatatccattcatggtaaaaactctcagcaaactaggaacagtaggaaacttccttaaaataataaaggcatttacaaaattcctgcaggttgcatcatgcttaatggtgaaagcctgaactatctcctaaacccatttactcctcctcagggaagacttccctgaccccatgtttaagtcaaacactcattatacattcccttaggaccagcctctcatccaaagaagtgatcataaatgcaatttaaaatgtatttgtggttgggcgcggtggctcatgcctgtaacccagcactttgggaggccgaggcaggtggatttcttgaggtcaggagttcaagaccagcctggacaacatggtgaaaccccatctctactaaaaatacaaaaatcagttgggtatagtggtgcgtgcctgtaatctcagctacctgggaggccaaggtggaaggatcacttgagtctgggaggtggaggctgcagttagccaagatcgtcccactgcactccagcctgggtgacagagtgagacttcgtctaaaaaaaaaaattatttctgccactatttgcttaatgtttgttttctggtgtaggcattcagctctgtgaataaaagcattctgctgatttctgctgccctgtatccagacggaaggaatgggtgagtgaatgacaggcacctgttctgtttacagtcagtaaagtaaacacaacactacacgtatgaactccaccggaaagatgaacacttatggtatatttggtgccactgtcccagggagagtagaagtacagggttttgttcttctgacttgagaaatttttgtgctagaagggccactgagggtcatccaggcctatcactgcccaccccaaatttataggtgaggtcactagggcctgagatctgaagcatgcatgacatcccgaatgaactacaaatcctaggtcagagttaacagtagtggtaactgcacaggatgagttggtgcagggtgacaagctcatgcgtggtagctattttgaatcaataccccgtaactaacctctgctgtttgaaacacctggcagagtgctgcaactcacccttgggcaaagccccactctctgaggctgtggtggggttcagggaatactaccccaaaatatggcagattggcattggagaaaacggcagaagcaggaaggcctctctcaccttctccttgcccttcttttcctgaagcaggccatgaaaccaagctgactttctcctggagcaaggcataaggtccttgtgtgagaggtgcccactctttacctggaggggaggaacatctttatctctgaagacacagggacgcagaagaaaagctgaacaaacaggccttgctgagttcccccttgtatataactaattagatcatactccctttgtccaatcacacttctccactactgtcgacttctccatcaaacttacaataaaaacacacaggtgtccctattccctatttctttatctttttctttctttctttctttctttttttttttttaagatggagtcttgttctgtcacccaggctggagtgcaatggcgtgatcttggctcgctgcaacctctgccttctgggctccagcaattctcccaccatagcctcccgagtagctgggattacaggtgcccgccatcatacccggctaatttttaaatttttgtagagacggtgtttcaccatgttggccaggctggtctcaaattcctgacctcacgtgatccacctgcctcagtctcctaaagtgctgggattgcatgcatgagccactgtgcccagcctctttggatcttttttcctgaggtgtcttatgttacataaaatttaaattaaataagtttgatgtttctcttgttaatctgtattttgccataggtgcctcagctatgaccctcgtaatgggtgaggaaaaaacacattttcttccctgcagctgcttggccacctgccttttgcttggattggcagaaatctggcttaatctggcttctccagtcctccatcacctggccaggaggtagcccttggtctaaccccttctcatgtttggaagcagactttccctttctttctaaggactggtaggcagctcctcatggatggagtgataactccagaatgtcttcgtgtgatggctgttggagtgggaagtgggctgggaggctgtgctggcatagactttgtgtaggattgagaagacaataactgccagtgtgaagatcaggcgggagttgggaagacagctgagagtggccaaggggaagccagagcctcttcaagtcatctctagatgggtgtgaaagggagagaagaggccaagaaaccatgagattaaaaggtggaggtgggggcatagagatcccagctgctctaggggaccctcccaggcaagtgctgtgtgtgtatgctcctccactgttccttctgcaatgcattccatctggctgctagatacggtaaagggaatgaaaggtgggaaaggcaaagggtgcatttaatccactcttcagctgtgaattctctagaggagagctagtccttgtgtttgttgatgcagctgcctctctcctgagacctgtaaaatgacttttttttttaaaggtaaaatcatgactcttacacaaatgtaaaatgaacacatgtcaaagattttatttagttcattaattaatgagggaaccagtaagatgctacaaccagcccaaaggagaattaaaaatgccacgcatagctaggacaataggaatgctgacatagaatttacaaatagatgcaaaattgatgatagccactggacagtctgtccacatgtccatggacaaggatagttggcattccatgggtcttttacaacttgcaaaccgaggaaagtttaggtcctcctttttccttgctgacctttcatgggtcagccctcatctggacatcaacactcctgagacatgtggtcactgcaataattgactgaaatcagtaaagacacaatttctccctctgctgctccgtgttcctgtctagagagttgttttcctctccaagtaaaagttgttaaagagcttaaagacaatgaagggcagagagagccaggatgtgaagacttttctgctgtactgtctttcacagatccatgttgcagctgggagcacggggaaacctggacacgcacttcaccaaaatgagacaactgtggcaggagacaggctaaggcgagtggggacaaatcaatgtgctggatgccctggtgtacctgtgacgaagaagcaggagctgggaagagagaggaaaaggaaatagacaagtgaataaataaataagagttcagaaaccccgtctccaccaaaaatacaagaaattaggtgggcatggtgctggcgcctgtagtcccagctattcgggaggctgaggcaggagaatgacgtgaacccaggaggtggagcttgcagtgagccgagattgtgccactgcactccagcctgggtgacagagcaagactccatctcaaaaaaaagagttcaaaggaagtgtagaagagttgagagaagaactctatttgcacattcactcttcagttcatttcctcattcattttctgaacagtgaatctggctctgtgctggatcctggagcataaagactaaattagctgcacaaagaccctgatcactaacatcctagtgggaaagacacactgtgtattaagctgagtaatcaccaccttcccaccatgtctgtatcctgatccctggaacatgtgaatattatcgtatatggcaaaatggactttgtagatgtgattaagttcaggatcttgagttggagagattactctgcattggcctaatgtaatcacaggggttttcataaggaggaggcaggtgatcagcataggagaaggcaatgtgattatggaagtaaatgtgggagtgatgcagctacaaactgaggaaagctggcagctctggaaactggaagaggcaagggacagattctctgctggagccttccaaaggagccaaccctctgacaccttgctttcagccttgaaagacacattttggacttctgaccaccaggactgtaagagaatagatttgtgttgtttgaagccactgagtttgtggtaattgctataggagtcataggaaactaacatatatgctgaacaattgcatggtcgcatgattgcaatgtagagtgttttgaggaaggaaattaaggcagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggatgatggaggctggtggcaggggcattaatgtgtggccatggtggtctgtgtgatacggtgaaaatgcaaaggagatgaactcccaagacttttgggagacatttataggaagatgggtgctaaataaatccaaggcagtcttttcagacagagggcttgataccactaattaggcagcttggatgagtggcaccatggaactggctggtggttttcttgtgaaaatagacacaaactcccttctctccatgttcttagaagatgtgaatttagaggtctccacattgcctgacaaagtctgttttaactgggtaaaataaaaaaaaaattaccattgtattgctcctgaaccttgcttaaaattccctttaaagatctacaaagggttttgctcatttgtacaatcttaaaggtcacaaaattagaagcttagcagccacatgccaactgcacacagcatttgaaatctttgacacagaccgttccagaagtcacaactggcaaagctgcacttcttgtgacactcagtagcctgcacacccatctcctggcttgtaagcatatgcctttttgtccagccagctgaggtacttggttcctgattgttttcttgtttgttttttaatgctcagatattctcatgtggtgaatatttgtgagccaaattacttggcaggagcgtttgatgccatggccaaatggggagcccagagtcagcatctttttaaagctaactcttacttgccagctcctctttctgcccacatactcgccccgtaccaggcccagtggctgttgcacagacaaacaccaagcagtcctgcaaaccccatttgcttccttctgggcttgatgctgcctgggagtgggcttctccctgggtggtatgtaggagttttccttacattttcatttcttatcagcttaccatttgcaactgatgcaggacaggcaagaccccaaactggggcttagcccaggaggattcttggctttgcccaggagagaattcaagcacaagtggtggtgttagacagcaacttttattgaggcagcagcagctgtactgctccctgtggagcagggctaccccacaggcagtgtgcccagagtagcagctcagggacagttcagcagtcatatttgtacccacttttaattacatgcaagttaaaaggcagttgatgcaggcatttctaggaaaaaggtggtaacttccgggtcattgggttactgccatagaaaggggtggtaactctcaggtgttgccacggcgatggtaaactgacatggcacactggtgggcatgtcttatggaaagctacttctgccctggccctgtttcagctagctctcaatttggtccagtgtctgagcccagcctctggagttgagtcccgccccctacctcactatcttggttctatttggagatgccctgaaaggctgtgtccagtcccacagtgagtgaggaatctatgctgaggttcctttggaggtgaattttgaatgacgtataacccagtacagaggaaaagtccagaactgagggatgcaggctaatattaaagactcatagttttgggggctgtctgtccaaaggctcatgcatgggcagaaagagttcacctgacctgtgctgtgggaagtttgctgtaaacattctgataaacatttaactttagtccctttcagtaccagtgccatgccctgcagtgttcactaagcgcccacaggcatctgctctctgtgacctgctcatatgacgagctaaagtcgagcatgcttcattcacagccaggcctcctccttctttgttggcctgagtgtgttgctgaccattcatgggtcagccccgacctggacatcaacactcctgagaaatgtggcaactgcaataattgactgaaatcagtctctccctgtttgctggtccatgttcttgtctagagagttgttttcttctccaagaataagaaggtggaatcgatttttccaccttttgttcccctcaccccagtgatgatgaggcaccaggagggaattttctgactttctgcaggcatttatgttctgcttcacatcatcatatttattcctttaatgtaggagaaccttaaatgaagcttgttggaaataggccatcctccataacctgggtttgttggagcccatgtatagaaatgatttcttggcaactctagttctcttgagcatgtgtgctatggttaaagaggcagaagggcacaagaattttagcaccctgaggactgaaaaccttccatagaaccagcatacatattgttttataaataaggagtattcttggggtatagttgtttgcaaagaaagggagctccttaagatttatgacccagctcacaataaccagatgacctgaatcaagggtgtatgtcaggaacaggatcctggaggggtcaatgacagtgtccatctgtggcctcaaagagcccgttcccaactctcctgccttttgacagaaggtctgtctggttatggctttaggaagatagatgacttctgtatagtcacaggaagagtctgcgtgcctggagctgtgggctggaaaggaggtgagagatgctggcctctccaaggcctcgtccacgtgccccatctccagacaggagcagccagggctccgttaggctgcaaacaatggaaaacctgaatagcagaggcttaaaaaacatgtggtttgcttgtctcacctgaaagaagtctgaaattgggaagtccagggctgggtcagaggttcagagatgctggggttgaggcctagatggctttttggccttttccccaggaaaaaacagaatcaatcagaaggtggctgatgtaggtcaggtgggctggggctggaggggatggtaggctgtgagtctggcgctccctcttgctggtgtggggatgggtaccaggagggcttctctcctccaccttgctctgttgctctgttgctctgttgcccaggcacccattgccaagaagccagactggaattcccaatgggatggggcagtcccaaggcacatggaatctttggtgggacttatacaccctgtactcctgtgagctcctcagtcactctggtcaaaaactctaatattgttccttttaacacagtcatcacccaaaaccctgttaaacacccaaatgcacctggggcaacccttgaccttatggagcccactttctttgcaaacaacacagatgttgagatgaagcaggaaggagtggttacataggaggatccagaatccccaaccccagggagttcgatatgggaaaaatgcctctgagtagggcggagggatgctcagagggctgcagggtcctgggaagtggctgtgtctcaaagtgtgctccatattcatacccgtctttccccactgcttttatttgcttcgcttttgaatctgtgattcaccttctttggtctcacctcttcctcgggccctttggttaagggcaggctgattactgcatatggctgtgccccagccctctgctttacccagcgattaaggagaagcccacaccaattcaacaaggcttgcattttaggagcagacaaaaatcttagacccagaagccaggtgtgcagaaaatgcatgttggcttccctttagcgttatctaatttcccaggctcaattctgtctgggtaaaggaacattattcttggttagctgaagtcccctgcttttcctgcagatgtgtctgatgctgggggctggcattgctccccttgggggctgggagatgctctcctttctggtctttggttgtcagagcctgctgttcactgctgttgtctcttgttctgactccaccccagctctgcttcaatcctactctctccaggccacagccacccactgggacctcccatgaagctcttgggagctctcacccatcctggagggagcccatgtaaatttgggcctggcttgttgattctgaatcaccaaataggcatttgcgcagcctgcctctccaagggaacttcagggttttgctgccactctggactttgtctgaggctatctttctgcacaaactgcacaaagtggggatgaagcccacttcatgggcacaggcccttcccaggacactgcagcctctccatacccctcccccctactcaggaggcctctgtgctgctgaggccaaagatttgctttgaaaggccaaatattcttcctgagccctggtcttaacccggggctgaagctttgctctcaaaggtaaaggtgaagacctccattttcctctgctctctgcaaattgcctttggctgaagcagggaacaggaaatgaatgaccaagttatgtggcctgggagagggagaagagcccagtcaacagctcaagaaatcccgccatgtctacttaaggggaagaagagagaaaggaggataaagagagattttttttccttttaatataatgcacattaaattttaggttgtttttttttttttctacatttaggtcccttatgtggcagaaaattccaaaatatattagtaaaaatgaacccaccttacatactcttggggtttcgttgaaatgttgagaagttaagaaactttgttagattattttacttaatttttaaaaaatagcctatcaaggagttttcaaaactttttaggtgtataaacaccctatttcggaaaccaccgtattttacactttcacttcccacctacaccagctcagtgacaagaaagtgtctgaaacaaggtgcaaaatcaaggttctcagaaacacgcttgggacgtcttgttccgcagcttggctgctctttccgcccggagtgtccttagcctgtgcccctttcgaactccggcactttgtctgcggagtagctccagcgcagtctcccagcgttacctggcagcctcctccttcctggagcaggagaagcggctctgtctcctgtgttccatcatcgattatggctgctctcacactgggttaggaaggtttggtcacctgagtgcctccctcctctgtgctgttggactctatggtttacatactcctagatgctattttttacatactcctaagttttcaacctgagaaatctgaaaccatcccctaaccttacctggttacctgttgaaaaatgtgttatcccagaggtagattctttgggtcctaggcatctggacttgcaagagtctcatgtcagtttcatgtgcttacaaaggtgataacagagagggacatagctgtgagtttttcccaacggccagtgagtgcttcgttccctgtatcatgttttatttatttatctatccccagggctagtgcagtttggacatagggtgctatgggttgaattacatacttgtcaaatccatatgttgaaatcttaacccctagtacctcagaatgtgacattatttggagagagggtatttatagaggtaattaggggaaaaggaggtctttagggtgggtcctaattcaatatgaccgatgtccttatatagagggaaaatctggacacagagctgtatacatccagggagaacgtcatctggagatgaaagcagagatcagagtgatgcagctccaagacatggaatgctgaagatggtgagcaacccaccagaagccaggagagaggtataaaaggtttctccctcacagcccttagaagccaccaaccctgctgatgccttgatctctgatcctcaaggatgtggagtagctgtgtgagaggctgtctgagggctcttcaaaaagttcataggaaatgcatattatgaaaaaactatgctggatttcaaattttttgcaccaaaattgatttgtactacctttttataacatgttcatgcacaatctagtttgaggcactaagaaggataatacatcagtttgaaaagagcctctatcagagcaatgtgaatttctgctaaaattgaagtaagaacaaacatcaaatttatagtgaagcttgaggggaagtatagtgaactcattgatgctttgtgaaaagcttatggagacaatacccccttcccccaaatcagcagtttacaaatagataacttcttttaagaagggagaagttgaggctgggcacagtggctaatgcctgtaatcccaacactttgggagcctggggcaggtgaatcacttgaggtcgggaattcaagaccagcctggttaacatgtgaaaccccatctctactaaaaatacaaaaaaaaaaaaaaaatagccaggtgtggtgacaggcacctgtaatcccagctactcgggaggctgaggcaggagaatcacttgaacccaggaggcagaggttgcagtgagccgagatcatgccactgcactgcagcctgggtgacagagcaagactctgtctcaaaaaaaaaaaaaaaaagggagaagttgatgttgaagatgaagcctgtggtggcagaccattcatgtcaatttgcaaggaaaaaattaaccatgccctaattgaaaagacctgatgattaacagacatttcagttggttcagtttatgcaattctgactgaaaaattaaagttaagttttccactcaatgggtgtcaaaaccattgcacccagatcagctgcagacaagaacagatctttcaatgaaaattaaacaagtaggatgaagatcctgaaggatttcttcaaataattgtaataggagacgaaacatagctttaccagtacaatcctgaagacaaagcacaatcaaagcaatggataccaagaggtggacattttccagtcaaagcagaagcagaccagtcaggagcacaggtcacagcaagagttttttgggatactccaggcattttgctgttgactgtctgtagagccaaagaatgataacatctgtttattatgagagtgttttgagaaagttagccaaagctttagcagaaaaatgccactgaagaattcagcagagagtccttctccaccctgacaatgcttctgctcattcctctcattaagtaagggcaattttgtgaatttcaatagaaaatcattgggtatccaacttgcagttctgattttgcttcttctgacttctttttgtttcctaattaaaacaaaataattaaaaggcatccattttcttcagttaataatgtaaaaagactgtattgatatggttaaattctcaggaccctcaatattttaagaatggactaaatgggtggtatcatcacttacaaaattgttttgaacttgatggagcttatattgagtaatacagtttataaagttgatatttttcatttttatcttttgattccattttccatgaacttcctaaagtcctcttgtatttctaggagggtcttggattaaaaaaaacaggaggaaggaacaagtgagaaattactctcatagtttatggcgtgtcttaacatcaagttacttttaagtcttttattcttttaggaagatattttctctttcagggaaaattaagaaacatcagggcctgagttatgttggaaaatctctcccctactctgactgtctggctttattctgagctcccaagctataacagtggcacttgggtgggatgagagtggggtggggctcacatctacatggctgaagaccaaggcagaatctcacacccaagtcttgattctttgtgctgcttagctgttgttcacaccacttttcctgcttgtgtccagatctgaatgaaactgatggctgttggagaggcctttgtcatctgactctatctgttcctctgtcaagtaataccatcaatgatgctattcatagaaacatttcatgtttgagaggtgttaggagttgaattgtcttctagaagctgttgaattcctaaccctttatatctgtgaatgtgactttatttggatataggtagggtctttgcagatgatcaaattaagatgaggtcagtagggtgggccttaatccgtattactactggtcattctaaaaagggaaaatgccgatacagacagatgcattcaggagaattctgtgtgaaaatgaaggtggagatcagtgtgatgcatctccacaccaaggaacactaaaggtcaccagcaaaccaccagaagtgagatgcgaggcattgaataggttttcctcgcagcttcggaaggaaccaaccctgttggcactttgttcctggacttccagcctgcaggtggttgtgtaagcatttctgtggtcgaagccacctggtttgcagtactttgttagggcagccctagcagactaacacaagaggtcattgaaagtgtcatatccagaacagtgtgccttttgggggaggaaagtccagttggccctttcacatacacgaacatctcacatttaaagacacaattccaggctgtctgtggacactcataggtgcccgtgaaagccgcctcagccataaacttcttggagtcacattgtgaagtatttatttttaattacagattttctttgatgatcctcttctcttctctttttgtttccttggcttgtcactcattcgttgtggtaaatagactgcctgctgtttacgatgagaagtagcctgtgctttggtctggtctcctgacgcccggttgccagcagtccttgctgtctctgggttggaagccgtgatgcctgctcatgggctcgctgtctcctcaggcatgaaagtggaggcatccttctggctctattttcaacttaccttggtgaggccacaagaccctattgacacatgaaggggaagcacagagggaaagggggttttacttttcctcttcaacagggctagccctcggggactgagcagagagagttgtgaatgctgggttttgaaactggccccaaacgattgtctcctggaatcagagaaggaacaaccgactgcacctaaaagaaacagagtgtttaccagtcttgctggatggctttaaaaacgcaaatacatacgcattctcattagcccatagcactcagccatcttcacccccattagagaaagccagtctgctgcctgcccccctcaagtcactgctgaactcatagcatgtgtcgggcttctggaacctcacagatgtattgccgcagacaccctttagatgagaggtgtaggttaggggcacaggcaagggagcggtcactcctagacctgaagcatctcttccatagacgtcacagtatatatcttcccagccagctcctccccagcccttcagggaaggtgaacacaattccacactagagtggcttttaaagaaaaataacatgtatgaactcttcccagaattctatgaaatgaatgagtttgcattactttttctagcttatgacctgagtcttttattttttcagatacatttagttgtgtctttcaaaatctatttttgcagaacctaccctttgttagcattgggctggaaccccggaaggataattatgtgtgggacttggtagctgcccttaggtgtacaatcccataaaggagagatgccatatgcagaatgatgaaatgcagcatgaggctaagtgtccagcatgggttatggagggtagatgagagagaggttggtgcccagaagacagccgtcctgcctcgggcctatatgtctgcagaggcccacaggagtggggcagtcctgttcagggagggctgaggggttctccgaatcttatcaggtaggacagggagactttagaaaggattgggcattcagtttgtgggtgtgttataagcaaagtctggagcagctgtgagttggatttcactgggtttcatggagcagatgtctcttgctggggaatgatgggatgtaagactagagacagacacagtcagaggcgatgtctgccttgaggcagacaaacagatttcaacttggtcttctgggcctaggcagtgagaagcctggaaggtgtctgagcttggagatgacctcatagagccaactttttggaagattggttgggtggcagagtacactgtatgaaggcacaggagagagaaaggacaaatgcacaaaggaaggatccagaattccagggcaggctggacatgtgggcctgaaggaaggggaggggtgaagggagacctgaccatggcttctgcctgcttgaccaagcttggcatgtacattagaatatacagagtttgaggcctgaggacccttgttctttttcaataagtaatggtattttaaaaaccatctctgggttttatcatgagcagaggcgaattccatgcacagtgaggactgttttatttatttatacttgttgaatagtaaacagcattgaagaatgtttttaaagaaacccaaacttccttttccatttctcagtattaactttctttttagcaactagggacacaattgaatgctattgtcttaaacctgcctgacagagcagaggtacacgctggggggcgtgggaacctctatttggcaaagggaacttctcctgttattcccatatggaaagagacataaatttggggagagcttgctccttccctacatttctgtgatccatggttaacagtctcctcaagtgaatttcaaattctctttccaataagctgcaaaagtacttaaatcatttatttgttctgctcctgaaatgagagttactcactaaagtcccaaagtgtcccgaaccatgaggtgtccacagtgaaatgacatgtttaaaagttgccataaatgctggtaactggacatgataataaatctgagtcatttcacatggccagttgggtcggtaataacaagacatgcacttaaaatatatatctttttgcctttcgggctataaagattaataaattgtgtaaatttccaagataaagtgtgagacattctgaattttatgtgaatgacttgcatggtgacagtaaccatgttctggcccttggaacaggaggtaatttactgttgatggtttcttggcataatatatatacgtatttggggggtaataatttaaaatcatccagcacatggtctctgataaggtgcataactcaggtactcagagttgttttataggaaaagagatacaggcacaccgtgcgactgcaatcccggcacgttctccttcctcaggaatgacaagggatggaaacctggctccccacggggaataataaagcatgcctgtgaaaaatgaatcctggacctgagctcagggccagagtgctccaaaatttggggctttcccaggacttagtccagatttgcttctgtccaggccagtgaccgcttgaagctgtagagggcaggggagggagggtccccttcctgaaagggaagtgctgtgagacgtggctgtcactgataccagtggggacctctctgcccccagcctctaatcatgcttgaaggtttactctctgagcatggcttgagaagacaagggaaagcaatggagattggccatcacagccaaattctgcctgatatggaggcctgagtccttttgtgcaggtggtgactcactgccctgttgaatgggaggaaggaacagtgatcagacccaaacactctggttttcttcccacctgtttctcagaagtaataagtgcagggctcatgctctgcctgtgtgtgtgtgtgtgtgtgtgtgtgtgtgtctctgtgtgtcctgtgtgtgtgtctctgtgtgtgtgtgtgcctgtgcgtgtatgtctctttgtgtgtctatgtgtgtgcgtgtgtgcctctgtgtgtctctgtgtgtgtctctctgtgtctctttctctgtgtgtgttgtctctgtgtgcacgtgcatacatgtatgtccctctgtgtgcctatgtgtgtgcatgtgtgcctctgtgtgtttctgtatgtgtgtgttgcagaggagctgctaatgtgttctcatgctggttgtactgccccgccttggaacaactttatccttgggtgcaggggctgggtgagcctggaagctgccagatgcagcacatgatggaggagaagggcctggaaacttttgcagttgtcactcaacaaacactcatgcagctcctcctgtgtgccaggccaggtgccaggagctggagggaatacagagagtgagcctgccgctttgggatctcatctcctggaggaggaataagttatctacttaggtattcaattttaactggtatttaattacagccatacaagtggttccattattagtcaagctgaactaagttttgctgcaataacaaattttcccagaatctcagtagcttaacggagcaaaggttggttgcttgtgaatgctgtctgtcctacaaggtggtgctctgctctgtacagtcactcaggattcaaggctgacaggctaccttcttctttaggctgtgcattctggaacatggggtttctttagcctctgtagtggggaagagagacaagagactcactcacaagcttctctatcatactaccttatgatggaggtggtgttattagcctttttacatctgaggaaactgaggcacagaggagttaagtaacatgtccaaagtttcacagcaagtgagtagcagaaccaggattgtgagctccagccatctggctccagaatccctgttcttgtcatgctctgccatctaattaaacagtttcttgggaagggaatgaagagatgtcagacaggccaggagctcaggggactagaaaaagaatttatcagaagaaggaaagtatgtcggggaatgacagggaaggataaatgagcaaggctagaatcccagaaaaatagagagacttcatcttggctggcagaatagcttttgcaaattcgggattagaagcctggtttcatgagtttgggacgaaagctacagaaaatgcagacacagggtggatcttacggattgtgaagtcagggaggtctgaaatgaaatagaaatggcccaaggaaacctttcatattcctttttgtttccacatacatctggccacaaaagctctttggtggtttatcccatctcactgcttccttagggctctttcaaactccttgcatctatgtaagcatggataaggagcacagcagacatgggacacacctgtgttgctttctgggcatgctgtaggatgccactttttggctgtgcacctggagcaagaggcagcagggcagcagcacccagccccctgcagttgaagctaaagactgcagctgcagcgcaggaattccccagtaggacaggaaagcaaacacaggcaagataaggtcagagacagccaactgtttacagcgtccaagctcttcctgggtttggtccaccctattaaaagataataacctcttaaaacatttcaaaggatgtgttggcagtgtttaagaggaaacataattgtcaccacagcctgggtagtgtgcaattgagtaggagaccatcttcaggataggatgggtgatgggcaagattgtgctgggagaggagttcgtttgaactgcagactccagaagctacagtggctgcccaacccatgaaaacacccacagatgctgtaactgctgggtatctgtcatctttggaataaaccactcatgctggggtctcactttctaagccattaccagctgcaagggttggctttgtgaaggcaaagggaagtttactttataacgatgtaggctatgtggagatatagaattataggagcacaaagtgcattactgactcactgttctgctgcccatagagcagctcatcctgctttgtgaggcattgctgtgagttgccttcaggcaacttgggaggaagagctgcctgaaaccctttcttgaatcttctttaaggttgctgatcaggacccatctaccatgggaggactgtggggattcctccatgacctcagtgctgagctgatctggctcattaagagatggttcttacgaccgggttcggtggctcacgcctgtaatcccagcactttgggaggctgaggtgggcagatcacctaaggctgggagtttgagaccagcctgaccaacatggagaaaccctgtctctaccaaaaaaatacaaaattagctgggcgtggtggcacatgcctgtaatcccagctactcgggaggctgaggcaggagaatcacttgaacctgggaagtggaggctgtggtgagccgagattgcgccattgcactccagcctgggcaacaagagcgaaactccatctcaaaaaaaaaaaaaaaaagaaaaaaaaaaaaagaaaaaaaaaagaaagaaagatgcttcttacaaagaactctttctttgcatctcatggataatctgaattgtacatctcactgaactaccttctttgccatggctgctggggtgcccagagcaagtgaccatggcatgcatgctgtcacctaagtggctttctcttatttttcttttccttctctgttatttattctgttgtattgtttatattttgataaactcacttaaattcattttgggacaagatgggatctaaaccaagaagtagataaatatgtgtgctttagagggtagttattgcagagtctatcctgggaagagtggctcctttgttcaggatgcctttctgggtatgaggggtgggttcaattccttccatccctttctagaagtatgtagtctttgatggattcattgagtcactgatttgttctgtggacacttattatgtgccaggccctgtgctaggcctgaggaaagtgacgatgacctcagagttatgttccagtggtgggagataggcaaagactatgtaagtgggcagagacactaattacatgtaagaaccactgccttgaagggagaatgaggatgagggtgtgtcttaggtgggctgccatagcaaaataccatctactgggaggctaaaacaacagacactgatttcacatgctcttggtggctggaggtcagagatcaaggtgtcagcaagttttattctgaagcctcttcttttagcttgtaggcagccacatctcactgtatgctcacatgacctcttctcagtgtttgagcagatagagagagagagagtgctttgatatctcttcttacaaggatgttaatcttattggaccccatccttatgacctcatttgaccttaattatctccacgaaggcttcatctccaaatcacatcacactgaggcttggggcttcaacatatgcattttggggtgggcacagacattcagtcatgacagagagggagaagatctacttcctatggggtgacgcaggaagcccactctgcagagggcaacatgcatgctggaatggaaaggataagaatgaggtggctgtgggagaggagggtggggaggcatgtgagggcgcgaggtggagagaacagccagggcagaggccctgaggctccctgagcagctggtgtggtcgcagcttactcaggagtggagagtagcacaggggaggatgtgagatgagtggggcacgagtgtgcagagccttgtaaaccagctatggtgagggttttgggtttcctactacatccagtgcaacgttactgaaagattgtaagcagagggatgtcatgatctggcttaggcttaaggagctgtgtggacagtgggctggagggattgggaatggaggcaggagactgcttgtcagttttggtaagaggctgggaccatggtgatggccacgttctagaagagagagtggaatctgttgatggaggaaatgtgagagacagggagagggagcacttaagggcaactcctaggctctaggcagaacatttaggtgcatggcgatgctgtttactgagctgaggggatgcggaagggagcagaggcaacgtgtatgtaatgggtaattgcatgtgtcaatttgactgggctaagggatgcccagatagctggtaaacattgctttggggtgtgtctgtgaaggcatttccagaagagactagcatgtgaatcagtagactgagtaaagaagattaccctcaccagtgtgggtgggcattatccaactgagggcctgaatagaacaaaacggcagagacagggcaaattcactctccctgcttgattgcacatcttctcctgccctcggacattggtgctcctggttctctggcctttgggctcagacaaggtgatatggtttggctgtgtccccacccaaatctcatcttgaattatggctcccaagatccccatgtgtcatgggagggacacagtggcaggtaattaaatcatgggggctggttttcccatgctgttctagtgatagtgagtaagtcccacgagatttgatagttttataaaaggcagttccgctgcacatgctctcttgcccgccactgtgtaagacatgcctttcctcctcctttgccttcctccatgactgtgaggcctcctcagccatgtggagctgtgagtccattaaacctctttttctttataagttacccagtctcaggtatttcttcatagcagtatgaaaatggactaacacaacagggcttatacatcacctcccctttagacttgaactgagttacatcagttcactgtctgcaagctggaggttttcctgggcctccagcttgcagacagaagattatggaacttctcagcctgggtaattgggtgaatgaagtcccataataaatctcttatatttctctacatgtcctgttgtttctgtttctctggagaaccctgactaatgtagtatgtaaggcacccagtcataagggcaggctatccttccattaatgacctcattccgggtgtatctgtagcctagaccactcttctaggaaaatcctattcccttcttgtctcttccatgtggaaatctcacagacattgcaacccaacccatccaaatcagatgggaaccaggggtttaatgttaacaggtgatatctgctgctgccggtctgccattgtcctaaagcattttatacacattttcttatcttagaaagtccctgtaagataggtgtgctaacaagaatcattttgcagctgaagaaatggaggtgctactggctcaaggaacctggattcatttagagagtgtgcccaggatgagacgtgtggagagcctggcctgaaccaacactaacagtctcctggacaggaggtgagtaaggaagaagcggcagggaaggagggacaccgggtgaaaggaggtgggtgtaggaggaaggagatcacaactgtgttgaaagtcctagcagcctgagaaagacgggggaagaaggccctgcaatgaaccctgtgaccttgggaaggacaagtcctcttgcccctggggcccactgtctgagtccctaggaagtatatatacaaagggtttcggaatgcagagtttgcagatgtgggctgcagctgcaccctgtgtgtgactggatggaattcacagctagaagtggttttgtccctggctgctgaatgtatcagctgttggtgccgctttagttttattgagtgggaaggatgtagaccctgagtctggagaatgggactgggctggccatggagcctggagaagagaatgagaccatgcaaaacctttattccttgttcttggtttcttgttaaacaggcccagtgccaccagattaaggaggtgagggggcggttgtaagaaagtaagagatcagtctgaagattataaatatgggccagtgcaacaaagggaaattcttgtgtcaatatttttctgagccagcacttgggagatcctgatttccttaacaaaatgataacaaacattttttcatgttaataatgtaagatgaacatttccttcatgtttaagccactgaatgtgcagtgaacaaaagacatttacatacaggcatatttgaggatatggaaggttcaattccacaccactgcaataaagcaaatatcaccatagagcaatttatacaatttctttggttttccagtgcatgtaaaagttatgtacattatactgtagtctattaagtgtgcaataaccactccttatctgtctaagaaacatacataccttaattaaaagataccttattgctaaaagatgctaaaggtcatctgagcctttagtgagtaataatctttttgcttgaaggagagtcctgcctccgtgttaatggctgctgactgaccacggtggcggttactgaagcttggggtggctgtggcaatttcttaaaatgagacaacaatgaagtttgacacatcagttgacttttactgtcaggaaagatttatttgtagcatgcaatgctgtttgggatagcattttacctacagtagaacttctctcaaaaaaatggaatcaagcctctcaaaccctgctgctgctttatcaactaaatttatggaatattctaaatccttttttgtcatttcaacgatgttcacagcatcttcaccaggaggaaattccatcttaagaaaccactttctttgctcactcataagaggctactcctcgtctgttcaagttttaatatgagattgcagcaattcagtcacatcttcaggctccacttctcattctagttctcttgctatttccaacacatctgcagttactacctccaccaaagtcacaaaccccgcaaagccacctatgaaggttggaatcgatttcttccaatcttatgttaatgttgatactttgacctcctcccatgaatcaatgtttttaatgacatatagcatggtgaatcctttccagaaggttttcaattgactttgcccacatccattagaggaatcactatttttggcgctataaccttacaaaatgtattttttaaataataaaactgggaagtcaaaattatgccttgattcatgggctgcagaatggatgttttattagcaggcataaaaacaacattcatctccttgtacatctccctcagagctgatgggtgaccaggcatattatcagtgatgagtgctattttgaaaggaatcttttcttctgagcaacaggtctcaacagtgggcttaaaatattccacaaaccatgctgtaaatagatgctatcatccaggctttgttattccatttttagaacacagccagagtatgtaactcatttatttatttatttaatttatttattttattatactttaagttttagggtacatgtgcacaatgtgcaggttagttacatatgtatacatgtgccatgttggtgtgctgcacccattaactgatcatttaacattaggtatatctcctaatgctatccctcccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatcccgtctattattgttggacatttgggttggttccaagtctttgctattgtgaacagtgccacaataaacatacgtgtgcatgtatctttatagcagcatgatttataatcctttgggtatatacccagtaatgggatggctgggtcaaatggtatttctagttctagttccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcgtgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctttcccatgcctatgccctgaatggtattgcctaggttttcttctagggtttttatggtttcaggtctaacatttaagtctttaatccatcttgaattgatttttgtataaggtgtaaggaagggatccagtttcagctttctacatatggctagccagttttcccagcaccatttattaaatagggaatcgtttccccatttcttgttttgtcaggtttgtcaaagatcagatggttgtagatatgcagcattatttctgagggctctgttctgttccattggtctatatctctgttttggtaccagtaccatgctgttttggttactgtagccttgtagtataatgtgaagtcaggtagcgtgatgcctccggctttgttcttttggcttaggattgacttggcaatgtgggctcttttttggttccatatgaactttaaagtagttttttccaattctgtgaagaaagtcattggcagcttgatggggatggcattgaatctataaattaccttgggcagtatggccattttcatgatattgattcttcctacccatgagcatggagtgttcttccatttgtttgtatcctcttttatttcactgagcagtggtttgtagttctccttgaagaggtccttcatatcccttgtaagttggattcctaggtattttattctctttgaagcaattgtgaatgggagttcactcatgatttggctctctgtttgtataagaatgcttgtgatttttgcacattgattttgtatcctgagactttgctgaagttgcctatcagcttaaggagattttgggctgagacgatggggttttctagatatacaatcatgtcatctgcacacagggacaatttgacttccacttttcctaattgaataccctttatttccttgtcctgcctgatttccctggccagaacttccaacactatgttgaataggagtggtgagagagggcatccctgtcttgtgccagttttcaaaggaaatgcttccagtttttgcccattcagtacgatattggctgtgggtttgccatagatagctgttattattttgagatacgtcccatcaatacctaatttactgagagtttttagcatgaagggttgttgaattttgtcaaaggccttttctgcatctattgagataatcatgtggtttttgtcgttggttctgtttatatgctggattacatttattgatttgtgtatgttgaaccagccttgcatcccagggatgaagcccacttgatcatggtggataagctttttgatgtgccgctggatttagtttgtcagtattttattgaggaattttgcatcgatgttcatcagggatattggtctaaaattctctttttgttgtgtctctgccaggctttggtatgctggcctcatagaatgagttagggaggattccctctttttctgttgattggaatagtttcagaaggaatggtaccagctcctccttgtacctctggtagaattcggctgtgaatccatctggtcctggactttttttggttggtaagctattattgcctcaatttcagagcctgttattggtctattcagagattcaacttcttcctggtttagtcttgggagggtgtatgtgttgaggaatttatccatttcttccagattttctagtttatttgcatagaggtgtacagtgcaatcaaactagacctcaggattaagaaactcactcaaaaccgctcaactacacggaaacggaacaacctgctcctgaatgactactgggtacataacgaaatgaaggcagaagaaataaagatgttctttgaaaccaatgagaccaaagacacaacataccagaatctctgggacacattcaaagcagtgtgtagagggaaatttatagcactaaatgcccacaagagaaagcaggaaagatctaaaattgacaccctaacttcacaattaaaagaactagagaagcaagagcaaacacattcaaaagctagcagaaagcaagaaataactaagatcagagcagaactgaagtaaatagagacacaaaaatcccttcaaaaaatcaatgaatccaggagctggttttttgaaaagatcaacaaaattgatagactgctagcaaggctaataaagaagaacagagagaagaatcaaatagacacaataaaaaatgataaaggggatatcaccaccgatcccacagaaatacaaactaccatcagagaatacaataaacagagtatgtaattcttaaaagccctaggagttttggaatgagcgttggcttcaatttaaagtcaccaggtgcattcgccctaataaaagagtcagcttgtcctttggaaacaggcattgacttctcctctccagctatgaaagtcctagatggcatcttcttccaatagaaggctgttttgcttgcattgaaaatctgttgtttagtgtggtcaccttcatcaatgatcttagcaagatcttctggataacttgctgcagcttctatgtcatcacttgctgcttcaccttttttttaattttttttttgacgtttcactcttgttgcctaggctggagtgcaatgctgtgatctcagctcactgcaacctctgcctcccaggttcaagcaattctcctgtctcagccttctaagtagctgggatcataggcgtccaccactacttctggctaatttttggtattttcagtagagacggggtttcaccatgcctggtggccaggctggtttcaaactcctgacctcaggtgatctgcccgcctcggcctcccaaagcgctggaattacaggcatgagccaccacaccaggcccaccttgcatttttatgtgatggggacagctttttttccataagcctcatgaaccatcctctgctagcttcaaccttttcttctgcagcttcttcacctctttcagccttcattgtattgaagagagttagtgtcttgctctggattaggatttggcttaaggcagcatggctggtttgatcttctatccagaccacttacgctttctccatatcagcgataagcctatttcactttcctgttcatgtgttcactggaggagcacttttaactactttcaagaacttttcctttgcattcacaagttggctgtttggtgcaataggcctagctttcagcctgtcttggcttttgacatgccttctactaagcttgatcattttcagcttttgatttaaagtgacagatgtgtgactcctttcacttgaacacttagaggccattgtagggttattatggacctaattttaatattgttgtgtctcaaagaacagtgaggcttgagaagagggagagagatgggagaacagctggtcagtggagcagtcagaacatacgaaacctttatcaattaaatttgccatcttatatgggcatggtaccccaaacagttataatagtaacatcaaagatcaccgatcatatgtcatatgtcaccatacagacataacgatgaaaaagttgaaaatattgtgagaattaccaaaatttaacagagacaggaagcgagcacatgctcttgatacaattgcttgacacagggttatcacaaactttcaatttgtaaaaaatgcaatgtctgggaagtgcgataaaatgaggtatgcctttactgactttaattttagtaaatgacttcataaggaaaaggaaaaaatgtcattgtgagggcactgtgtttgttatagactagctaggtcatcaactgggtggttttgatactagcagagtcctccatgtgctaggacactgtttgaaattcttgttatagctttaaaagtcatggttttatcaactaactccctattagttactgtaattgaatttttatgttagcttccactagtagcaagtttttgagtcaagatggcccttgggttttattgccaaccctgacagcagaatcctagacagggtcgctttgctcttaaagcctctgatgtccagttgcaaagtgagtataattgcttctctctcagatctgtgttgaggagctcaagaaataacgaatgtggaagcactcagatcaattactttttttgtttgtttctaccttatctagtttcctaggtcaaaagtttgcttggctaatggaagaaaggagtcccaacctttccaagtgggacagattccctagctgtgctctgtatattgaatctgcttcttatcatttggctgtggtctgtgtgagtgctgaaaaggaggagataatttcacgcactagggaaatggaaaagactcctgcttggcaggcaccagggtggcaagagaatccaggatgtggccacgcacagcttaaagactacatttcccagctgcctttgcaggtgaatgccatcagtgagacctaattgagagtatagtctggggagtctgggaatgttgcctaagaaaggctgatttagttggtggtgcaactccctttttacctcccctctttctctctttctggaatgtggatatgatggcagaaccacagatgatcttgaatgaggaggtcacttgctgaggatggtgcaacagaaagatggaaggagctcaatccctgatgagcttgtggacctactgtatcagtcctggattactcactttctgtcttttatggagagaataaaccatcctctttttaagttgctcttccccctttgtttgtgatccctcttaccatagaccaaacttaattcctaatgaatagatctgccaaattgtttatatcagagatgacaacaggaacacatctgtttacattttcctttctcctgaagccccacctagtcccagagggtggtgtgtttcttcactgctattttgggcagaagctacccggctgtggtggttaaagtcagcactgctgttagcccttgtggggcctttgtgcaaattgaaaaaaggcattcatatcctaagacaccttcctgttctttgccagaaaaatgtctcaatgcaaattgacaatgtgtggacaggaatggaacatgcccttgagaagcagcccctgcacaggatgccactgctcagctttgggtcaatgtccaggccagtatctgacctcgaacttctctctaggtcttccacctttacttagcacaggcctcagaacagtccagccaggggtctaggagagaaagtggctgagactgtgtgagatggggatggggcagaggacggatagggtagagggtggattacagtgagtttctggctattgactgctttcacatgagcagctcatttctgtgccaaccatttgactagtaagttggcagaagccctgcctgttggtcacattctggcccatgctacaaggccacctggcaggctcaggctgcagcacggcaggctgtgtgcacacggctatctcccctagtctgtccccagagctgtctgtgcagtcctgagctcccatgtaagccaatgctacttttgtgtgaagaaggtggacgaaatcatcagcaactcttgcttatatagaatgtgacccaagcaatggaaagagaaaatccaggtcttggttttgtactggcttgcgagaagtccttcttttcctctctagcaatttccctacatccatccctgcctacccacattggattaaagggaagagagaaaaatgccctaagccccagagagaaaggtggcagaaccatgatattgctgctcttgactttgtaagatggccaacatcagcccagagaaatctgatctgaaatagaatgagctcacctgacttcgaaatttaccacatttgtcatgaggcagtcacttaacctaaaaagtaaacaggctcttactctgtcatagtttacatttgtgtgtgtgtgtccttttctgttttctttctttctttctctttctttctttcttttctttctttcttctttctttctttttagtagctttaacttgttctgcaaacaaagaatatgacagaacaatgtacgttcctttgaaatggcaccattaatcttgatagcaagtttctaattatgaaggatagagagctttggctgcttcatggaactgtgtcctggtgacttttttcagtccctttttcttgctttccctgtctccggtagcttccttgagagctgtggtttctcagtgttagatattcaaaagcacagcagcctacaggccatggctaaatcttctttacaaccagatgcatatgagatcttagcaggaagtaagaaaagtaaacgcattattaataaacacacttaaatgcatacaataaaatgaatgctgtttccttcaaagtaaccctcctttgcagatatagtctaaccaagcctctattgccctgcccagcatggatctgaaactctcctccgtaaattctctagaactctaggaccgccccttctaaatgcccaaaagaatcccaactgactgagggcaaagatgcaccttatttctggctccctttcgcttcaccacttgacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagtgctttgtaaatactttgattggtagaggaaaaaggaattgcatattgaaagaactgtatttccattaaaatgcatgtgtgtaaagtaaagaagggcaggaaacattgagcccaagactttctgagtttgagtgaaccaacctgctggagtggtttctggccatcactttgtgctgccatgtctcagcctgtgctaagtccagaggatctggggttccgatatttgcaagaaaaagcaaggacaacaggtttgaagtcaagcaatgggagggtctcccagagacctggagcagggaggatgagtgccttagctgcttctgtctatccatcttccatctgtctggcaatcaggatattttctggggcccattcaatgcttctctgttggctgggggctcccatcagctgccaggggttccacctgttttcagtggtccatgtgcagtactcagagaaatgcctcctgagggaatgagtccagcgggtgagcgccttttaagaaatgcggtggctcacacctgtaatccagcactttgggaggccaaggcaggcagatcaccagaggtcaggagtttcaaaccagcctggtcaacatggtgaaaccccatctctactaaaaatacaaaaaatagctgggtgtggtggtgggcacctgtaatcccagctaatcaggaggctgaggtaggagaatcgcttgaacctgggaggcggaggctgcagtgacccaagattgtgccactgcacttcagcctgggcgacagagcgagactccatttcaaaaaacaaggagtatgaaaatgctttccagctctttgcagtagggcctgtctcatggggtgcagcctggaacttgcgcaggcccctacacagaaggacctgtgcttggcccaatgctctgctcctgctgtcttgtcatacttaatactttttttagcaagaggccctgaatgccatttgcattaggcaaattctatagctgatcctgatgaggctcttctgtatggggacctgcacaactgcaggactgcaccctatgacgcaggccctattgcaaatggctggaaagcgtttttgtatttcttaaagggtgttcactccctggattcagtcgcccccaaaataacgtcttgggtgtcttatttaggtggcacctgcttggtctgaaagagctcatgtgacttcaggaaatactgaatttgttctgagaaagcctcttgccctaaaaaaaagtgtatggggggagtgctcctagtctgtcatagttaaagttcaaaggttatttacagtgtgttgcatccactgtggtgactcctggcagatcctgaacttaagcagacgtgtgttacagatcttaatgagtgtgttgatgccgatgggagttgccctggatcacaccaagtgggtgatgggtgggtgagaggagagacattctttttgttaacccctcatttccacggtcagtctcagatggtcattacaaacctcttctaaatctggacctcaacaagcccccctcacaccagggacaaagtaagggtcatgcgatggcctctgagctgaccttcgagttcagagtggccgtgtgctggtgctgtgatcattaaactgactgctttgcaaggtcagcactcaaggctatagatttatatctctcttttattctaaaactagactatgccacaaccaggtgactgtggtgcctcactcaggtggtctgtcttctgcagttgaaggcaggtctttttcctccatccattcagattgaatccagggggtcctccctggaagacctgtgttccacagaagactcccctggagcttctcctctctgcacctcagctttcttgtgggtgcagcaggccacccaggcccagtccctgctcacgacaatgacttcagctttccagggtctttctcatgcattcccaaccattagactccccagtcctctctctattttttccccttatttagtaaatatttattgaagatccattacttgcacaaaagacagcaggccgcagggaaaggggtttatagtgggagatacgatgaaaagatgattaagattgcaagttctcaaaagtttagatgttgaagtattattttccaaagtgagttacacagggtattaatgggtaccgctcaaagaaagggttctagagtgaatatgaaacattggcttaaacaaagttaaacattttaaattactgcacagcttctcaaaagttttaatatgctaatgtgtcatctaacttcccaaaaggagaaacataatatattggacttcttaaaagtatttatgacattttttcttgcattgaactagtcccagatagaagacttagccttaaagggcaaaataaaaagatgagttctttttctttttaactgacaaataaaaattgtatacatttatggcttataatatgatgttttgcaatatgtatactttgtaggatggctaaactgagctactaacatgtgcatcacctcctatttttttgtgtggtgagaacacttaaaatctactctcagtgattctcaaaatacaatacattattaactatagtcagcatgttgtacaatagatctcttgaatttattcctcctgtctaactgaacttctgtatcctttcaccaatatctccccaaccttccccatacccctgactccagcgcctgctatcaccactctacgttctacttctgagtttgactttttataatagattccacatatgaatgagatcatgcagtatttgtcttccgtgcctggctcatttcacttagcataatgtcttcaaatgtcctcagggtctgcccctctttctgcctctgtgggggctccaagtgggaattcgtggttactgtaattggcagggggcggagatttggagctggaacctctagagtctgagctctaccatggaaaggccgtataatgctcagcaagtcatttaactctttggtgtctctgttttctcattgataaatgcaaagataatagtgcaccttcactgagcttcactgggttagccaggtaaaaagccttatggggcaatgcctggctctggcaggcttgaatgctggccgctggctctggttctcccatgtggaaacaaagcctacgtctcacacccagcagcaggagcagcggggtctcggcccagccagtgtgtcctgagtggcacagggtcagacataaccaggtccatgaacatttgtgtctttgtataaggtcagacttttattgatgcaatttcaatcataaaagccactagctgcatggagttcccaaggaggtgattttctttagtgctacctgtttacttggtagttaaagcctcaggcgcactttacaaatcagtcagtattgcaaacaagacatagtagtacacttaatcaatatacaattgctatagattaaaccttctacatcagtaaacattcataaagtaatatttaacattaagagaaagggggataggataaacgggttaatgaaccagtccaagagggtaacatgaacaaggagaatgtcctggtctgatctggatggacatcaacattttgtaagaaagagactatcgtggcagatgctgggtgctggtcatgagtaacagcaggatggggtctatgaagacggccatctggagctggtgaattcttcctctttttatagcccccgagtcctctggtgaggactgataaagtgaaccttatctgattgggtatagtcactgttgattagacaaacatctggctcctgttggcatgatgtcttttaaaaatgtaagatggagtctttttctaagatggagtcacttaggtcaaaggtcctgtgtccacaggggctgcccacatttcaccacaagttgccatgagactgcccaggaggacccgaatgcctggagtgctccagccatgctcatgccacggcttttgtccctctgcctgtctttggacacctctggtgtggagttggagatgaggaggagaggcttgcattcctatcagcagtgtggaatgagcagaggtgcgggtagactgaagctctgtgtttaacctctgtttacagaatatggacgctgagagagagtctggggtacttaaggaaaggcttgattggattgcagaaaacagtttctgaaacagactatttctgaagactcaaattttaattcttttgaatttatacagcaactcatctcacaaataattattaaatgataataacaataataatgatactcttcctcctcctattatcaccaaatagcatttactgggtgttggcaaaatgctgggcattggtcaggaatgctggacttgtatttccacttgacccttcaaaaatccttgtgatcaataaattactatgttatataattaaaatattaaaattattggaaattttatttaataatagcaataatatattagtgtaaatacttttctgaataatgaaatatacaataatatattatgcacaaacacaaatgtgttaagtaaacacatcagagcttgttgccagccatgatataatgtgtattatcatatgctataccgacatccccatttgacattggaggatatgagctctgggttgctaagtgacatttcccaggttacagctctctggaggaggcagctggactccaggaccccgtgtttcctgagacctccatagcctgcctcccgctttgctgtgctgcttctatgagaagataaagtaatttaatagcagctgtcgatatgcagggccacctctcaagtgcttgaaaatagttctcttaagcgggaaatactttttttttttcccaaaataatttattatgtttcaaaagtatttcctctaattgcagggaatccaaatcaagcgcttgcatttcttataaacaaacacctctgtatactttcccctgaccatggctgacttcaaaaccaggccggcctgcaccagagcctcagagccagagaccgccccaggcagaaccacagactatgcagggcacctctgttcacctctgcacccatctccctgaagtgccgggcttggcttcccggcaacatccttcatttcaacagctaaatacgcggtcaacaatgggttggtgaaaatgggggcgcccaggagccattccatgccttcagatggggtccgggctcactgtgcaatgcatcatttcacacaggttaaaaggaaaagcagttgccagtgcctgttgttcatttaaggagattaaaatgatagaaaaagaggattttgcatttagacagtgagcagtggaatttaaaaagcagtgccagaaatcatttagtatgtgttacattctattcttttttttttttttccagacagagtctcactctgtcatccaggctggagtgcagtggcatcatcttggctcactgcaacctctgcctccctcaagttcaagtgattctcctgcctaagcctcccgagtagctgggattacaggcacccgtcaccaagcccagctaatttttgtatttttactagagacgaggtttcgccgtttggccaggctggtcttgaactcctgacctcaggtgatccgcctgcctcggcctcccaaagtgctgggattataggcgtgagccactgtgcctggccttagtatgtgttacattaaaaaaatcactccataaagatgtacaattattatgtattaataaaaaatgaaaataaaaagaccgtgtaaactgccacgtattcccactggagagctggtgagtctctccgtggatcgtaccattaccacaagagtcctctggcccacgcacaccctgctctgcccatcagcagtgctccccctcctctccgccattggcttctcatatcctcctgggctgatgtgcccatgctgtgtactcaacactgcctctggctggtgcaagcctggaagggaggtagacggtatggatggctaagcaggcgagctgggctggctgtggcctcggctgtctatcacgctgctacccagcctcggattcaggtcgaacttgcctgcactttctgaacacctagaaagatgcagcccgggcccagacagttcacttctcactcagcaaatgggaaaaaaaaatggagaaggcgctgcgtcctttgaggctcctgccctccagccaccttatctactgtgtctctctgggctcaaatggcgctttcctccagggctctcttggcgtctcatccctctacctccacagggtgtggtaccttcctttgttcctgtggttcccactgcacagctggatctctgttctcactgcctgaaattaacattcctgttcccgtttctcttgccttcctgacttccaggaggtggtggcagttactcagctctgcttccacaccctcgccatgtcttcctcaatagactcaaccctttgtcctgctagttgctagtactcaggtcacaggcagtggaactcgtcttcggcatttagtaagagatggcctttctgactttgtgccccagccacggtgcagtcttctggatctttcccagcagcgtcgacaccgtgagtgctgcctgtgcacgcattcgttgcattcttgctccagatggcagtctgaccagcacgactcaactcccctcccctcctgtccctttctagtaaaattgcctgtatgttaccccaacctctgctgactcacaggtgactgctgtcctgatttttaaccccgcagaataattttgtctgtttttgagattcacataaatggaattgtatagtacacactatttggtgcctagtggcttgaatttagtacagtgttttagaaacacatccctgctgttttgtctgtcagtagtttatttgtttgctgggtgatgttccattgtataattatcctataatttctttattcattctcctgttgttgtgcccttgtttatttccagtttttggctactgtgggagacagcatgtgtagcagtggcgctagctaggcttggacattagtctctctccagaacttgggacaggccattaaggacaggactggtgaatgtgacccagagcttgctgaccctcagctgcctgggacagcagtggcagtctgaccctgggggagtcagaggagggccacgtggtgaccgttacaccccaggagatacggactcaatgagcaaacccctgtggacaggggtcaaggaatctccctcctaaggaaatacagggttttgtgattttctttggttcaatgtcaagagaatcaagttgtgggaaatgctggaaccctcctcaactcagtgcactgagtccctgaatgctcactaaaggagacaggaaaggtggagtgcaggcctgcacagcagctactgggctctggatcagggagggcatcgtacaatatccaaggagagagcaacggaaggaaacaccagttaattcatttaaatctcacaataacatgtcatctctatttcatagatttgaaagctgaggttcagatatgttaaataatttgtccaggggtagcagctagtgtcagagccgcttcttaataactggccacagaactagataattctccaaagataaaatgcaaactaagtgactagtagaaaacattgattatatattagttttatgccaaatgctattcttgccagggtattacagttaaaaagacagacagaaattcttgccttgatggtgccccaggatgagatgaatgatgaacaaagtgaacacatagagtattctagaaggtggtctatggagaaaaataaaacagagaagaaacaggggttgtggtttcaggggtatttgcaagagtaaatatcttgaccaggaaaagcctatgagaaagtggcatttgaggacagacttgaaagagatgagagcatgaccctggggtgggattgagcattaaaggtgaggaaatggccgtgcaaaggccctgtgacagcagtgtgccaaggctgagaaaatgcagagagggcagggtgacttaagtgactgagtgagggggagtcataggagctggcgtcagaggggggtttctggggatgagctcaggtggacctcacaggccatggtgaggaatgactctttgctgagtaaggtgggaaaccatggagggtttggaacaggggagtcacatgccctgagttgcgtttaacaggatcgctctggctgcccagttgacaacagataattgtgggacagaaacatgaagacccttaggacattattgcaataattcaagcaataattcagatggtgactttgaccagagtggctgttccacacgtggtgaaaagtggtcacaataaggttcaattgggaaagtgggacccaaagatttgctcacggataggatgagggatgtgaaagaattgattctgactccaaggatggtgacattgctattcaccgaggtggggcaggtgacaggaaagcagctttgcagggaagaacaggaactcatttttggatacttcacactgggaaatgccaaggaaagctgttagacagctggatatctgcatgtggagttgagggaggggtccagctcggaaatataagcatgggcgtcatcagcgtacagactgtatttcaaacatgagagtggatggggttatctagggagtgcctctgacattctgaggttgggctagacccaggggaggagacagtagaggggcatccagtgaggggagaggaaagcaggaaagcagcggtggactggagggggtgtctggctgtgtcacagcagctcttaggtcaggtgatctgggggcttggcaatttggagctcatttgagggagattttgcagcaaaagcctgagtgggttgggttcaagagaattggggactgtggacacagacaactgcaaagggttgggtggagaggatgtaggccaaaagaggctctgtccagcctgaccaacatggagaaaccccatctctactaaaaatacaaaattagccgggagtggatgtgcatgcatgtaatcccagctactcaggtggctgaggcaggagaatcttttgaacccgggggtgcggaggttgcagtgagccgagattgtgccattgcactccagcctgggcaacaagaacgaaactccgtctcaaaaaaaaaaaaaaaaaaaaagggaaagaaaagaggcttcttctaactctttttcatggcagatttcaaacatatacaaacacaggatgaaagaacaaaatgcttgtgtctccaccacccacttcaacaatgatcttgaccaatcctgctccatctataccattccttcccttgcaaaccccaaacatgtatattaaattaattgatattgccccacctgcaaaccccaaacatgtatattaaattaattgatattgctccacagctcactgaggccccacagctcactgagaccctgtaaaagttttttgtttttttttttttttgagttcttctcccctctatgcttcatttgggataggtgccatggggctgccttctagtttgctgatcttttcttctccagcatctaatgtaccattcatcttatccagtgaactttccatttctgatattttacttttcatttctagaatttcatttgtttggtttttgtatcttccatttctttgcttgtcatgtttatgccttcctttttggtggctcacgcctgtaatcccagcactttgggaggccgaagcgggtgaatcatctgtggtcaggagttcgagaccagcctggccaacatggtgaaaccccttttctaccaaaaatacaaaaaattagctgggcgtggtagtgcatgcctgtaatcccagctacttgggaggctgaggcaggagaatgacttgaacctggtaggcagaggttgcagtgagctgagatcgtaccattgcactctggcttggacaacaagagcaaagctccacctcaaaaaagaaaaaaaaaaaggaaaaagaaaatatttgtaagattaaaaataactgttttaagattcttatcagatagtttcatcatcattgtaatttctattgactatcttttttaaaaatccagtttatgggttatggttttcttgcttctttgtatgcctggcagttttttattagatgctctatatagcgcacttttcattgttgagggctagattttgttgcatttccataaagagtgttggattttcttttggaacacacttaagttgcttgggatcaggttgaccacttcaaagcttacttttatgttttatggcaggcccagagcagcatttagtttgggactaatttagccctactgcagcaatgtccacaactagggcatggcatggatggagtggcccatgcagagtagggaggggcaaggcacgttcaagagctgagaggccattataggaaagatcatcttgtgactattaaagtggccaaggtactaaatctgtttgtccttccttccttccttccttccttcgtccttccttctttccttccctccctccttccctccttcctttcttccctccttccctccttcctccctcccttccttccctccctccctccttccctccttccttcattccttccctcccttcctttctttcctccctccttccctccctccattcttccctccttccctccctccctccctctctccttccctccctccctcccttccttccttccttccctccttcctatctccttccctccctccttctttccttccttcctttctgaaagttgggaaaataaagaactaaattccgtgcatgatcctagattggatcctgaattgggggtgaggtcctataaaagatattattagaacaatttgatgaaatttaaatttgtacagtatattaaataataatacataaataataaatttcctgaattgggccaggtgtggtcgctcatgcctgtaatctcagcactttgggaagctgaggcaagtggatcacttgaggccaggagtttgagaccaggctggccaacatggtgaaccccatctctactaaaaatacaacaattagccaggcatggtggcgggtgcctgtaatcccagctatttgggaggctgaggcactaagaattgcttgaacccaggagacagaggttgcagtgagcagagatcatgccactgcactccagcctgaatgacagagtgagactctgtctcaaaaataaaaaaaaaaaccataaaaatgaataaattttccaaatttgatcagtgtattgtgattatataagcgaattccttgttcttaggaagtacatatgctgaagtattgagatgcaaagggtcaatttactctcaaatggttcaacgacataaagagagaaaaaagaaaaaagagaaagagcacaaatgtgataaaatgtgaacaaagaatgaatcattgttgtactataattcccgggatcccaggaatatgtactcactaggacagtcatttgtcacgttgcttaggaagcaggtttggagtcttgtgtggggaattcgtcgacaccaccagtcccgagtttatgtgcagtggaaaatggagcagtgtggtcagcagtaggagagccagcttccaccctccacctgctgttccacgtggtgggtctgcacagcctggcttgtgagcaaatccatttttccttctctttgggaccaacatgggcttagagatgacatagccttgggcatccaataaattcaaatttgagaatctcaatgattcaaaattgctgctgtcaattaatacatgatgaattcatgttgttttgaaaaaagaatgattgaggtgaccaacagaagacttcaatgtttgtccccaagtaggtaggccaccccagatttccaaccctgggtgcattgcattggcaatctaaatcccaaggactgtgaactctgtggtcattctgcagtttcctctgagagtattcatgggttggggaatctcctgctgaaaaggatattgggtaaaattgctttatgtgagcactagtaaacatttagcatatattaccaagaaaagcaacactgtaagcccaggaagcttagagcttctcaaacagaaggggatgatggagaaaaaaggtgaaaagtctggcaggcaggatgaaggtcaatcaaaaaagggcagctggccacagggaaatatcatttcacccctactagcgtgactgaaaaaaatgtatgttggtgaggatatagagacattgctgatgtcattttaaaatggcatagctactttggaaaacagtctagcaattccttgaaaagttaaatgtagagtttccatatgacccagcaattccactcctaggtatatactcaagtgaaataaaaacacatgcccccgcaaaaacaaaacttgtacacgaatgttcattgcagcatttttcatgatagcccaaagtggaaacaacccaagtgtctacaaactgatgaacgaataaataaaatgcggcatattcataccaagaactatcctttggcaagacaaagaaatgaaatactgataaatgggacaattggggtaagctttgaaaatgtgctgagtgaaaaaaagccagacacaaaaggccacatattgtatgactctgtttatctgaaacatccagaacaggcaaatctgtagagacagaaagtagattagttgtggcagggctagaaggagagggatttagggagtgatgacttatgggtgtggtgttttctttttggggtggtgaaaatgttctgaaattagatagtagtgatggttgtacaactctgtgaatatactgaaactaactgaattgtacgttctagaaggatgaattttatggcatatgcatggcacctaaaaaaaccaaaagagggcagctgtgtatcctgggtttttccttgcttcttgtatgtgtgtttctgcagtccggttgagcagctatgcctcaaccctcgggtctatcctggtcttgaatgttcctgactgttgtcttcagtcttggaaccacacagcaccacagcacagcctgcaagccttcctgggaagatttacacctctaggctgagtctctgctactgcactttctcctccctctcaaatgaaaccgcagtgcctctctgtgtgaccttctcagtcatgcaatgacttctctttcatttcctataagcctctgagctctgccttctccttgccaattccccttagctccatcttcctttggccgtccgccgttgtgtaaatctgtagggaaatgtcattcaaagacaaaacccactgcttattcttctttcttaattgctccttgggaaatgtttgcttctgtgttcttggtgaaggaaagcttaattttgtctgcttttatatcactagtcttttcagattacacattcccaatcaatcacctcttgaatcaagtaattagttttattgtatcagtctatccttcagaatttcattatgcaaatataaacatgcataaatacattcatgtttccccgccttttacacaaaaggaggcacactgttttgtgccttgctttcgtttcacttactatgtctgagaacttttcacatcattatatggagagcttcccctttctttatcagctgtgtgagagtccagtgtcaagatggactgtgtttggtttcatcagtctctgtggaaggatcctggctgacctgtgtcttttgcttttacaaaccttgctggatgatctcacaatcaccttgttgcatgcacacgtaggcagagctgtagaatagactcccagtggggcagttgctgggcaaagggtaaatctctttataattttggcacatattgccagagtgccttctacagggttctatcaactgctgggcactcctgtcagcagtaagagtggctgcttctcccagcctttccagtaaaatatgttaccaacatttgaagccaggtgcagttgctcatgcctgtaatcccagcaactttgttactaacatttgggatttccgcaatggtgtgtgctaataaatgtttaacaaccacttctccaaacaaaacgaaacaaaacaaaacccaaaaccaaaaaaacaagaagccctaattgtagtatctgctgatttccatagcataaatacttctacccaggccaattgcaagctatcaacatgatgtccctgaacacggagttgggaagagatgggccgtagcacccactgtatagtatttctaccacacagatgcaagagatgcaagtagcatggataattgtgaaatgtggtaaaataataaggaatttaagagtttttatttcctttgtatttgtatgatttatttagttataaatttatataattaaatcttagcaacaatctgcatttaacaacctactcataaaaccagctcctaaaaatctggtaattattcatggtcaactgtcaagagtcagctccagcacactactgcaatgctgccaatttgaaaggtagcgaatgccatcccaatgtagttgtcatttttattgttattgttttacttgtttaaggacgatttgcatttccttttctgtgaaatatgtttctgtccttcgcacatttatctactgagttttattctcttgttgatttctaggagatccttatacatgaagctccttctgcatatcttttgtctgtgttataaactgcagtgttttttcccggtttgttatttatcttttgtgcttgcccatggcatttttctttttttctttttctttttttgccatgaagttgttgttgttattgtttcaaaatatagttgaattatttttttcattttttctggtttttttttttttttttttgacacggagtctcattctgtcacccagactggagtgcagtggcatgctatctcggcttaccacaacctccacctcccaggttcaagcgattctcctgcctcagcctcccgagtagctgggattacaggtgtgtgccaccatgcccagcttattttttttttgttttgtatttttagtagagatgggggtttcaccatgttggccaggctggtctcgaactcctgacctcaagtgattttcctgccttgacctcccaaagtgctgggattacaggtgtgagccactgtgcccagcccattttttcttttatggcgtccaaatgttgaataactaggaacaacaggattaaatacattttttttctaatcacaatcaagtttcacatacttaagcaagtttcttatactctaagcagtctgtacaattcctgtatctccttggagttcattatattcaattttgtctttttcttttgagtcagattattatttaaaaaccctctctacttaatggtatcacaaatatgcataatatgttagagacaggcctggcacacttcagctaaaaagaagtatgcatagaggttataaaatatttatcaagataccatcactagttcagtggtggctaaccccaccacttttctgtgactagtattatttcctactggggagtttcttcacttgtgtttgacttcccatgtgggcattgtcttagtaattttgtgttgctgtaacagaatagcacagactaggtaatttataatgaatagatatttgtttgacttatggttctggaggctgggaagtccaatattgaggtactgcatcagataagggaagctctcatatggcaagaaagtttacaggggagagaaagagagggctgaccttgcttttataacaaatccactctcaaggtaaagaatccactccctcaacaatgacattaatccattcccgatggcagagccctcatgaaataataattgcttaaagatcctatttctcaacacagttgcactgggaaacaagttcccaatgcatgaactttggggaacacattcaaagcatagtaggcatgtactggcttagtcctgcattgctctctccatcagacttcaaggcccaaagctctaagaatgatgctggagtgtggtttgtgttcaagaaatattagttgagacaccacattcaaaggtatgaacccctcagatagactttcatctgcatctccaccatccctgacaatgcccattaacatttagtcagcagccacacatttccagcattacttgagaagctgtgcatgtggtctatgtggtgtagcctcagaatacggtcatgcagaaagttctaactcagtgtatctaaaagccacttgaccacttagagtgagcttttatttctagcatctcatttttggttctgactttagaaatgtgaaaaccagatctcaggtatgatatgtaatttacccaaagttacctcattgctactttggcttttagtagtgcgtctggcacatagtaagtcctcaataaaatgaagagcatttgagatgacatgattttcccatttcccagtccagggctcatgtcactgtcctattacaggtatgacccaagatggtggtggctggatagtttccttccaaggtactctttaaggggtagacatgaaaggcagtgatcactcatgccaacaccctatgcttgtaacctgatctccccctggctggtaggccttattctgtcaagatttacccttagaaaagcatatgataagtataacaactacaaaatattgagggcatattatataccagttaatgtgctatgtgtccaatcctcatccaaccctgtctggtgttaatattattactgtcattttataggggtgcagagaggttataggactagtccaagaccagacagaggcaacagtagagccaggtggaaattcaggtctgtcatggtcacaatgctctttgtccgtggggcatggagttgcccaatatattattgttttacagtctttagacacagtgtcttcgcttgacaggaggcacgttcctttatgttgtaggaaatgcactgaacctgaataactctacaggagagctctcatccccccttccaggtcgtccctgctctcagcctgcacctcccattttttgatcaagacagccttgaagttctttatgtctgtggaaggaaggagacggagcttgtttttcacttttgctgccatgattaattatttttaggaaagcattgtgtcttttgagagaggattgtaagtgctgggagaataaatggatcttagagtgagccttgtgtgctccagacttccccagcttgataaacagcttcctgaccagtggctgccagtccctggtctcactggacggacattggctgggggccaatgtctgagttgaatggcgaggactggacagtgcttcttcccagccagtgtggcaatgagcccactcttaagaaggcgccttggcttgggaaaacacattgcacattagatgttggtatccgcggcagggacctgaggctggagtcactgccaggcaccttctgggaggcctggctttccagcaaggcctgcttcacattctcaggagaaccagacccagcataggaaatgccctattgcccaagaggaaaccccatgtcgaggaactgatataattaggatactgataaaaattagaatgagaaggggagggcctaaatgaagggtcatggggtgtactttttaaaaaaaacaaacaaacaaacaaaaaaaacaaaccttcctgcccttctctgcatatgaatatactacatgcttatccaagaaaactttgaaaagtaaataaaaatttcttccaataatttcacccagaaatttaacttctactatttttaaaggagtgtcttttgtatgccaaacttctcctatttttaaataatatatcatgaaaatcattttattttgtaaattggacctcaggtgtatgaaactgggttaattgtgacctatgattcatagtgcatgtattagtccattttcatgctgctgataaagtcatacctgagactgggaagaaaaagaggtttaattggacttacagttccacatggctgggaaggcctcagaatcatggggggaggcaaaaggcacttcttacatggtggcagcaaaagaaaatgaggaaaaagcaaaagtggaagcccctgataaacccatcagatctcatgagacttattaactatcacgagaatagcatgggaaagaccggctcccatgattcaaatacctccctgctaggtccctccctcagcatgtgggaattctagaagatacaattcaagttgagatttgggtggggacacagccaaactgtatcattctgcccctggcccctcccaaatctcatgtcctcacatttcaaaatgaatcatgccttcccaacagctccccaaagtcttaactcatttcagcattaacccaaaggccacagatcaaagtctcatctgagacaaggcaagtcccttctgcctataagcctgtaaaatcaaaagcaagctagttacttcctagatacaatgggggtacaggtatctatgaaatgggagaaattggccaaaacaaaggggttacagggcccatgcaagcctgaaatccagttgggcagtcaaattctaaagctccaaaatgatcttctttgactccaggtctcacatccaggttatgctgatgcaagaggtgggttcccatggttttgggcagctccgccctgtgattttgcaaggtacagcctccctccaggctactttcacaggcttccattgagtatctgcagcttttccaggtgcatggtgccagctgtcagtggatctaccattctggggtctggaggacggtgaccctcttctcagagctccactaggcagtgctccagtaaagactctgtgtgggggatccagtcccacatttcccttctgcactgccctagcagaggttctccatgagcgccctgccactgcagcaaacttttgcctgaggatgcaggcatttccatacatcttaaagatctaggtggaggttcccaaacctcaattcttgacttctgtgcacccacaggctaaacaccacatggaaactgccaaggtttgggacttccaccctctgaagtcacagcccgagctgtatcttggcccctttcagccatggctggagtggctaggacacagtgcaccaagtccttaggctgcacacagcacagggaccctgggcccagcccaagaaaccactttttcctcctgggcctccaggcctgtgatggcaagaggggctgccatgaaggtgtctgacatggcctggagacattttccccaaggtcttggggattaacattaggcttcttgccgcttatgcaaatttctgcaggtggcttgaatttctccccagaaaatggatttttcttttctattgcacagtcaggctgcaaattttccaaacttttatgctgtgcttcgtttataaagctgaatgcctttaacagcaccaaagtcacctgctgaatgctttgctgcttaaaaatttcttctgccagataccctaaatcatctttgtcaggttcaaagttccacaaatctctaaggcggggcaaaatgccaccagtttctttgctaaaacacaacaagaatcacatttactccagttcccaaaaagttcctcatctctacctgagaccacctcagtctggaccttattgtccatatcactatcagcattttgggcaaagccattcaacaagctctaggaagttccaaactttcccacacattcctgtcttcttctgagccctccaaactattccaacctctgcctgttacccagttctaaagttgctcccacattttggggtgccttttcagcaatgccccactctactggtaccaatttactgtattagtccattttcacactgctgataaagacatacctgagactgggaagaaaaaaaggtttaattggacttacaattccacatggcttgggaggcctcagaatcaaggcaaaatgcacttcttacatggcagcggcaagagaaaatgaggaagatacaaaagcagaagctcctgagaaacctgtcagatcttgtgagacttactatcatgagaatagcatgggaaagaccagcccccatgattcaattacctccccctggggtccctcccacaacaagtgggaattctgggagagagaattcaagttgagatttgggtggggacacagccaaaccatatcagtgcactctcttcatttgaccatgcaatgcatgtttttaataataaacatctccatccaatatgaaaactcatactgtaactgtgatttataaaacctttggcccaatctttttcctacaactacacttctctttatctaccttttatttttactttttgcttacttgagcacatgctatacatgcccctttttatgcctctcaggaggtttacagtggtggaatttcatcactcagatagctttccactccacgccctttggatcccaaaatggactgcccatttatctctttctgtgtgaaggaagtcagggttaggagagtcatctgtatatgcctcctcgtttatctctgattctttagcaaaaccaccctgaaacccaggcagatgtcaagtcagcttgtccttgagggtctctgctaaaggagaggccccagtggccactgcagcctccataaatcgctgtggtcaagcatgcatcttgccatcagaccaaccaccacctgatatgtgaaattcacatttgttaattatttgctagaaatctaagaagctgttatttattgtcatgtagttgaaagcctctttccgcctcctccagaattcacttttctttctatctttcctctgatcattgtttttatcctttgactgttcttttgtagttcttttctttattcctgaatttatttaagttgcagatgaggattttggctatgtccacaccccagacttcaccaggaaggtaacttagggttccccaaaatccaaccaaactgttctcaaatgcaggaggagaactctccccttcccctctacccctgccccctcatttcttctcttacaggctttcctagctcttttccaccccatgccccttctgtctctccttccatcctggggtttgtggtagaggattacccagttgcggacgagtcacatgccttatccagtgaaaatattattgtcttatggatgccaagaacaactcctgaatgtacaaactatttttaatgctcatttgagattgatagatatcaggcaaataataaaagtttcacaagattgctacaaataaataattttgaaaacaaaaccaaccaaagcaaaaaacaaacaaacaaaaacaaccttttctgttgtgattagcatttttgctaaactcaccttgggcttttgactttccagacactctcattgcaggtgtttggagctcagttctgttcctccaggcttgtgcgctctccttgaccccaccttttgtgcgtgtgctgtccttgtctgaaaccagcctggagctccctatacagatgtgtcaaggtcaggccaggtcaaggctgagcacagagaaaggagctgctgtaggaggcccacaaggaattttgttggatctgtgagatcagtgtatgctccagcccctctgacatatccagaggagacagccttgagtttgggcccagtactgccacttattagctgtgtaaacttgaaaaagtcaattaattttgcataagtctagtgcaataagtaagagtcttcaagtcatcaccctgttgtgatggattacatgagatcaagcatgtaatgtgtcaccatgataactggcaaaaataagtgcttagtaaatgctgaccattcttcttcttaacaacatcatcatcatcatcatcatcatcatcatcatcaacaacaacaacactaggtgcaagcgccagccccggccaaggccaataggccctgtgtaggttgcgggctacctactcagtctggatgctggtttcctgttctcctgctcctgtctttgctcttgacctgttttcttcttgcctctgcaatggactctgctgctggttgtgccatctcctcaaggttggacccttggaagctgacgtatagctggtaccttccagctacctcttcaacacccctgcatagcttgaactcaggtgacctgctctgctccaggctccgagtcccccaggtgcattttcctgtccttgttcccaccatgggctcagacagtgagtgccttgaaggcaggaatagggggtcctcaacccattccctggcccctgacaagcagctggctgcaggatgtcctccactacttgttagtcaaatgcatgaaacattggatgaaggcaagaaggtgagatagccaggtgtggtggctcactcgtgtaatctcaacactttgtgaggctgaggcaggtggattgcttgagcccaggagtttgagaccagcctcggcaatgtggcaaaaccctgtctctacaaaaaaaatttaaaaattagccaggcatagtggtgtatgcctatagtcccagctacttgggaggctgaggttgggggattgcttgagcctgggaagcagaggttacggtgagctgagatctcaccactgctcttcagcctgggcgacaaaaaagagaatgtctcaataaataaataaataaataaataaattagttaattaattaataaaggagagataggaaccttctcctttgttgaatccaagtttagtaggatgttcctttcttttctctctctttctttttctctctttctctctctctctttctttcctttctttctttctttctccttccttccttccttccttccttccttccttccttccttccttccttttttctttctttcttgacaagatctcaccctatcatccaggctggagtacagtggtacaatcatagctcactgcagccttcagctcttgagcttaaactatcctcccacctcagctttccaagtacctgggactctaggagcaagtcaccatgcctggtggatgttcttttctattgaaagtctagagtaattcatggccaatacttaattttagcagctttgttccttttgaatgagccctcaagccaaaaacatatccatcttttaacagtttcatttatttcctttgaaatcacttcaactggattcaatgcaatgcatttgaacagatgtttacacagtgtgttgggcattgttatgggcacatgactgagaagagaatggtcaagtttcctgccctggacagaactaaaattttaccaggaagagagatgctgagcacctaactaataaatacacagggtaatttcatttttataagagtttccaaagcaattaccatcaccaccaaagaatcagggtagattactgggtctcgacaagtgtgtgtgtgtgtgcgcacacgtgcgtgcgcatgcatgtgtgtgtcttggggaagagataaggcctgaataaggagggacagctgtcctgtggagatctggagaagattattgtagtagaggaatggcaagttcaaaggcctggaagtggtagcagagtcattgtgtttcaggggcagaaaggaggccagcgtgcctgggtgccaagggaaggaggtgagggtgaggaggcggacaggcatctcaagtgcatggagagccacctcttcttgggtccccagtccagggcactttctttggacccaggatgtaggtactgacagctgccatgaatctcggagttgtcagcattcacagcaaagggcatttccaggctaaaatctaagtaaacaagctccagaacaaagaagacaccatgttcaaagtgtgtgaaaatggataacaaataggaaacatttaaaaacaagcactttgtggaaaaccatgtttccttgatgtgctttctgtcatggtatctgaaacactgcaaaaggacattgaagatctgggagggagagttgacaatcttcccaaataagatacagttatcttatttcaaataaaaaggaagcaaaattggcacaagtttgggtcaaatttctcctgtgccaagtctagaatcagcaggtagtgctgaaatcactgtcccacatcccagacatagtgagcattcttttaaggctccaggctcaagtgtgtgcaaacagagggaaattacacttgaaaaaaaagatcaaggaccgtgaattagatacaaccttggacaacaaaagcagcaaccatgaaaggttgtatgtacttaagaagtcaaacacttctgggaaagctgtggggaagagagttggtatatgggaaaaaagtggtaaactcaaaacgccttttgtatggagaaaggcattggccagctttaaaggcactgcagcatcagttgagcaagtgcttttaataaattactctcttttgtagctctgtactttttctgatatggataagctatctagcatccaaagcaaactcatcttaaaccaagaattcaaacaaatgataataaagatggtagaatgcctattccactccatttgaaagagatgcacaaaagaaaatggtaggtgttgcttgcaggagtgtgataatagtgttgctcttctaaactggcaactttatgagtagatcatcaaagccaaggtattttactttgtggaataagaaacgatcacaccgaaaataataaaattcagcactgcaggttttctgccctttataaatgtttttcaaagacggaaccgaaagaatagcttgagtgataacaagcttttcagaaggagctctggaaattaatatgggacaggtgatggagcaagactttcagcatgaagaagcccaggaactgggaaaacacaagtctttacttcagaatcaccccatagcctccaagtagtgtgttgcaggttgaatctagctgaaaatggcataaaacagaatattaatagctatatccacatatcactaaactaggtacattcttgatgttcctgaatataaggagattataaattaaaatgattctgaaaaactacagacattgatgcaagtttctagtttcaaccaggataatatcacatctcacctcaaacaaaaggcattttcttcagaaaggaactaaaaaaaaatggcctttattctatacttgcttatggttctggtttaaaaacaaaaacaggttccagaagactacttattcaaagaccctgccccacattcctcttgaggatcccagtgaatgtggcactgataatatgaatggtttaccttccgtgagattgcattgaggggggaaatattcttagaaataaaatttttaaaaagaaaatatgatgtaaattgaccaaggggtttaaaaaatctgtcaatctcatatcctatacctagcaaaaatatccttcagaaatgaatggaaaattaagacattctcagatagaagaaaaataagaaatttgtcaccagcattaaagaatgactaaagggatgtctctaaacagaaagtgaataataacaaagggaggctggaacttcaggaaggaaacaaaacaatgcaatggttaaaaattctcctcaagtgtttaaaaaattgtgttgaagcaaaaaaatataacatcatctggtgagatgttcagtgtctgtagtggaaatatttatttaacatatttgtattttaagggggagggtaaacagacctaaataaaagtcagatttctatacttcacttgaagaggtaaaatgctgatacagttagctatgacatattatgtatatatattgtaatatctagggaaattagtaaaaaactatatgatgaagagatatattaaaaatgtactatagatatgaatatatgtgtgggttagtatacatacatagttttccttactctgtcacctgagagaacaaagaagcaatgacaaccctctagcaattagcacaccggacacacagatcttggtttctaacaccattcaccaataaaacaaatcagggctccttggagaaatggctgattccaggccttgggggaaaaatatatgagatgaacctggagcattttgtagcaccagaatgtaaggaaatgtgtgtgtgtgtgtgtgtgtgtgtgtgtgtgtgtgtgtgaagagacacaggagccaaccaaaagagctctcaatggccaaacttggaataattggagcaagaaaataataaagtagtaatgtattatcacccaaaataaatatccatgagtccatagtgatataagtaaatacttgaataaataaatggggggaaaaaagacaactctctcttatgaagaactggaaatagttaatacagatactacaacctgaaggaggagaagtgtaagttcctggtccttaggtatgggcctacatagtgattttcttccaaagagtgtagaatagatagggggtgggggaaagtagatttacactggagacacctgccaagcactacttcagccaggtgatcatggtcaacacctgctgtgataaatcgtggtgtgagtatgtaccctggatatgatgtgatgaaaatgacacttcactgctttacccattacccttgtcgaatcatgaaaaaagcctcaggtgaatttcaataagggggtatcatagaatacattgaatataggataatacctaaccaggactcttcaaaattgtcaaggtcctaaaaatcaggaaaagtttgagaaactgtcacaaccaagaggagcctgaggagatgtgatgactaaacacagtaagtatcctggatgggaccctggaccataggaagatgttaggtaaaactaaggaaatctaaataagatatagactttggttaataataatgtatcaatattggctcattaattgaaacagtcgtgctaattaatataagatgttaataagatgggacactgagtgaggatgtatatgggaactttctgttctaccatctcattttttttaaacttataaaaaataaagtctattaaaacattatagcactttgggaggctgaggtgggtggatcatctgaggtcaagagtttgagatcagcctagccaacatggcgaaatgctgtctctactaaaaaaacaaaaattagctgggcatggtggcaagtgcctataatcacagctactcgggaggctgaggcaggagaatcacttgaatttggcgggatggaggttgcagtgaggtgagatcatgccacttcactccggcatgggggaaagagcgaaactccgttaaaaaaaaatcatgagtttaaacataaaacataaaaatatataatgtttagaaagaattcacaggagaaaatctttgggacctaaggctagacagaattcttagacatggcaccagcagcactatccataaagagagaagaaaaagtcaatatactatacttcgttgtaattaaaaacttttgtggtgtaaaagactcggtgaagaggatgaaaagacaaactgcagactgggagaaattattttcaaatccatatcttttttttgtttttttgagatggagtcttgctctgttgccaggctggagtgcattggcgcgatctcagctcactgcaacctccagctcccgggttcaagcgattctcctgccttagcctccagagtagctgggactccaggcccagctaatttttgtatttttagtagagacagggttttaccatgttggccaggatggtctcgatctcttgacctcgtgatccacctgcctcggcctcccaaagtactgggattccaggcgtaagccaccgtgcccggcctcaaatccatgtcttacaaagaccttatatctacaatacacaaaaatgtatcaaattcaacagtaaaaagacaagaagaaaaatgaagaatcccatcagaaaatgaggggaaaatatgcccatgaatttcaccaaaaagactatacagatggtaaagaagtgcaggaaaggatgttcgatatcactagcctttagggaaatgcacattaaaaccaccgtgagatattactacacacctatcagagttgctaaaattgaaaacaaattataacacaaaatgctggcaagtatgtggagaaactggatcacacctacattgctgggtagaacaaaaaatattatagtcattcagataacagtttggcagtttctttaaaaactaaatatgaaattgctgtttgacctggaaattgcattcctgtgcatttattgcggagaaatgaaaatgtatgttcacacaaaaacctgtacaagaatgtttatagcagctctattcataatagctaaaaactgaaaagatgcaagatgtcctttagtgggttaaaccatccacatcatggaatactactcagcaataaaaaggaaccaactattgatacacacaaaaccctggttaatcttgagaattacattaagtgaaaaaaagccagtcctcaaaagttacatactatgttactctatttatacaacattttaaaaaggacaaagttacaggaatgaagaacagattagtggttggtgggacagcagtgaagtggggtggttgcaaaagggccacatgagggatgcttgtggggatggaattgtttcatagcttgactttctttttgtttgtttgtttgttttttttagacggacggagtcttgctctgtcacccaggctggagtgcagtagtgcaatctcagctcactgcaacctccacctcccaggttcaagtgattctcctgccttaggcctcccgagtagctgggattacaggtgccactaccacgcctggctaatttgttgtatttttagtagagacggagttttaccatgttggccaggctggtctcaaactcctgacctccgttgatccacctgcctcagcctcccaaagtgcaaggattacaggcctgagccactgcacctggccaatagcttgtctttcaataatagtgttcttgctgtgatatcatactacagttttgtaagatattaccagtaggggaaatttggttaagagcatgtgatgtttctattatttcttacaactgcttatgaatctacagttacctcaaattaagtgtaatttaaaaaatactggaaaacaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactgttgctttgtttccttctggtttctgcatgatttccactgcgtctcttgtgttctgtttgtttgttttggagtttctcacattgagagatttttctcattgttgggtaaccatgactctatcttcctgtttaagaattaggggctgggcaccatcgctcaggcctgtaatcccagcactttgggaggctgaggcaggcagatcatctgaggtcaggagtttgcgccagcctggagggttggagaaactggctgttgcattagtccgttctcacactgctataaagaattaactgagactgggtaatttatgcagaaaagaggtttaattgactcagagttctggaggctgtacaggaagcatggctggtaggcctcaggaagcttacactcatggcagaagggcaaagggaaagcaagcacatcttcacgtggtggcaggagacagtgaaagaagaagcactacacacttttaaacaaccagatctcgtgaggactcactcactatcatgagaacagcaagggagaattctgcccccatgatccagtcacctcccaccaggtccctccctcagtgttggggattgcaattcaacatgagatttgggtggggacacacagccaaaccatagcagctgttacctcatgctcctaattttgtggaagatcagataacaacttagtttcagtttggtggaattgtagcatagataactctgttttgatttttagtctggttgttggggcgtagtgagggggcttagtgggggccctgtgtgttttatctggtgaccctccagtttctcagcgccatgcatttgcttgtcctggcctctgcagtcacctttgctggctgtggcattgtgagggtgtgaaggctgcagattcttagagggggcctattccaggctctcctgtgttcatgactgtcacatcccatcttgggcgaggccaggctagagtccacaggctccactcaggctctctttcccagaccccgacacctctgtcagcctcgttgtaggtcctcttttgattgctattgccttggacctggacagtttataaaccaagcttgccaagaggcaagagtgaagaggtctgttaaatagggaaagagcttggagtctcctgggccatgtgctcagtacacaagttcttacaggtgggtagtcctgtttgggatagttcagacacaccagagtagggagtgagggtcccatgctggccacctttcttcttcacctccctcttctcatgcctccctgccaccacccaacattttcagccttgagaaattccaagtaagccccttgctcagggctgggaatccagttggcagttcgggaggcggtggggtcagagttaccgcttctttccgggcctttccagaggttctgctgctcccccaatacgccttccattgtgctccagtgcgtccctccagcacattcccacagttagattcttctggggactgttgtaggcacatccctgaaattcccgagggatctccccctggctagtgtacttccttttctcaaggtatgtgggaacaggagctgtctgccgggattagcagcccacatgatttcccagtctcaggacctgtttcctgttgggagcccctgagctctgagacatgtggttgccaagtgcttgcagcgctgggtgtggtggagccccaggctgactctcctaggtggcagactcttgggggcgagctctccccagggcggggacaggctgggggtggcgggctcttgggggtgggcaggatctccttgggtgaggggtgtctctgggggtttggctctggggaaggggttctgaggagggggcagattctcctggggaggtgggctctgggggtggggagcaggttttcctgggtgggcctctcctgggaccaactctccctggccgcagtctctcttggccacgattctttcctccacagcaacatccatgtgcagaggtgctagagctgccagtactagcttaccagcgctggctacaagatcttcaggaactttttggcctggttgttaaccagagcaactattaaaaattatagaacctcaggtaagcaaattaaatcgcaaacaaaagtaatggatacacaaaacttatactaccttttttatgacattttaccatttcctgtgcccttgaggctctttacgttatggtacctgtgtggtggaaatactgtactgggcgacggggcagctgtgcttctctccccagttcctgcttgtgtgggagtatttcaccatggaaatcagcaaatcatgcttagttatttggacagctggttattaaacatttaccagcacacaccattacctgagttctatcagcttattaaattaaaaaataaatggagccctttaatcacattgttcttattttattttattttttattattttttagaggtaggctcttgctgtgttgccccggctggaatgcagtggtacaatcatagctcaccatagcctggaactactgggctcaagtgatcctcttgtcttagccttctaagtagaaaggaccactggtgcttgcaccatgtctgactaactttttttaaaaaatgcttttttgtagagatgggtccttgctttattgcctaggctggtcttgaactcctggcaagagatgcaagtgacccttgcgtctcagcctcccaaagtgctgggatataagcatgagtcatcgtgcctggcctaatcacattgttcaagcattgtgcaaatcaatggaagcctagctcacaacacttctggtttaaatgcaggcacacttcccctctgcctggccctgactcctgctgccctctcctactcagttctctggcagctcatccccctcacccactctactccattccctgcctgctttccagtctctcgacctggacaggttttctgtccctttccccattgtttctttgaagtatttattatgtaccttcctttatcctctcagctaaagggtttcccttttcttgccaaggtttgtgatccatctctctcttctcattctcctgattctgaatttatcataacatttcctgggcacaatttaaatatgcttatttgaccttcccaggctgtgctaacagcaccaccaccactgctgctgccgaaaagagttagtgatatttatctacacctgtacctgtgccacctgtgtcccatgccagagaccccggagcactccatgggcaggtcccatttaatgctgatacctccatgagaaatgagtgtttggttgaatttaagtactgtaagggaactttttagactgccctaggtggtatgtgaaacctgagggctttgtggttgtgccaaggggcttctgagtagagaagaagaagggataccagagaagatgagactcacccacagcccttctaaccccagacctagcagagcatttcactgtccagaaataggagttgaaactgtggccttcagagcaatgttttaacctggctttagtattcttactagctgagtgaccttgggcactctgtgcctcaatttcctcatctgaaaaatggggataatactattaccttataaggttttttgtgaggtttaaatgagttaatgcacataaagctcttcaaaaagtgttcaactaataaatattagccattgtcattactgaggctatgtgcaaaattgtacttaataaaataatgcttctggtaagaggttgaagaccacatatgtagctctatggcctttattttatagttgagaaaactgaagctcagagctaagaactggacacagccagtgagcagcagagtcaggactaaatccctttctgctctgaatttttcaacaaatggtattaatcctcttctttgacctggaaggggcatgacacctacaacatttgatacccatggcatttgacacccacaccactcaacacccttgtgcctttattttgattaaaggtgtgcctttaaagtgatgagaatagtgtccaaataaatatgacagaacccttctatccattttctctgggaagaaatgaatattaatatctctggtaagatttgaatattaaacaaagagaaagaactagcccctttagtggatatagcatgatctggggaacaaagagacagcccagatgggagcatgttattggagagggataaggagcgtgcaaggtaaggtgtcggtgaacaaaagttctctgtaaaagaattggaagggaagagactttattccactaagcagtttgcaaaatggggagatgtgacctgtggtctaaaatgaaggttccttccagggagcaaaaggaggtttcagttttgacagcaaaagttcctgtccgggttcccactcaagtccatttatgcaaatgaaggattcaaacttgcttagttctaattacttgatgaagctaagttctgattggttggttcaggtgagttctgaaagtcccaaagttgaacagaggtatgggttttctgttgacacagagtacatctgtgatgtctagtcaataaatgaccactaggctcaatgttaaatttaggcccagttagccactagggatccatcttgaaggactggctctttcggtttcatattcattcccatgaccgaggcaggacccatcctgcagcttttgcccagcgggtaggagaccaggcttgggaggccattaagtcaacttcagacactgttttactgcccagggtggaggaagatctctaaactaaatgcctacagcatccacagctgaatctggctggcatgtaaagaaccagcagtaagcgatgtgcctggtgtgctggggtacacgaacggaggcgagccgggccctgtagtgatagtcagtttcactgggactaccctactccagacaggaagtcctcattgctgacagcacttaggagcagtgcctctccaccagaagtgtattctcagcaggggtggatctgagagcagaatacctagtggagaagaggggtttccacttgtggggtagagctctttcaagcacccgggccacattcagagaagttcccctgcactgggctaaatgagtcaggtggcctcacttctctcagacacatctggcaacctgggcagcttttggggtgacactgcaggaccacaggagggactccttctctctggcattctgagaggtgaagggcttcacattccagtgatggaaatcttggcaacactagagaaaggagtgcagctcctacctaaccagtgagagaatattatacatgattttgtataatctgatttgaaacttgaaataatgcaacattttcttagttgaaaaacaacaaaaaatacataatttcaaagctgttcttgggggcgaggtgcggagcgtgaactgtctcccacttcagggggtaagcaggtagacaggaatgtcaccatccattgtctcgtgggtgtgaatcactgcttctagactcctgtgcttttgataattattgcaaagtcatttcaacttttgctgtgttatgatctttaaaacaaatagtgtattctactgcaggataggttaattgtcattaagaggtgattccagtggtattgttaaaaaaagtacacccacaatcagtaaatttagaaagaaagttaggtgagataaaatatcatgaagatttaaaaacaccaggaaataaataccagtctgctaattttatgacaagcatcccaagaaatattggagatgatgctgagaaaataaaaatagcattaaagatcctcaaacagcccctgttcctctgactttgcagcatttggaggggaaagcactcttacattatgagggcctctggagccccacctaaatccttaagtgaaaactcccagggagcatcattttctgacagttgcagctggattagcaccacgtgggccagtagcctcagagaagggagtgtgcaatatcagcttcctccagagagatgccgatgggtccattctgggcccccgtttccatacctgtagcctcttaggggacacagaatgactgggaggtgctgcctattcacctgtggaatgtgggcacttctggggtctgactttctcctatatagctctgtagcttttgaatacctataataattatgtacttgtattaatttttaaaaatctattaaaaagaaaaaaaataaaggaagaggggctgagctctgctgtggaaatcagatctatttagaaagcaagaaggtctgtggacaatccaatacaaggtggcccagcctccataccacctccagctgtccccaggctgctttgcagtaacaacctatgggcaaatggcagcgtgcgcctccgtctttctgccctatatgcctgaagtcacagcggtccttcaggagtgttatgactcattcccatggggaggtgggggcgtgctaggtgtcttagtccattgtgtttgctctcataaaataccatagactggggggctttaacaataggcatttatttcttacagttctggaggctggaagtccaagatcaaggtgcagcagatctggtgtctggtgagggctccctttctggtttgcagatggccgccttctctctgtttccacacatggtggagacagggagagctctgatcccttccttttcttataagggcactaatccatcatgagaaccccacccccatgacctcatttaaacctaatgatctccaaaggtaattacatagggggttagagcttcaacatgcaaatttggcagggacagggggtggggaacatgaacatccagtccattaccatagagatattcaaatgggggtaaatgcttctgtggaaaatccccccgtgggaggctgctctgggctgtgtgtccaccccaacttggtgctcccacgagactgtgggaaagggtggcagtcctctatccccagtatggccttcagcatgtgcagtccctggcctggctacctgcagaagcccacaggaaaggggcagccaggggttgaaggagaaaagaggagagaggggtggggatgagacactccattctgaggagaggtccccaggaagaggctacgcagattctttggaactggaattgcctgagaaggcttaggacagcgctgctcattagaccactgcctgggaaatggccatcagctgagaatgtgggaccttagtgtccctgtgtctgggggagtccaagagagagagatggatactgaagattttgcaaagtggcatggctgggtgagtgggccctccaccaggagacactgactacaggtgcttgctgggcataaccgaaggagggcccggcagaatccagaccctccccattgccgtgagaggctcagggggctagcttatgaggaagagaactaaaaactaggggacacattctgaggatacaaaatgcacaatgagccctcatttagatgaggggtagggtcttaaccaaactccagcattacaccccagcctttccttgtggttctatgttgtcatgcaccatgtgcttagctacagctctcctgggtgctgccttccagagatgggaccacctcagtgacagtgaagagattaagtgtgcaagctggggacagcgggcaagtgattaacatttcctgactctgactcgtcctttggagggtgatgctacatacagcccatcatacgcactatcatggcccaatctctctgaaagtgaaatcacttctccccactgagctgcatctggaattttagcagcttggagcaatgcaaaataatggtgcttaaactcagaccagcctcctcaattttgagctgggcaatccattacacatacattttaggcagaatgggatcctggtaaatttgctgtctgtgtatgtggcccacaaatttccattcattgaacagttgtcatttttaagagctgcagggcaaaaaggttatttgttgactttttgttttttgcaaatgatattaccttgcaaaagagcttaccctgaaactgaaaagaatgattctgtgttaccatatgcttttataggcttagctcttgtctgtgggaagtttgcaagcattccctcctctgctccccattcatttataaagaaacctcccacatggtgctattaaaataaaaacttactcatatgcttagtcaatgccgagcagaatttctttcataggttccgtatgaatgagttctgaagtaacaggtttagaaaatgaaactgctcaaaaagaatatgaaaatgacttgaaaaggtgccagaaaatactttgactgtgtgtgcatgtgtgtgcacgggggtgggggaaatatcagatcatgggaaggttccaagaccttcaggttataatggcatgtgaacaacctcaggagttggtgtgggaataaacgattcaggcttaaaatgagaaactcctgttatggacaccacgggatgttctagtcaacagatctaaacacgtggccccatgactacctgtttatgtgggtgtaatcaatgcccagctctgctattcaccagctgtgtggcctggggcaagttgctccaccaacctgatcctcagttcccttgcctgtaacatgctgataataacagcatttattccataggacataggatccccacaaccccaattccttggagctcaaaaattagatgaatcttgatccttgttcacagtactttccaccacggatccatccatgactttgtcatttatttagttatgtaactagttatttccaatattgtaatgagcacccatgaatctaccaccaaacaaaagctaagtctaggacaataacctacatcttatcagctagtccccagtatcttattaacctcttctccccacttctaaggtctacaccatcatgaatcttgtgttcctgatacccctgcttcccattttatttggttttatgcttccatatgtatttctagaaagtaggtatatttttatcttaattgttttttaactttataaaacttttagggacttacttttttccatttaatgttatattgctaagagtcattcacagtattgtgtgtcattgtaatttctttgttctgactgctgcatagtagtgtatacaaataaaccatagtgtaatcatccatactcccattgaggggtacttgggaaaggagagggtccagacttttgctagttagaacagggctgttatagtcctactggtacatgtcagcctttgtacaagtataagagtttctcttgggtatggaccttcaaggagaatcatgtcagagaacatgtgaaagttcaactttaggagacaatgccaaaacattctctaaagactctgtgctaatctacaatgccacaggcttcatcctctccagcacttaattgtgttaggctttttactttttgctaattgaatgagtataacatgttatttcattgtgattttaattttcactttttttctttaacaaatttttttatttttagtttttgtgggtacataataggtacatatatttatggggtacatgagatgttttgatataggcacacaatgcataataatcacatcatgggaaatggggtatccatcccctcaagcatttatgttttgtgttataaacaatccaattatactcttttaggtatttttaaatgtacagttaaattattttgactatagtcacccttttgtgctatcatatactaggtattcataatttttttcacttttctttttgaatcttttcataagtttattgggcatatatgtttcctcttctgtgaaatgccattggtgctttttttccccattattatactggttatttgtgctttgttaacaaaattgatttgtagcagttctacatatattcttggtactaaacctttgtggttgatattatgaatatcttgtcccagtttttactttgtctttttactttttaaaggtatctcttggtgaacaaatgttctttattttgacatagttaaatttatcattttatagtcaacaatttaagtgcttaagaaaaactttagctgcgtgtattagtccattcttgcattgctataaagaactccctgagaatgggtaatttataaagaaaagaggttaaatgactcacagttctgcaggctgtacaggaaacatggttgggaaggcctcaggaaacacaattatggtggaaggtgaaggggaagcaggaatatctgcatatggccagtaggacagagagagaaggggatggtactacacactttaaatacagaactagggggatggtgccaaaccactagaaaccacctctatgatccaagcacctcccaccaggcctcacctccaacatttggaattacaattcaaaatgagatttgggtggggacacagagccaaaccatatcactactccaaggtataaaatagttacctgtattttactataaattataaagtttcttttttgacatttaattcctgaatctatctagggttatttttcggatatagtttgagagagatattcaagttcattttttcccatatgaataactacttttttccacctccatttgtttatcagcctcctctcctcactgacctcctgtatcctctgtaataaaccaacattctttatttgcatccatctttttctgggatcttattcataccccatggtctgtttttctgtctctgcaccaaaactacagggttttaattgctccagcctcataaaagtccagacatcaataagggaaacccctgatcactaccttttcagaaacatcctatttttggtcttttatgctttcacataagtttagaatcattttttcaggttctatttttaaaaaaattattaggaatttgacaagaattgcactgaatatatagatcaaattacactattaaattatataatccatgaacacaatatctctctccaattacttagccctttttaatatctcttaaagttttacacttttccttctagaggtcttgaaaatgtgtccattgttaggtttattctaggagacttgatattttaatttttttttttttttttgaggaagggtcttattttgtcatccgggctggagtgcagtggtacgatcatagctcaccacagcttcgaactcctaggtccaagtgatcctcctacctcaccctcctgagtagctgggactataggcacatgccactgtgccccactagatacctgatgttttctgatgctgttgtaaagaatattgtcttttagcctgggcacagtggctcatgcctgtaatcccagcaccttgggaggctgaggtgggcggatcacttgagatcaggagttctagaccagcctggccaacatggtgaaaccccgtccctactaaaaaaaaaaaaaaaatacaaaaattagccatgtgtggtggtttacacctgtaatcctagctactcagggggctgaggcacgagaattgcttgaacccggaaggcagaggaggttgcagtgagctgagatagcgccactgcactccagcctgggtgacagagtgagactctatctcagaattaaaaaaaaaaaatattgtcttttaattaaactttctagctgtttgatgtatgtaaattttatatcttcactaaatttaattgttcttaatcatttgtttatggattttgggcattttctatataagcagtcataccttatgtgggtgataatggtttctttccctcataagatgattttaaaagtgaatggggttatataaacaaagcaaacaacacagtggttggcagctagtcagtgctcagtaaatgcttgtgactactgatattatcgtcattactcattaacagaagaattttagaaatttctttaacaaattccttcatgttgaagaaagaaacagaggcccagaacaagtccatgatttgcctgggatgacatgacaactcaatgccaggactgcacctggaaaacctgggtctttgggctacaaagtcaagtgccctttcttttaatccccaacaaatgcaggcttctgtctggcataaacttttgcaattgtagtgtttacatgaatggggctttctggcacatccatgaaaaaaaatctattaaatcagcagcatgaattaagctctttctgtgtgctgggcttcccacattgcacacgcttctagcagaggaagaatttacaccctgcaactcagaggggcagaaaatgataatttatttccttttaaatattctctatatggatctcatcatttcctgttgatggcagaggaaggagggagaaccttaaacttgcccattgaaagcaacttagactcttttggtctaactcactttcttttgggtaaatacacagttaaataaaaattaagatttccttctcaaaggatgtctcttcactctctatgtcccaggttggcagctggaagagggaaacaattatggattctcacagtgtggagtggtgcctctgaactcatcctgcctttgagacatagcaggtgctgattgagctgggcctggcctgatcatgtctttgagcatccaattctggggccactaggtctagctgtctctgctggtgctttgggacctccactgctcagatcttcctggccccaaagatctctaaatctcagctttgtctgtcatctgtctctaggctctgcaaaggtgacctctcagcagtctggctcgcagctacaccctctgggggcacgtagaacactgagacccctttctggccacagtgtagcagaggaagaggcaggctgtggggcacatgtgaggtattctcagatactagctcagccttaacttctctcatcttctcttctctctgcatccctccctccccaacttgcctcttggccagaagagtgtctccttcctgttgggtggggtttccctaacttgatgtcctctgtcttctctttattcaggcttatagcaagctccacagtcacactggcaaggcctagctctttgaagatgaagggaactttcagaatctagaataatgtgtgtcctctttcaacaaaacttgacattggaaacctgtttctccatggcctctaaaaatgtcagttttggcatgcaaatattttctaaatattatcccaattacccatggttatggctgcctttgggattatgatgaagactgtagttgtgtagaacatgtcatgctcctgactcccctctcgggatatggaggccactgtctttgtgagtggatggagctccttcctctgtccatctcttaactaatgaaagccaggtctgtctgttctcagcagtctttctctgcctagccactgtacaggacactgtcactaacacgtcctcaaggaatgacctctgacttctggcctgaagatctctgtggcctctattcaacctttattgagagcttattatggttacagctctgtgctcgtgagaacccagagagagcgagacagaattgtcttcaagctgctcaaagagtaaaatccatgcataaagacctggctgtatcacagctgtgcttatgatattagcaaaatccagtacaactaggaagaacatgtacagagaaggaaggaaaggcaaaactgttgggtctagttttcttggttcctacatgaaagaaggctgggcaatatttaccctcgataaagttcattatgccttgggtatagtaaaaatctgaagttttgcctctgtagaccactattctgccagggctgggtgccagagtgtattttacaatgctgacgcctgtccgagacagtgggttgtggtttctgttccactctccaatgcacttttgggaaggcaggtgactgggatggacctgctctagtcatcaaatgtggcaggcccactttccattgccaacaaaagttaagtaaattaaatagggccccaaaggagctctctaggagttggtgtatcatgaaatgtgaagtgggcttgcccctatgcaagaactaaaagaaacacaatttagttatctttggcttctgaggcatcggcagagttttctgctgccaatatgagatttcagtggagagtagggtttcccaaatcatgttgaaacgtgacattgttttccttaggcccacagggccttggcctgacactgagcatgtattcgtgtgtgcacacacgactgaccactttctgcacgcttcttacacatccgccatgtgtccgcctcagccagtggaagccctgtgccactcttgagatgcaggtggctgtttcttgctgctgtcactgttactgctgctgccgcttgcagcctaattcctcgctggtttcaaaatgtgtctcagagatttccccaaatccatttctccaaattctgagttgttcatccatggataacaacaggatggcatggatgtaggcactggtaaagaagcacagaagcatgtactgagggtgttaattctgaacatggagagactgcatgttctgaaacacatcttagcatttctgtgtccacatatgtgtattgcatttcaagcatttttattattattattattatttttgctgggtcgtgtcaatagaactgacagcatcctgtgaccatatcttcacctttagtgctttctaagtaaaactcagtgtcttaatatagccaaagggaagaaaatcctagtgagagaatgaactttttctgacattcctggttggtgaaatgcaatcctcttttcctggcatttggtgaggataattgaatttatgtctggtaactaaggggatgctcgggagcctcaggaaccatgagcaggaatgaggatggtcagaaagcacattgggttatgtggattcagtgacacaaaccccaagaaacctggtggcttttggcactgcatgtgattagagacaaatgatctattttcatcttctggaaaaatcaataaatacatatataaaagagtgccttcaagtcctttgagctattaagaatagctaacgttttgattgcttattgcatgtctattgctgttctaaaggctacatatgtattcactcatttcttcttataacgtccctgtgtggcccacggtcatgttattttcattcccattttacagataagaaaatggaggtcacgagctggagaactccttgctcaagttgcatagctaataagggacttagctgggattcctggccagcaatgtggctccaggcctggtttctaacttccccttcttggcaaccaccttcacagaggaatgcaagaggtgagtggatttgatgtgatattttatatcatgcctatttctatccactttctctggagtccactaagattaaagaaggagagaaattctctagttctacaggaagtgcgggctgtttccagtgggtccttgaagtcctttgtctgtttccagtttttccttcaggtcttttgagcccagcttccctctggccagctcaggctcagggagacgggcatacaccggtggcctgggtgacagtgtgcagctgatgagccacaggacttgggcaggccatagtgggtcaggagagactggacgcttcgtcttttatgcttctgggatttctgttgtggcttctgttttcaccgcatttcaaatcctttaagttaggtcatatggggaaaatgcttgtgcttctcatttatctccctggaggctagcctggatctctgatgaggaggagcaccaggccactccataaccaccgggctgcaggatctccagggccacccaggaagccaaaatcagaacagagctccttgctgtgggggctttgctcaccctagttctgggagccagccagctctatcttggggatataactttccagggacaagagatgcctgattttgtgcagacacctgtgtcatggagagtatttcttatgttccaagcagagaagttcaaatttaccagtcttcctgtcactccacccccaaaatctggcgaccccactcagctgtttttcagggcccaccctcatggcaccttctggggactccctctttgctactgaggttgagacctagcactaggttttgtgctagaagcgccttgggggcagaaacccccatatgccagctgcccaggtcaggactgcatgttttcctactcaccgccaccttgccttgtatagaagaggtgtggccacgtgcggaatccgcgggcacaggcagcgaggccaatgaatggtatcttgcctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtccctgtcgcttggaatccctggaagaaagcagaaccgagaagagaagcccgggtttaacgctgtggtttcttttttgcaagataaaaccatgtgatttagatatatgcaaacaaatcttgagttaaaggaaactgagtttcaaattagataattgtctctgagaaaggcattcatatatctcatatttcatttctaactttttatcatagaacatcttaaacatacaccaaaatagagaaaattataatgagctcccatctgtcacttgccttcaacaatgatcaacttatggccaattatgtttcagctacaacccaatctcgccccattctaatttttttaaagcatatcctaaacattgtatcattttatctgtaaatattttagtatatatctctaaatatatatgaactcttatttttaatagacataatcgtaatcatcatgattttaggaaatgattttaataaaaatcacacccaattcacgaagttaaaaaaccctcccaatattcacacccttctcattactcttggttttaaatgacttttcctgttgtttgaagcctgcgttgcagtctgactctgatccttccaaaaactgctcctagagaagctagaggtacactctgagattaagctacctcaacttcaagcctctggattctgggaggagttgagtccaccctctgatctagagtttccaggcatggctttgtgaatgcacctaccttcttcccagatttttgcccgtctgaccctcttacatgagaacatccccatacatggctgtggaaaatcctcaagtgcaatgaaggcaagactgaaaacagagccgctgccaaacagagcagcaagttgaagggcaagtgcctgtcaacacaatccccttgaaagactataaagagctgccaaaacatgagatgcatctgacatccagatagtattagctgactgcttcccaaatgggttagctgtctacagaaacgccctaggtagctgatatgaatcgcaaatgtgctgtgacttgattaatttgtaacagtcagaaattaggtagttcagtgctagtcatgctcaagcttagtagtagctggtttagttgttttttgttttttgtttttttctgtgggtaattggatctaggatgatagtgtaccatcccccagcagtcatagaagacatggtaaaaactagctttacacgggtcctggacttgaggtcacgggtgtggaaggtgattcactagggagttggctcttagcttagtgggtcatgtatttctgagaagcttctttcctgaggtttacagtcagtttcagaggtgaatgaactgcttcagatgatcagaaagatacactctgtcattattcccccaagaataatctttgcttctgtagttacattaaagctaaattttgctgccagagtaggagccatccattatattataatcgatgacatgaatgttttgctcaagttcagatgtctaataagagtcattttctttccgagggagtgttatcagtttcatgaatatgcgctctgtatttcattagcattcttctagcaaaacatgattctgagtcatttctgaaatatctgctctcgcctgcaacttgtttctcagtttttacaaaaattgccttttctacttactggcagaaaagtttgataccacacgagcctaaaatgggtatgctgagaaaaaacacagcacacctatggaaccgtgaccacaacagtgcatcggtctctgtcccaccgtctcattcgaggttaatccctctccacagggcggcacctcagcagggaagggcgagtctgaggactgagggtaaacagtcatgacatgggtattcactatcatggctttcttagatttttaagccagaatgaagttcagagagcttgtcagaggatgttgaatgaacagaaaaggaaatttggaacccatatgaaaagagctgctttatgaatcacagagagcttttgagttccagcttacagtaattcaaataccactcacttatattcaactgagagcagctctggcccagccttgtcccctgaccccggggacactttctctaggatgaacaagagaaggtgttctccactgtactagctgccagtgtgtttctttcaaccaaggaagtatccatgtctcttattctatgtcattattgtaagaatggtctaccttgatccttagaagccaaccaggatggagtcccattttgcagagtctgctgtgactgccagccacccctgtaccatggacttccacagcaatgatgctgtgctgcatctccatccaaagggattgcatctgttttaattgcttgactttcaaggacactcagggacaggtactcttccataattctacgtcatcccagtttcacaggggcgtgaattccccatcccctgcaaggtctactgctctccaaagtgtgtgtctttgagatggaggctcttcacagggttcaccacctctgcaagtagggctgtgacaactcagccttgtgcactgccacaaaaggcccttcaagagcttctagaaatttctggctcacagaagccactggaatactgtaaatggagttggttttggtggctctgtcctttgatgggaggctctgtctcctgaggccaagattgaaggcaggatctgaagattgtgcgcctggatcaactctaatcctttccagcccaagagagttgttcttgcttcttcttggactgttgtgagaaacttccacactgactgcttggaagtgtcacatgttggacctcttggtaccagtgtctctgacagactcataccactgggagctcagagcgagtggctgaggccagcagagctgaacacttagtgccctgtccctgcattctgtgggatcaagaatgaactggaagtaggatgccgccctagaggaggcacaggtgctacagaggcagctcagctcaggaagcggacgtgaaccccttcctaccccccattagtgctgtggccatgaggccccctcacctgagggggaacacctctgtcagcctggctatctgccaccaacaaacacttttcctgggaaggggcctggattcctccagttgagcctccttagatgcacaggttgcaccagggtggaggccacagccaaaaccaaacagtgtagcatgaacaggccaggctcccagagtgggaagggaggactggctggaggcagcaggaggctggagccacatttgcctgcaaaaagtcttttcagacgcacatctcaggccagttacgcaactggctcctggatccctctgcccaggcccagtccctcccattgcctctcagtgtaaagcagggaatgctgcaggatggagagtcctaagccttaatcgtggatcttgggattcagagtccagagaggataaagaagcaaattcacagtcaacacttcctttttttggatgtttaccatagtgaagttttgtgcaaagtgctatgcggacatgatctgacacatcatgttcccccaccctcccggcccaggatctgaaggtccagcaggagaggcaagccaatgctaaccaaggctcaatctgatacagggacacagactgctctggacttccgtatatgcctttaaaaatatatatatatctttaggctgggcgtggcggctcacgcctgtaatcccagcactctgggaagccgaggtgggtggatcacttgaagtcaggagttggagaccaacatggtgaaaccgcatttatttattttatatatatataattttattaataaataccctggaaggaccttgttcctttaacgtgctggcacctatagcagggaccaaatttgtacttttacaaactgtctgtactggtctaaggaggagcagaggcgcacatacaatagctgcttatgcagaatcactggaaaacaggtgattcctgaacgttgctagatgaatataactcagaaataacccacagcctagattagtaatctgtgaaagttggagaccaaatgaaatttgtttagcaataaaatgcttttgaagagaatttctctttctttgatgttcttgctcattactgtacactctaatggtgttgggctcagaactattgctcaatagaggtttgataaatgaatgctccagaagacacacagaggctatcagtgtggtcgttgtcaatgagtgtcccagacattaaataagagcctgcaatgcctgagagccatgcgcagagatcatgggactgacacctggggagaggttctgaagggacctaagcacacagacaggagggaggtgtcatcagcagattcatccagccccatgttttgtagatgaatagttccaagacactttttaatagttatccaatcctgtatctcctgagcatgctcagtgccatagagcctcagtttccacatttccaagcagacttttctgttctctcataagcacatttgagaaaggacttgtttccccttgctgtcataaatgcccttgctttcaagttcaagccaaaaagaagcagtgcaattgttcttcaagctgatccggtgcagaggaaccgcaaatgccagctccagctatggtttctaattgaatatgactttctttgtaaatgcctgtccttgcccccagcagcaaactgacaactaggacttgcctttgtgagctgaaatgatgtcgctgataaccaacagcttgtattaatttttcctgataatctcatagtacttttaatgagattggtggcaaacatgccattctggggcaaattaatttgtccttgcaaaacagagtgtcagcgatttttatttcctttgtctgacgtgtaaatgggttgtttccaatggcaattgatacaacctagtattttcggctgcactgaagggagaacaagattttgccaagagcaacaaaatcagcacaaccacaattaaagcagatgatcgacatttggaaaatggtctgctgatgtttcttccttcgttttccatgctgaaataggttgtgatttagacaagggccaaagagatgaacaaggcagccagcggctgctcagcctccatgtagcctggtcatggagaagcaaaatcgacatgaaatgtgaccctctctcttttatgtgctttcacatgctgtggtcaggaaccaagtactgtatttgcattcactgctcaggcactgtgcggtgacctgcttttatgccactttgcattgctgaagtgatgtgggtgaaaactggaatcctagttagaaggaaacatggcatccgactcttccattctctcatttccaatgtattgtgttgcctctctcacccgccaaagaaatgaaatgtgattttctaccagagttggaagagttttggccacaatataagtcattatggcagtttccattttctttgctatacattttgaacaaggaaccacagttcatggaattgcattgaaaattaacagcttttttttttctttttttttttttggccaagctagccagaaaggaacttgcatgagaaattcactaatgctaatgcagtttttcaagtggtaatatttctagaattttaattaggactttttttttgctttgaagggtcccatcacagaagagaaaggaatgctaatatttgtctttgatggccagcagggtcctggaggacattaacgttttgcaagctgaatgaggtcttcccactgacacgagcataaagagcaggtggatttaacagctttcattccattttctatttagtttaatcaagataccagttaagaacaaggggaggctgctcccagagcttctctgtccttttaggggttgaccctactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctcagttttatgattcctaacttagagttaaaagaagcaagccatacaggtaaatgattatcaggcagagaggcctagaatgcattacagttatgcaaaacctgggtttttcataggtgtttttaatgttggtgtgaacagtggagccaaatagcatcttgtagcccctacgtgggcacgattctttcctgggcgacaccgtctgcatgccccatggtgacattcctgtgcgcttgctacagttggctagtaatcctggctttgaagaaggttttccagtgccaatcaccatgttcaagacaatgtgtgggccagtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgcaggcagttcaaattcagcaggaaactactcaggttcctcctagccctgccccattctttataacatggaaaccctgattccccccgccgaacactttccttcaggtagcaggatttttgcttcaccgtaaacacaccaggatcacggatgatgatagcatttattgcttggaataaaaagtgatttgcggccctgtaaataggacagcaaatagttttgcttttgacctaaggctcccatgtcacttcatgatttcattcatcttcatattcaaaagaaggataaataaactgctttcctgcttagtagcttggtcatctgaaatccagtatctgacatcaattcccagtgggagaaattgtgctttgctgcgtgtgtcttaactcagtctctgatgttctggttctgactcaggatgttggtgacagctgcaccacatatgccacgtctttcatgctagactaagaccagacatcttttctggtgcgcatggagtcacactgtgacctagaagacagtgctttgaaataatgacaaagcacagaggcaaggaatgaagttgacattgcataccaacggcatcatcaaatttgtcctcaaatgtcactgtgtaatgctgagtgatttttggaatctccctagtttcccccaagcaaattacatatcttcataggcacatcgatatcaatgttttgaatgtaatatattttaatgaatatgtaaacatgtacaaataaatataatgaatataacaagtatgactgtcctatatgagacatagatattttcaataaatgtatatttattatgaatatatatttataatataaatatcaatacaatgttgttgaatgggtgaataaatcctttaaagcagcctcaatgttataagtagtcactgtgattcattcatctcatacaagcattctctttctatggatgtaattaatacttatggcaaattgacttttcttgagtctcatgaaatagaaaaattcctttctgacattttgactattctaatatggcacaatattataattttagtgcatgtaatcttttccacccagaaaattggcactttctaaattcctggtttcttatttgaaaacaaaaaagacaaaaattatgacaaatactaccaaattaatatttaaattatatttgaatggcaaattaatacttaaaattacattgctaaaaactaattccagatacggagcaaacttaaatgagaaagataaaacaatttaaattttagaagaaaatataggagggcaacttcatgattttggccaaggcaaagatttcttaattaggatgccaaaagcaccattaaaaaagtgggtaaaataaggcattgaaataatattgggggctgggcacggtggctcatgcctgtaatcccagcactttgagaggccaaggtaggtggatcacctgaagtcaagagttcgaggccagcctggccaacatggagaaaccctgtctctactaaaaatagaaaaatcagtcaggcatggtggtgcatgcctgtaatcccagctactcgggaggctaaggcaggagaatcacttgagtctgggaggcggaggttgcagtgagcagagattgtgccactgcaccccagcctgggacagagggagactctctcgaaataataataataataataatattgggtacagataataatttcctccacatgtgtgaaaaagaaggttatgagaatcagaaagcaggaatttagacaatatgtaggggcagcagatttcccttgttttgtaaaacaggcctcagagaggagtatcaacttgcaaataggtcaaaaaccctttgagggaaggaagtttctgggcagcagaagctttaccaccatccactgtcacatggatagggattgcaacatactggcccttcactaataacatctcgtcccatttggatggcaaccctgtgaagtacatatgatcatgctagggaaactgaggttgagtgaggcctggtgccatgcccgaagttgggctgctgtccagtggtaaggcacgggctagctgtgtcagccctaaagggcaccccactacatatccccaagatacaggccacggggctgcaccctcagccacggcccagcgtccccaaggctcagcatgagtttgcatctgctccttccctaggaagtcatttatttacataaatgactaatgatcctgggcaagggctcctgttgggccacatgttctgctttttaaaattcagagcctaggtcaactgtttgatagaaaaatgaaaacataatgtaaattctaaataaagctgatatgcaaagaaactgccctgttaacttaccttacttgtagatcatattttcggtggaagtctgttcagtttaaagataaacatgacatgattagaggagaaagaggatagcccctccctttaagctccaagataattcaagacatcagttaactattgagcgattagagaaggtgttttgggagctgaccttgacctagtattctcaaatctccttcccctccataaggcctggtatacttcatgttgctggcagtcaacatctgtctggcttatgaagaacgagataatcacactcattttggggcctcaggctatgagcacctgagtgtgttaatatcaattaaaaaccccagtacccatctgttgaggtcaggactattaaaagtcaggcgtggctgggcgcaatggctcatgcctgtaattccagcactttgggaggctgaggccggtggatctcttgagcttaggagttcaagatcagcctgggcaacatgatgaaaccctctctactaaaaatacaaaaaattagccaggtgtagtggtgggcacctgtagtcccagctacccaggaggctgaggtgagagaatcacccgagccccagaggatgaggttgcagtaagccatgatcgtgccactccacttcagccttggtgatgggagtgagaccttgtctcaaaaaaaaaaaaaaaagaaaaagagtcacgagtcaggagtcaggtgtaaatgcctgtatatcagactgtattttagaaatttgcttttaaaagttacccttgtgactgagactcaaaaagaaacttccaggatgaatgttcaagctttttttttacttaataaaaatacagctttaaggctgggcatggtggcccatgcctataatcccagcactttgggaggccaaggtgggaggatcatttgaggtcaggagttcaagaccagcctggcaaacgtagtaaaacctcgtctctactaaaaatacaaaaattagccaggcacagtggcatgtacctgtaaccctagcgactcaggaggctgaggcaggagaatggctgaaacccgggaggtggaggttgcagtgagccaagatcacgctattgcactccagcctgggtgacaaagccagactctatctaaaaaaaaaaaaaacaaaaaaaaacaagtaaaacaaaaaattttgcctgtgatacgataatgagtttcttttaaaacttctgagattagtgtcttagagatttaactgttgtgttttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaagaaaaaacaacaacaacaacaacaacaacaacaaaatgatcccccaagaatcaataataaccagaataaggagccattatcagatattctttattactcttaattactgttaggcttcaggaagccactagttgggtacagctgcccaggactaaacctgtttcttacaaggtcctacagccacaaaaggtggacaccacaacctccatttataaaacagaaaacttaaggctgttgttttgcaaacacatagattaataacatggttctgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatcgaatctctgagggagcaatgagataggaggtaggtgggactcaacccaggaccagattgaagactggctgacacaaggaagagacactggaagcacctgtccataacacatgcccaccagtgccatatcagtttaccattgccatggcaacacctgaaagttattgcccattttctagctatttctgaataacccactcctttattagcatgtcattaaaactggggataaatatgagtgcaaaactgcccctacgctactgctcttggcacaatgcctatgtggtagctctgtttcacaagaacagtcacaaagctgtaacactgccacctcagtaaagctgttttcttctaccaccagcttacgctgcattccttcctgagtgaagccaagaacctgccctgcaccacttttgtcaagtcagttgacataaaattactcataatatcctctctttattttttgactcctgtaggctgtgtaatgacttcttcctttccatttatgatattgtgttttgtgtcatttttctttccctcttctttttttttgagacagattcttgttctgtcacccaggctggagtgcagtggtgcaatgttggctcactgcaacctccgactccccagttcatgccattctcctgcctcagcctcccgagtagctgggactccaccacgcccagctaacttttttgtatttttaatggaaatggggtttcaccatgttagccaggatggttttgatctcctgacctcgtggtccgcccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaatagataatttttttgttcctcaccagtataattcacataggagtagaaatctcaagtttaaagtgtggatttgcactttaccacttggtgtattcaagaagatgaataatattaatacatcagtagggccaggcgcagtggctcaatcctacaattccagcactttgggaggccgaggcaggcagatcacctgaggtcaggagtttgagaccagccgggccaacatggcaaaaccccgtctctactaaaaatatgaaaattagctgggtatgttggcacacacctgtaatcccagctacttgggaggctgaggcaggagaattgctttaaattgagagatggaggttgcagtgagccaagattgtgccactgcactccagcctgggtgacagagtgagattctatctccaaaaaaaaaaaaaaaaaaatcagtagctttgaattttaaacatctatttgacaagaaattcacagttctttctctcttaaataacgtaataattctttcagtaatgagcctggtttgatgcctctctccccaacatgataaaagtatcacataaatctatgaaaaattcaatttccctgttcctacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacaacaaccacaaccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctacttagcattcagtttttagattatcattgcacacatatacccagcatatgtctaatatacatgtaaaaatccatgaagcaagtgttatattagcttgtgttttctattgtattaaatttttctcttatatcgtcttctcctttttgtcattaaaaatctgttcaagtcagtcaattaattattggatcataagtagataaagtcttttatttcataacacattgactcaatgaatatgtttctttgcaagacacagtcctcatttccaagaaaacaagcctgaaaagattatactggagcaagtctacaagtaatgatggtagtttttccttattgtcagtcctggggcaagaataacataaaagataacaaggtagaataaagattacataagaaagaaggacagcaacaggacatgggaactatttatagggtaacatttaaataatggatgatgagaagtaatgcgttagacagggatggatgggaatgattgaaggtctgagtactttagcacagattaagatcaaatcattaggattttaagagttgtgtacagttactgaagaaaatgccttagaatttaatttgactgtggataaaacattcttggattagatttaagactattttccatggtaagtatatttataatgatgatgactgtagtgctgaacatttaaacaatgaaaacaaaattaattgccacacacataatgtcctgaatactactgtaaatgttttatcttattttctttaaactgtctacagcactgtaaggcaggtaccactattgtcacagttacacagatatggaaaccgagacacagggaagttaagttacttgattaatttcaagcaatcgggaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccgaggtgggtggatcaccaggtcaggagatcgagaccaccctggctaacacggtgaaaccccgtctctactaaaaatacaaaaaattagctgggcgtggtggcaggcgcctgtagtcccaggcactcgggaggctgaggcaggagaatggcgtgaacccgggaggcagagcttgcagtgagtggagatcgcaccactgccctctagcctggaagacagagcgagactccgtctcaaaaaaaaaaaaaaaaaatgtgtatctggaagattaagttctaacagactcttcatttccatagatccaataatgcacttagggagatgactgggcatattgaggacaggaagagagaaatgaaaacacagccttttatattgttcttaacagacttgtgccaaacattatacgggtgtatttaggtgattgaagagaagaaaggcacaggagtgaaattctgtgagcacaagggaggagttctacactcagactgagccaacagacttttctgacctgacaaccaaggcggcgcaggatgctcagtgcagagaggaagaagcaggtggtatctgcagctggaagcccagctcccaccccagctgctttgcatgtccctcccagctgccctaccttccagggcccatatcaatgcctgggtcagagccctggggaggaactgctcagttaggacccagacggaaccatggaagccccagcacagcttctcttcctcctgctactctggctcccaggtgaggggaatatgaggtggttttgcacatcagtgaaaactccatcaggagttttctctgatcagcaagaaatataattaaaattcaaagtagatcaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggccactcagttttagcgtctctgctctatttggacattttgcagttctaaaaaaaaatcattgaataatttggactttgattcttggactctcttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcagtaaaagctgttcatgtgaagatactaccatggctgaataaatcccattctttttctttcttcaggctatcaacatttcagtggcaaatggttattatggaaacatttgccatttaaaagtgaactaaattatttcttcaattttctctgtgatgcagtagactgtaaaaagattaaagtttgttaaaataaagtacatattcgataaggaagaaatagattattcctaatgacgtctgcaatgacctagtagaaggagtgatagaagcagttgttttcattatttttgtccaaaacttccttccaaatgggatttcattgatcatattcatttattaccacctataagacatgttgacattatgtaacatctgatgtgaagcgctgaggatacatctgtctgtattattcttgccaaaaattaatggtgtgaattgaatcagtagtaaacatcatatacaaacccaactaggaggacattcttcaacatacctggacagtaaacttcaaatgtttgaaggccatgaaagagaaacaaaagtgaaaaactatcacagatttaaagatattaaggacaggataaccaaataaaatacagaaacctgaattttatcttgtaacataaaaaaagtcatcaacgggaaaaatcagtgaaatccatatggtattttaaatgagttaacaaataacattatatctatgttcatttcatggttgtgatacttatgctgtggttatttatgatgctgacattagagcaagctgaaagaggcacatatgggaatcatttttactatatttttcaaattttaggtctaaaagtatttcacctctctcctgcatcctgggattgcctccaattaactacctgcttacaagacttttctttattttctttttgccttttattctttacatgtaaaagatgagtccatctggagcttattttaaagcacagtatgaggactgacattgacctgtttttttaaatgaaataactagctgtcccaaccctgcttgttggataacactgctctgtttcaggagtacccccactgtcatacacccgtgggtccatacccctgggctctccatctgggcactcccctgcctgtggcacctccttcctgagggccggcctcacccagggcccagctgccctctccatggcctgtgtcttcctttcctgatgcctcagatttcccccattctctggcactctttccatcctcctggcctcactctgcacctcccctgaggtgcaggactgccctgccccagcccccagcttcctcactcccaaagccttgtgccactgaagcacgagctccagagtgcacctggatggcagcttctctcctggccaacaaacgcctggtgctggctgccctcccagcatctcccctcaactcctcagctccaccccagggccttaacacacacatgcatagcacacacacatacaaacatatgcacacacagacatgcacacaaatgtacatacggacttacacagacacatacaaatgtgcacacactcgtgcatacacagatgtgttcatgcaaacacacacgtgcacgctcacaggcacgtacacatgtgtaggttatgctaagaaatccattttgtgtggaagacactcaggctcaaatatgtgtccaaagtcacacagctatggagcggcagaactcaggtctctagtgcacacagccccgacttaccgcagttccacttaacagttttcaactttatagtgatgcaaaagccatccacagtcagcagaaaccctcgtgtgagtcccacacggccagtttttcgctttcagtacagcagtcaatgattacatgaggtatccgacacttgactacaaaacaggcttcgtgttgatgcttctgcccaccgcaggctcagggcagtgttctcagcaggccaaggtgggcccccccacgctgtgctattcggtagtcaggtggactcagtcattttccactcgcagcggccttatcgggccgcagccaggggtaagttgagcagtgtctgtacttttagctccaccctgggtatttttaagtggcagatttacaacaaaaaataaaaataaaaatgaaaaaatacagcgttccaaatagtaggggcataaaaggagagaatgcacgttgcggtcagcccatgcctgggagcataagcacttcagaggcatcaccaggcgtgactggctgttgttcctgctcttcctggcagcagcggcctgggcctgagagggatcgccctggccacagctgtaggcaaggctgctgggagccaggagccgccgcgctccgcggtagcgagtctgcggcgccacctcgtgggtgctgcgtggaactccccgtggtgcgggccgggaaggccgggtccccacaaagccggagcccgagcacagcggtgcgagctcgccccaggacatcccacagcacccggagacgggggctggtcccccaaaaccctcaggggtgagaggaaggaggtccccagcctgctgagagctgtcctctgagcacgcactcgcgcacactcacacgtgcatgtgtgcatcctcaggcaccctgacgcgttcacatgcacgtacacgcgtgtgcacacgcacagtctttcacaagagtatgacgcattcacacaagagtgtgacgcgttcacacgcacgcacactccctctccctcgagcctggaaggtgcactgggctcataggggtggaaacctctaccgcggcagaggcacagcaccagggccaggatgctcgcttttatttcagacgtgaaaaccgaggcccgaaagagacagccagtgtccaaccctgtccaacgtctctgctgattgcgcctcctgtgtgtggccggggccggtgtgagggcagcgggcccaccgcatgcctggcccgccccagggcctcgagccacttcctcaggagctgctggcagctgcagcgacggcgcacccagagcccgagggtcccatggagccaggcttcccagcacacaggcacggtggagcctcggggtgggcatacaccccgcgagctcgcgggggctgggcactgcgggtcctcgggtggggactctggagttcagtcttgaaggacacagtcactgagggtcagggaaccaggagggtagggagggtagggaggggtgcctaggcctagtgggagaagcatgtgaaagttccctaagagggctgggggtgaacaagctctcggcccggcctctccgggtagactgctctggtgccctggagcctcccttctccaaggccccatggacgcccccagaggggtgacgccctcgcccacgctgagctctgagtgctgcacgagaactcccagagccgtgtgcacacgcactccccttgttataaccggcattaagtgcactcacattgtcgcatatcccctaccaccgtccatctccagaacttcttcatcttcccaaaaggaaaccatacccactgaacaccaactccctccttttgttaaccattgctctttctgtatttgaatttgcccattctgggcccctcatgtaagtgaaatcgcaatgtatttgtccttttgtggctggcttattccatctagcacaatgtcctcaaggttcatgcgtgttggcacacctctcagaatttccctcctggctgggtgatattataggctcacgcctattatcctagctgttagggagacagaggtaggaagatagcttgaacccaggagttcgagacctgcctgggcaatatagcgagaccgcattttccacaaaaagaaagaaaaaaaagaatctccttcctggtaaaggttcagtaacagtctactgtatgcataaccacatttcgcttgcccatccactcacccatagaccctcagaatgcttctaccttttgactcttgtgaatcacgctgctttgaacatgggtgtgcaaatatctgtgagagagcctgctctcaaaaaaatccatattcttggcaccatgaagaatcacctctcacagacaccagcgaaaagcaagtctgtctgagagcagagggtgaggaggggaaagccgggctgcggatcacagtgggcggaggaaagcccacccttgtgctcccatgtgtgggaggagagaggagagatgccctctagtgaaggaactcttgtagcagccagctccattcctgcttggcctgtggagggccagctcaggaacccagaccaggaagaagtcaaatgaccgacaagatccatcaggaagcagaagtgtgctgtgtctcatcggcaacaacaaacagagctaggaccagccacccaccccccaacccaggggaaatgcatccaccacacaactaccaccgctgcgctcatgacactctcagagacaggcacgggagctcctggcaaggcacaaccagggcaagtgacagtttgccagtcctgggcaagcagacacttatcctctctccagtccccaatcccaccagcctgcacaagcagagaaacatcctgcataaattaaaagatcatccggatcatcaaaagatctgagcaaacaaaacgactgagacaaaaaacaaacaaaacaaaacaaacaaaaaacagaacaacaacaacagaagaacactcatttttacagagagatttgagcccatcccaacagagtacaatgctctttccaagctcatggatggcgtttgggaaaatttagctgtgctaaaggagcaggaagcctcagcccctttcccaagaattgctgttacacaaatcacattctctcaccagggtgcaacaaaattagaaacatgcaataacaaagaccatgttaaaagtgcattttggggccgggcacggtggctcatgcctgtaatcgcagcactttgagaggctgaagcgggtggatcaccccaggtcaggagatcgagaccagcctgggcaacatgacgaaaccctgtctctactaaaaatacaaaaaattagccaggcatagtggcaagagcctgtaaacccggctactagggaggctgaggcaacaaaatcacctaaacttaggaggcagaggttgcagtgagatgagattgtgctactgcactccagcctgagtgacagagtgaaactctgtctcaaaaaagaagaaaaagtgtgttttggaaacaaagttagttttcacaatgaaaattataaaatgcctggaactcaatagcaatagggtattacatattaaaattatgaaactcaacaaaattgacatttagggagaaatttatatcctcagattaatttgtcagaaacaggataaaaggagaaagctcatgataatttgagtaaaagagaaaataaaaactaaaatgaaaaacttttcagaaacaaactacaataagtgtgtgacctatcaaaatctctggatgtgtccaaagcagttctcaggggaaacgttatagctggaagtgtttgttaatatgcttcaacagaagacatataaaattatataaactaagtaaacatacaagaagcttttttaagggaaacaagaaataaatgtatttaattttaaaacagccataataaaagtagacttgataaataaaacccaaaaccacttctttgaaaagaccgttaaaaaaacctctgagaagtcaagcaaaagagaaagaaaaggcacaaattttaaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaacctgaacaaacagaacaaacagaaatggtaagcaggtgctcgaggggctccatcagcctccagggatgggctgctgtgttagggagggccagagcacaggggaagtggagtgtaattctttctacaagattagcaagctgaacttgaatctcacacacgcacacacaccacagtgacgtggaaagaatccacaggacacttatgagaggtaaaaatagaaagtttctgcacaaaacaatcgtgtgtgtttaaaagataccatgtggcagaaaatagtgatgtttgtttgccagtgtctaggaagaaaccttgaaggcgcacgccagactggcggctgggttggctagggaggagacgatggggtgggagcagctaaggacgacacacactcttttaactctgttcctgcgttgtcgggacgtttacaaactgaagatatatatttttaattaattatttttttttttaaaattttactttaagttctgggatacatgtgcagaacatgtaggtttattacataggtatacatgtgccatggtggtttgctgcacctatcaatttgtcatctaggttttaagccctgcatgcattaggtatttgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcatttccacaatacaaaaaattaaaacaaaaaaatcaaaataaaaaaatggctatagaaagttcttatgcagaagggatgaatatgggactatgggaggagggacaaaggaaagacgagaaatgtggatacatacgcgagacaatccacagttcttaaaatcacatctgacgactgaaacaaaaactataccaccacctaatactcaagccagtgatttatacaagtggaaaaggtaaagagacataaatgcaaggcaggtttccacactttgaagtggtaaatactggtaccagtagactactatattacaatacacatattgtaacatccagagcaaacactttaagactatacaaagagatacacgcaacaacattttacagaaatagatcaagatggagggaaagaaaaaggaaacaaaaaagcaaataataaaaacatcaggcataagcaattatgtaacaataagcaccttaaatgtaaatggtctaaataaaccaaaagacagattgatggagagcctataataaacacatggcccaactaaatactgttcatgagaaacttcaaactcacttaaggacctaagtaggttgaaagtaaaagaatggagaaagatatcctgtgaaatcattaattttttaaggaagcaggagtgactatattaatatttcatgaagtagacttcaagcaaaataatttaccagagctggagagggtcttcgctgaattttaagatctaaaatttcctatgctgccttgacatctttgagcctcacagggccccaaaggcctagccgtgggttttcctgtttctaccagacaccccctaccccgccacccaacaggaaaggctccccacctggctagttcttttatcagccagaacagttgcacctcagcctaagaagtttcgcttcacctgtctgccagcccatgaatttattcaaacaagccaattgcattccccctcgggaaccattggtcatcgtgtgctcttgttactaccaagcccgcctgcttcctcagcccgcagccctcactccactacagagtgcggtgcccatctgaccctgtgtggcatgcagtgtcctcctccgagctgtgggtatatgcgactaaaacactgctgtcaatctcatccatccacgccaggtgtcatgttcggccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaaaacaaaggatagcttgaggccaggagttcgagcctgggcaacatagcaaggcctcatctctccaaaaaattttaaatttagccaggtgtggcggcacacacctatagtaccagctactcaggagattaagccagggggagtacttgaccctaggaagtcaaggctgcagtgagtcatgttcgtgccaccgcactctagtgtaagtgacagagtgaaactaggcagaaaaggagcaaggatttacaaaagatctgaacagtcaaccagcaaaatctgacatccgtataacaccccactccccaacagcaaaacacacacatttttaaagccaatagaaatctaccaagatgaggtacacttggggcaataaaagaactcacagcaaatctcgctgtgtgcccctctgcgccggcgccgtgcccctctctgcgccttcttttctcaccatggggaagcgtttgggggcctcttgagggaccccctagatgcttctactcagagcccccaaagccggggagcctccactcctctgtctgcagcctcccctgtcggttctcgctacccagggttcagtggcctgggggtgacggagggggtcgcctctgccaaggcccctcccggcgcctccctggctcatctagcccaccttcctcccacgctggctcacgcaaagtgctctggtcaccaggagcccttcctgaccagccccagccccttcttggccttcgcccacctggcctcccctggagccctgacctgggtgccgggcctgctgggtccagagcccaccccgccctgaacaaccccgagtctcagccaccctcggttcttaccctttcacagctggggagtggagcctgggcctgcacctctccgcgccagagccggcgccagcgcctctccgcgcctgcgccgccgctgcgcgcctcgccgccgctgtctgcctctccgccgctgtccgtctctccgccgcgccgccgctgtccgcctctccgccgcgccgccgctgtccgcctctccgccgctgtccgtctctccgccgcgccgccgctgtccgcctctccgccgctgtccacctctccgccgctgtccgcctctccgccgcgccgccgctgtccgcctctccgccgctatccgtctctccgccgcgccgccgctgtccgcctctccgccgctgtccgtctctccgccgcgccgccgctgtccgcctctccgccgctgtccgcctctccgccgctgtccgtctctccgccgcgccgccgctgtccgcctctccgccgctatccgcctctccgccgcgccgccgctggccgcctctccgccgccgtccgcctctccgccacgccggcgccagcgctgtgtgcctttgcgagggcggagctgcgttctcctcagcacagacccggagagcattgcgagggcggagctgagttctcctctgcacacacttcggagatacagcgaaggcagagcaatgttctcctcagcagagacccgggcgggcgggccggtggcaccgcgagggcggagctgcgttctgctctgcacagaccttgggggcactgcctcgctttgggacaactcggggccgcatggacggtgaataaaatccttcctgtttgcagccctgtttgtggttggtggcagcgatggacactgcagccagccagagcgtagaaaggcgtcggggtaagtgcgctatccaggctgcactgtgggtggcctgggacgggttgggagccctatctcaggcgtcactgcccgtcttgggtggccggttgggtgtgctatctggggctgtgctgcctgcaccgggcggggggtggggggtggtttgggggccaaaccggggctgcactgcctttggtggggagccggttgggggcactatcccagactgtattgctggcaacagtgaggtgggctaagtgtgctatccggggctgcactgtgcggctgtcgggggggtggcggtttcgggttgagggcgctatggggtgctgtaatgcccatggtgtggggaggcggggcagtttgggtatgttgggtgtgctattgggggggtgacactgctggtggtagggggcagggtgggttgggggccatatcaggggctgcactgatggctttagctaggatttctggtactatgttaaacaacagtggtgacagggggcatccttatcatgttccagatcttagaggaaaagctttccatttttccccattccatatgattctagctgtgggtgtctttcctgtagtttttattatgttgcggtatgtttcttctgtgcccgtttctttgaggatttatagcatgaagggatgttgaatttcatcaaatgctttttcggtttcagttgacgtgatgatactgtttttgtcgtttatttggttgatatgatgtatcacattgtatgttgagtgacccttgggtcccagggatacatcccacttgatcatgatgaattatctttctaatgtattactgaatttgattcactggtattttgttgaggatttttgcatccatattagagatcctggcctgtagtttccttctttgatgcttttgtctgattttggtatcacagtaataatggtctcacagaataagtttggaagtattccctcctgtttttcaaaatagtttgagcaggattcgtactaggtctttaaattgtttggtgtgaagccatcagcagtgaagacatcagttcctgggcttttctttactgggagactttttctgatggcttcaatctcattacttgttaccaatctgttctggtcttggatgttttcattgtttaacctaagtaggttgtatgcatctaggaatttgccaatttctactaggctttccaatttattggcatatagtagccagttatgatcctttgaatttctgaagtattagttgtaatgtctccttttttaatctgttgattttatttatttgaatcttgtctcttttcttagcctggttaaaagtttgtcaattttgtttagctttccagaaaaccaacttttcatttaatcttgtatgttttttatttcaattttgtttgtgctacgatcttatttattttcttattttcggtttagtttgttctttactagttctttaagatgtattatttgaaggttttcttttgtttggatggtaggcacttatagctgtaaatctctgcctttgtactgctttctgcataacaagttttggtatactgtgttttcattaccctttgtttcatgaaatttttgaatttctgtcttagtatcttcattgatccgctagtcatttattcaggagggtagtgtttaacttccatgtgattgtattgtttccaaaattgcttttcttattgatacctagttttattcctttgtagtgaaagaagatggccacggagacagacagcagcgtggtcagagtggtaggagccggccatcagcgagagctgctccatgcctggctgctgggtcctagagcctgtggcccactggcttgcctcactgtggttggtggtggtggtgacagagactgcaggacgaccagatggtaggacaggggctatccagggctgcacctttcgcagtgtggggtgggttgagggcgctatccagggtgtcattgcctgcattaggggtactggttggtagcactgtacagggctgcactgcccacggcagggagggtgggttatgggtgctttctggggctgcaatgcccatggaggaggacaggttagggcactatcggttatacgctactggcggcattgggggacggaggtggggggcgctattgagggcaggactagcagtggagcgggggcgagttcggtgctatcaggggctgcactgctggtgtcggtcaacagagttggcatcccaggaaggagtggttctcctctccctgactccacactccagagggcgacccactcttggtcatactggagtgcagcagggcacgcagcgtttgcgtgggaatcctgagcatggcagagcccccacacccaccgtggttcctggttcctgggcctgtgtactgtgggtctgtgcctcagaggctgccaggcacccctggggacaccacgggggacagggccctgtgcgtggaggcgtccggaacaggaattggcacctgggtgtggagggctggctgggtctgaatttttctgcttctcctgctccccgaggagtgcagccccagtgggcccaatggttcctgtggagtggggagctgggtgctgtggtgtctccagcacccaccccagaccccagttcctgcccagcttgggccaaaaggagaggctggactttggagggtgggtgtgagtgcctttgctgaaactggcccctgccacccagtggccggcatgacaagttgaggctctaacccttccacccctcacgtctttctctaggcttttctggctttgcccgcccagctgctctgtgccaggaagaggaggagacacctagagcctgcgacaccatggctcgcctcgctgcgggtgggcggcagtgacggagactgcagtgcgccagagcggtaggagagcggctgcgctaggagggcaggcggctgcagccagggttgggggtcaggcttagagcgatggacgggctgcagcagtggccagatggtaggagccttgtaaggagggctggtgcattggcaatgggcctggctttgccctgcgcctgccgtggatctggccctgtactgccctgccttgccctgtacctgccctactgttacttggactctcggccctgtcctgctctggtcccatcctgaccctgtcttggccctgtgctaccctgtccctgccctggtcttgccctggcactggctctgccctgaacctgcactggcctgaccttggctctggccgtggctctggccctgcctcttgtcctgaccctggtcgtgtcatggcactggccctgccaatggtcatggtcctgctcctgttctggccctgacctggccttggacatgtcctggccctgctttggcccatccctgccctggccccaccatgggcctgcctgttctgccctctcctggcactgaccttgccctgtcatggcccagtggtgccattgccctgccttaccctgcgctggttgtgacttggccccgcttggtgctggccgctccctggacctgccctggacctgccctgaccctgcccttggcttttgccctgccctcactgtggcctggccctggccctagccctggtcctgccatatccctggccctgcccttatccaggccctgcccctgctgctgccctggccctggcctggaacctggtcctgtcaaggacctgccctgactctgccatggccctggccctgctctgccttgttcctggccctgacccagacccagaccctttcctggctctgcactggactttccctggccctgagctggcaatggtctgcccctggtcttgccatcaccctgccctgctgcgctctggatgtgtcatcaccctgccctggccctactctgcctttgaccctgccctggccttaccttggccctcaccctagtcttcgctagaccctgctctggagctggccctagcacagacctggccctgatcctggccgtggtctttgtcctgccatagccctggccctgaagtggacttggaggtgtcctggccccggcataacatggctctgcattggcctgtccctgccctgccgctaccatctccttgccctgctctgtcctgtcccagtactgtcccggccgtgctatttcccttccctaccctgccttggctgtgccctggctcggttctggccctggccccggccctgccctggacatgctctgacactgcctcagcctcggcactagcctggctctttcttggcatcagctctgctctctctgtggaccggctcttgtcctgtcctgcactggccataccatgccctgccctgccctgccctgactcagtcctggctcagccctggcccaaccttggccttggcattgcccctggtcatgccatatttcttgccctgtccctaccctggccttggccctgacccttaccttgctgtggccctgcccttgccctaacgcagcccctggccctgtcatggccctgccctggacctgtcctggccctggcccttccctgcttgagaacttgccctggttctcccctggccctgaccctgaaatgcctggccctaccctggccttgcactgctctggcccttgccctgactctggtcctgtcactggcctagccccagccctgttgctggtcttaccatggcccagaccctgccttggccctgccctgacactgtcctggaccctggctgtgccaagaacctgcactgtccttgccattgttttgctcctgccccgaacctggtcttccccaggccgtggccgtggccctggccctggccctgcccaggtcttggcactgtcctggccccgccctgccctggccctatgctttcctggccctgccttgccggccctggccctgccttggccctagcctggctttgaccctgccctggccctaccttggccttcaccctagccttacctgggcactgtgttggacctggccatagcacagacctggttgtggccctggtcctgccgtggccctgtctcagaccctagccctgccaggtacctgtcctggcccagctctgggcctggctttgtccctggttcttagatgaacctggtcctgctcctgcccttgctcttgccctggaactggccttggacatgtccatggtcctaaccctggccctgcccaggagctgccactgtcttggctgtgccctggctctggccctgccccggccccaaccatagacctgccctggttggtcgtgaactaccttaaccctgtgctaccctgggcctgctccaccctgccctggccctgccctccctttggccctgccctgaccctgccttggccctcacactggccctagcacagacctggtcctatgtgtggccttggcctggcattgacccctgctcctgaccccggtcctgccatggccctggccctgccaatgaccctggcagccctggccctgtcttggccctggccctgaactggccctgccctgaccctggccctgaagtggatttgcaggtgtcttgtccctgatgtaacctggtcttaccatggccctgtccctcccctggctctgtcctggccttctgctgaccctgacccagaccttggccctgccccagccttgtcctagatctggccatggccctgcgtctgccctggaccagcgctggcactggcatggaccctggccctggcccttcgctacttaaggccatgccctggcccagccctggtcctgaccctgtcctggccctaatttggcgtggctctaccctggcatgctattctggccctagccctgaccctgtccctgtccctgtcctggccccagccccattgctggtcctgccacggcccttgtcctgacattgccctttcctggttctggccctggccctgtcccagccctgctctggccctggtctgaaccctggccctgcaatagacctgccttggtcctgcccagaccctggctctggccctacctctgccctggccatacccttgccctggcctggaccccagtcctggtccttgtcctgccccagccgtggccctggccctgccctgcctgtgccctgttctatcctgggctggccctgccatggcctggtcttgccattgccctgccctagcctgccctgcttgtgccctagacctgccccggcctttgcccctgtcttggttctagccttgactgagccctggaccttccctgatcttgcctcagccctggcactaccctggccttgccttggcatttgccttactctctctatggcctggctctggtcctgccctgctctgctcttgttctgtcctggcacagccctggccctggccctggccctgccgtatcactggctctggtcctgcccttatgcagacctgaccctgccactgccttggctttggcctggaccttggccatacagtgaccctgccatgaccctttcctggccctggcctggaacctggccctgccaaggactcgccctggctctgtcatggccctggccctttcctggatttgggtgtgtcctgtcccttatttgccctggcccttccctggctctgccataccccttctctggggtagggccagggtcaggaccagaccagggcagggtcaggaccagggtagggccatggtaaggcctgaagatgggaagggccagggcagcggctggaccagggaagggtcagggccagggatgtagtaggactaggggcagagccggcactagggctgagccaggacagagcaggagagattacattgggctattacgtaaaatttttattttagatttttaagataactatagtagtagtaatgtctatactatattgtttgtaatagtaataatatttgcagtaatcactaaattttaactaatactatctttgcttccagtagtgttctatgagtataattttatcaatatgttaatatgtgaggcattgattctcacaataattctatgtgctaggtacttaaagcatccccattttccaaatgtaggaaacaggcataaagaagttaaatacttggccagattactcctgtaatcccagcactttgggaggccaaagcaggcagatggcttgagctcaggagtttggaaccagcctgggcaacattgtgaaaccccatctctactaaaaatgcacaaaaagaactaatttaagtttcttgtaggattctggttacaaaacactggtcaaacacacagggcatggatagggcagggccagggacaaggtcaggccaggaaggggccagggccaaggcagggccagagatggacttggaagtgtcctggtctgatttgccctgccccaacgttggcccagccctgctctggcacttcctgtcatgccctgtccctggcctgagcactggccctggccctgtcctgcttctggccctgccccggagttgaccaggcactgccatggcccagtcctgcattgccctgccctcctctgccctggtgctaccatggccctgcttgggccctagctctgcctctactctggacctgccctgactctgctcagccctggatctaccctgactctgccttggtgttgccctcccatctctatggcctggctctggctgtgccttgcatagatcatgctctgccctgcgtgtcccagcctgggcccagcccttgtcctaccatattcctgaccccagccatacccttcttctggccgtgaccctgccgtggccctctcctggcccttccttggtcctgccctgcccttccatgccctggccttgccctcaccctgcattggccctgcactggtcctgccctgccctggcactgccttggccccggccctgccttctccctggtcttgcctttgccctgccctggcctgaccccaggcctaccgagtccatgaaatggccctggacctgccttgccatcgtctgtcctggccctgtattgtccccaccatgctctggtccagcgcttgccctggccctgttgctagtcctgccactgttatggccctgccctgtttttggccatgccctgtgctaccctagccctgccctgccttggccttggccctaccatggccttctcctaccctggcctggccctacactggccttttctaccctggccttgcccttcccctggtcttgccttgccctggccttgccctgccctggccttggctttgccttatcctggtcctggttctgccctgaccctggccttgctctggatcctctctggttctgctttctccctggccctgcccttgctctggccctgtccctggcccagccttgaccctgaccctggccctgacaatccccaggtctgacactggccatgcttggccctggcccctccttttggccctgccctggccctgccttggccctgtgctatcttagtcctgccctggccctgaactcaccctggccctaccctcaccctacactggccccgccctaccctggccttgccctgccctggccctgcctttggcctgctctggctctggttctgccctggccttgcccttgccctggaccctccctggccatgttttttccatggtccttctctggccttgcccttgccctgtcccctttctggtcctgccatatttctggccctgtcctgtccatgtcctggacctgactctggccctggacctccctgtccctgccctgccataccctggcccgttccttgctctacactgaccctgccctgccttggccctgtgctaccctagccttgccctggccttctgctgaccctgatcctgccatggccctggccctgccatgtccctgccctggccctggttctgccctgcttctggccctggccttggtcctctcatgtccctggccgtgaccctgcccctggtttttctctggccatgaccctgcccctgttctgtcctatccctggccctgtcttagttctgtcctagccctggcttttcacagtactttatgcttagtaagggctccatggtgtctgtgagttgaatgttgtgttcatagtatctgccaaaacagaaagaaaaaaaacaaaatattttgataagaagttaaagctttgtatataatatgccttgaattgtaaatgcctgttattagttgtattacatataggtcatggttttgtacacataactccaaaccattgatactgttaaaagaatatatgaatatatgaaagaatgtgtaaatgtaagaatgtatcagtatctaattacctttccaaattaatttttatttttagctctattagatttttctcagtgtaacaaatgtttattcctatgtaattaagggcgtatttcctgtacagaatattcatattacctaattgaaaattatatgatacaaaaatataatactatttttaggccaggcatggtggctcatacctgtaatcccaacattttgagaggccaagtttggagaatcatttgagtccaggagttgaccagcctgggcaacatagtgagaccttgtccttattaaacaaataaataaataggttgggcactgtggctcatatctgtcatcccagcattttgggttgccagtgcaggaggattgcttgagcccaggaatttgagaccagcctgggcagaatagcaagactccatctctacaaataataaaatattaaccaggtgtggtggtgcgcacctggggtcccagctacctgggaggctaatgtgggaggttttctcgaggctgcagtgaactgtgaatgcaccactgcattccagcctaggccacagaacaggaccttgtctatgaataaagaaataagtaaaaatataaataaaaataagtaaaaagaaatattagtaaatataaatataaatacatataaacataaaaatgcatgcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgatgagatgagatgagatgatgagatgaaatggagagtggaaatgagatgaaatgatgagacgaaatgacaaagctgaaaagaaattgaaaggagatgagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaatgaaataatgaaatgaaataatgaaatgagatgaaatgaaataatgaaaggaaattatgaaatgtaatgaaattgaaatgaaattgaaatgagatgagttgaaatgatgagatgtaatgatgaaatgaaatcatgagatgagatgaaatgagatgaaataatgagatgaaatgagatgatgagatgagatgaaatcatgagatgaaatgatgaaatgaaatgaaatgatggatgaaatgatgagatgaaatgagatgaaatgtaatgagatgaaatgaaatgacataatgaaatgaaataatgaaatgagatgaaatgaaataatgaaatgatgaaataatgaaatgaaaatgaaatggaaatgatgagatgagaagaaatgatgagatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaatgatgagatgaaatgatgagatgagatgagatgatgagatgaaatgatgagatgaactgatgagatgaaatgaaatgaaataatgaaatgaaattgaaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaaatgaggtgaaattaaatgagatgatgaaattaaatgatgaaatgaaataatgaaatggaaatgatgagatgagatgaaatgacgagatgaatgatgagatgaaatgagatgaaatgatgagatgcaatgatgagatgaaatgatgaaatgatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagataaaatgagatgaaatgatgagatgaaatgaaatgatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaactgatgagatgaaatgaaataatgaaatgaaattgaaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgtgatgaaatgaaatgatgagatgaaatgagatgaaatgaaattagacgaaatgtaatgagatgaaatgaaatgacataatgatatgaaaaaatgtaataatgaaatgaggtgaaattaaatgagatgatggaattaaatgatgaaatgaaataatgaaatggaaatgatgagatgagatgagatgaaatgacgagatgaatgatgagatgaaatgagatgaaatgatgagacgcaatgatgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagatgaaatgatgacatgagatgatgacataagatgagatgaaatgtaatgatgatatgagatgaaatgatgagataaaatgctatgaaatgatgagatgaatgatgagatgaaatgatgagatgagatgagatgatgagatgaaatgagatgaatgatgagatgaaatgatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacgaaatgaaaaaatgaaataatgaaatgaggtgaaattaaatgagttgatgaaattaaatgatgaaatgaaataatgaaatgaaataatgaactggaaatgatgagatgagatgacatgacgagatgcatgatgagatgaaatgagatgaaatgatgagatgcaatgatgagatgaaatgatgaaatgatgagatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaataatgacatgagatgaaatgaaatgatgaaatgatgaaataatgaaatgaaaatgaaatggaaatgatgagatgagaagaaatgatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaggtgaaattaaatgagatgatgaaattaaatgatgaaatgaaataatgaaatggaaatgatgagatgaagtgacgagatgaatgatgagatgaaatgagatgaaatgatgagatgcaatgatgagatgaaatgatgaaatgatgagatgagatgaggtgtaatgatgagaggaaatgatgagatgtaatgaaaggagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatcagatgagacgagaagaaatgatgagataaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaatatgatgagatgaaatgagatgaattgaaatgaaatgaaataatgaaataatgaaatgagatgaaatgaaatgatgaaatgatattgaaatgaaattgaaagatgagatgaaatgatgagatgaaatggtgaaatgttgaaatgaaatgatgaaatgaatagatgtgacatgaaatgagctgaaatgatgagatcaaatgaaatgaaatgagattaaatgatgagatgaaaaatgatgagatgaaaaatgatgagatgaaatgctgagatgaaatgagatcagatgaactgagatgagatgagatgaaataatgaaattaggtgaaataatgaaatgatatgaaataatgaaattgaaatgagatgagaagaagtgagatgaaatgttgtaatgaaaggaggaaatgatgagatgaggagatgaaatgatgagatgaattgagatgaaatgagatgaaaaatgatatgaaaaatgatatcaaaaatatgagatgaaatgaaatgagattatatgaaatgacaatgaaataaatgaaattagatgaaatgaaatgaaatagtgaaatgaaatgatgaaatgaaataatgaaaatgaaatggaaatgcgatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagttgtctttgtgttccttaatctgatgagattttcacactctgcacatgataattgttagatttttattgtgttgataaattgtatatcaaataaaaaatgttattacctcttaaattaggatttttaggtgatataggcagaaaggacagcaagtttttataactttgtctaaatgaactttctaaatgcctgagtattaaaagatagcatgtctataaatcacaatgtatatattactgtatgacctaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaaggaattgctttcttaatttcttgtttcagctagtttactatcaatatatagaaatgctactgatttttgtatgttgatttatatcctgcaactttattaatttcatgtatcaccctaagaagcttttggtagagtcttatttttttccatgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaagctttcaccttttccacactcagcatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaatcagtatatcaaagacttacctgcacccccatgtttattacagcactattcacaatagccaagatatggaatcagcaaaagtgtccatcaacagatgaatggataaagaaatgtgatatacatatataatggaatactatttagtcataataaagaacaaaatcctgttatttgtggcaacaagaatgcaagtggagggtattatgttaggtgaaataaacctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgttgggtgactgtagttaacgggaatttattgtgtgttttcaaataactaaaataaaagattttaaatattctcactgcaaagaaataatacatgatttaggtaatggatatgataatgactctgacttgatctttacgcattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacattcagtaagaatagaaaacttgggcaccgtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataagcttttaatatagtagtcaaagtattaatttctcacattgcaatttccttcaaagacatgaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccaagtagctaggactacaggtacataccacgatgcctggctaatttttgtatttttagtacagtcaagagtttcaccttgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttactttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcacagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcatgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgaatggagttgtacatataatttttatgaaaaaaattaacaagtgcataagttcataatagaaaaaccaataatactccaggcacaagttagtactaaaaaaattatgttgaatattctctaatacaacatgctttttcccttcatgaacaatttgtgttttactgagaagagtcactgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgcaatgtactatgtttatctgggttttgaaaagtgatgtttcctaatatgagaaagccatttacagttttaaatctacaaaggcaaatggaatggtactaaattatttacataataatgtttagatggtggcccttataacattctttctatacttcctacagagttggggatatgcaatcctagaatatttctgggagctaatcctttagcttgatgaatgaaacaagacttttaaataaaattaaactttcaaattatccaggtaatgggcctgtcttttaattcaatggatatggagcataatgaattaacccctgttcattgggtaataagttctcattcttataatactcaaaatgtcctttaatttttaatttttgatagtcatatcattatccctaggtattttagcttctatcttaaattctaaaataattttgaaataggagaaagtattctttattactatatgtattaaacatcatggttttcaaattgaactgcaaatgtatcttttcattgcttcttgatgacacccttcaccctatccatattgtcactaccaagtggtgattacttttcaggttcacatacttattcttcagaaaaatcttctctgtgccttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttataaactccttagacactttttattctgagagaaataaaaaagctaaaagtcaaatgactttttttactctccttattataagcacccatcttggtaatttagggtctttatagttagggtaagttgtgtcataccgaggttacaaaataaaaagtattttgtctttttgggcctttccttattcagtaatactgtcagtttggctttttttgtaggtcaacttattgaactcagtattctgaaataatatgtttactatcttttgagaagcacttaaaatattagatttattgttactcttctgcctttattgggctggaagaataattgtttcactccacaaaaggcaagttgcggagaaaaacacatagacattcaaccgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaagtatataaataggtgacctaatgttaatttttattgtctgagaccatgtctgttatttcactctttaaattcagttagtagtgcagaacctagcacttagtagatactcaaaaattatttgctgaataaaaaaaggttaaacatgtaatatatacaaaatgtactggaaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatgtagtcaaatatccccttggaaaaaaattaagtggcctctaaagtgaggtattcatatatgtaattttacaatcctctagtgatagaattaattaaatacaccaccaaattgattaattcctactgtgttaaaagagaagcactaacaatgccagttaccatgtaacatggatttaagctacaagtcatagaaatgtgatgagaagcctcagcgctgtaaaacagagggtggaggaaagcttttcctctctcaaatgagctttgcgaggtatacttcttgaaggataggaagttgaagtgttcaggacttttatgtctattctactttggcttagtttacatgattcgtagtttattagcctagaaatggccaagaaaacttaaggttcaataattagttataaatatgaaatatccccgatttttaagataaaaacaacttataaatgtatttgtctgtaaaaattgtgtatatttttacagaacatctatttctttttttatttttttatatttatttattatgctttaaattctagggtacacatgcacagtgtgcaggtttgttgcatatgtatccatgtgccatgttggtgtgctgcacccattaactcatcatttatattaggcatatctcctaatgctatccctcccccctccccccaccccacaacaggccctggtgtgtgatgttccccttcctgtgtccaagtgttctcattgttcaattcccacctatgagtgagaacatgtggtgtttggttttttgtccttgcgatagtttgctgagaatgatggtttccagcttcatccatgcccctacaaaggacatgaactcatcattttttatggatgcctagtattccatggtgtatatgtgccacatgttcttcatccagtctatcattgttggacatttgggttggttccaagtctttgctattgtgaatagtgctgcaataaacatacgtgtgcatgtgtctttatagcagcacaatttataatcctttgggtatatactcagtagtgggatggctgggtcaaatggtatctctagttctagatccctgaggaatggccacactgtcttccacaatggttgaactagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatgggtctatttctttaaaacaaagggaggggagtctctcatttgcattagtttttttcatagccttttgaacttcacaatttctatgtttcagaacctatttcttacagtttttctatgctaaactctgtcctagtcagttctagagtgtatgaagaaccaaatgatgtaatagtatgccacctggctgtagtggaacaaatttgactcttaagtatgcaggctctaattttcctgtctggttttggcaagtattccttacataggttttttctttgaaaatctgggattgagaggttgatgaatgaaaattaatcctttcacttttttgtatataggtttgcaataattaggtcagagtggagttttaaggtcacggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacttattactggaatgtgttttaaaggatcatatcagatgaatgaaaggtatttgatccttcgtttccttaataataaaatgatggtttggaaaaataggctacagtctaaccacagtgctattattaggctttcttgttaaacataggtctaagcctaagtatgtcaatacaacaaatacttactgtttcatttctagtaatgaaaaaaaaaaaaaaaacaagtctttctggcataaggatgattttcatctggttattttgaaacatttttgtaaaataaatttccatctataaagaacatttttatttgtaaggaggggtatgtctctgtgcactggaagagagggaggactaaatcactgggaagtcttatgataaagaagccattggcttaaatcagcgaagcaagccgtcccttggtttaaggtgtttttcctggccatcctgtcttgactagaactttacctacaccttcctttttggtttaggcaaattatagtatctaaaactaaagtctcagctctgtgtctttgacatataaatgttctaccatgtcttctctggaatctgataactatctatctctttaaaatgcaagtctagggagatgactcatcagaaaaagaagaaaaaagaggtatttggaaattgtgcaaattaaagcagcccctgatgtcaaagtctacacattcctgagtgagtcagttctggccagttctagctggatcaagagagctcttctgggcaggcctgaagagcacctgaatggcagccacctgaggagccaggtgcctgaaacttccttcacctgcttgaggagcgccaaagcccaggtgctggctggacaaccacttctggctgcctaagcagatggcagaagaaggaaacaaggtcagaggcagagtattgaaccctgcctcccaggtgggtggaagatgcctgtcgccaaactagggcccagcttgccgggtgagatgggtgaactggtgatcccccgagagagtggacgtcagaactacatgttcctggacttcacctcggccagcgaaggagagagagggttaatgttaactgcacgaggcccactctagccttaaattctgtaattcaaacccttcccttggagacaaaacaaacatgacaaggaattctgaggtcaggggacaagaatcacaaagtgggagattgaggaggcagtgtccttcctgcccttggtctactggctaagaaccttcctcagcctgacctttgcacattgcactttcagctctgtttgcaattttcctcctttagtgctgagggaatcccagtgttccatcctgaaatctataggttcctaatgggtggttaaaaaaaaacctcagcgagagaagcagaaaatgtttcctcttcctgaaaaactgtagaaaggcaggcaccattctgggtgaggacatggtccttgcaaatgtctttgtgttgtttttgtttttgttcttgtttttgagatgaagttttgctcttgttgcccagactggagtgcagtggtgtgatctctgctcattgcaacctccgcctcctgggttcaagcagttctcctacctcagcctcccgagtagctggaattacaggcacctgccaccacacctggctaattttttgtatttttagtagagatggggttttgccgtgttggccatgttggtctcgaactcctgacctcaagtgagccacccgcttctgcctcccaaagtgctgggattacaggagtgagccaccgcgtccagcctgcaaacgtctttaaagacagcgtgtttcagaggctgtgacagtgccctgtgaacatgccaattctcacagtcccgggagctctgaggagcaggcccggctccttgccaggctgatggtactgaaactctgctctccaagacataacctgatggccatgcaagatttcttaatcgactgtggaccgtgagagtctgcatctcattttaattaagatgggaaaagaaagaacaaaagagcaactcccaggttatagagaaagtggattttagtataatattcaagtgtagcattgctaataataacaaacctttcccctcccaaacggtaaacacttgcactgcctattatacaaaaattcaaccaccctctctgttaccccgatatctcctccccagtgaccccccctctcatgcggcctcatgagcctggccagtggtgaatggcactttcatgggcatgagactccacgtgagtgggactcagctgggacccctctccacgtgggagctggggaagccaccctagtagcagctcaaagtgtccgtgatgtccctgctgctgaggtaggggccgcctctgagctggtctcggggtgtgagctgctgctggtagtgggctctgccctgagggcctggtggctggtcagaagggcaggcacacatgggtgactccccaggaactcaggccacctccccaccacagccctgcactgtgtgctccaggcatgtgctgagtgcctggtcaatcaccagtgccctattgatcccagtctccagagagagcatttagtgtcactccacagaggggaaactcggcccagagaagtaaagtgactctccccagtcacagggctggtcagcagtaggatgggaggctagtcccttgctgtctgactccctgagcccacccatatcccaaggcagccaacctctgcccgccctggttcaggccccgactggcccctgtggtgggtgatgtctatcttcctggcctttgtgctcccagccaactgggatggagcctccagctggcatgacaggttgtagctacggacagaagagtggctgtgaggctgccaggaatctcaccagggccccctcccagggcctgtccagagtgaggtctgggtaccccaggcattgccagaccacaggatctgatgttggccaagaggccatggccacaggctttctgaggctggcccccagggagagttcaatcctactatcccaattcctgtcctggccttacctctcagtctcaccgagccacttcatggtcccaaaccaggacccaaagtgctgcttgggctcaaggttgtaattatttgcagccaactggagcagtggacctccttgcttactttgaattcctgggtccagagggaaaaactgggtgatgacagggactggacagggatgccacaggggccctgtgggggtgttagatggggtggtggccagtctttgctcataggggaccccctcctcctctccagtcctgtccccacctgttctcagagctggctcaaacagcagctcctccaggaatgtgtccttggtttcaacctggtactcccacctgcaggtcttcctggagtgtctcctctttctctctgtctccccataaatctaagacgagggggatggatctgcccactgctactcaccgtatgactcttgtgaggttgatcagtctcccctggaaggccaacagctgaagtccatcagaaagggtcctctggcccagagccagcccctgcccacccctgtcttgctgcacccagggtgcaagacccagatcaggtctgggtgacaggaggggtatagaggggctgaggctcaggggccttctagcctaacttgtctggagacagttggggaaactgagaccccaagcagggaggtatggctccgagagattattctcattaatctggaacatttttgcaagctgttaggtataggaagtctgtcacaggtaagagaaatgctttttaagagcatgagagacagcagggttgtgacaatattgaaacaccaccgtgcagattcaccaattgccaccaccgggagccccctgagagtcattgcagatgcacagccctcccctgcaacccctggacctccccgtggtctggcacctaaagggttatgcctcatggcaggaatcaggaccctcagggtgccctgcccactccaaggtctgcctctgctctgattggtcactgacattcagattgtcacccaaatataaggacattagcagaaagactcattcaatacaagtggactcagacatagataggaattgggttgcaagaagccccttttgtttcttttattttattttggaaaaaacttttattgtgaaaattcacatatatatatatatatatatatatgtatatataaactcaatcaatgcaaaaggatagacaatgaacaaatgaattccccttccactccagatccccaactcagatccagacctcctgagcccacttcccccatctcatcacagatccagacctcctgagcccactttccccatctcatcacagacccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccaactcatcaccagtgatttcttgggctctgcattagttttctattgctgctgcaaccaacagctacagactcagtggcttccatttctgtcttatagttctggttgccaaaagtcctaagaggatctcactgggctaaagtcaaggtgctggcggggctatgtcccttctggaggctcaagggatgaatcgggtccctgccttttctagcttctaggggctccagcttctaggtttgtggcctccttcctccatcctcaaagccagcaacagcaggtgaagtcctcgcccatcatgcatcactctcccttcttcctccttcaacttttttttttatatttagggggaacgagtaccggattcttacatagtcaaaaagctccttatagagaagctcggaactttcaatacaactttgccttttctgccattttaattttccatttaatttaaatgtattctctcatttgaccttcatactctgtggagaaatattcctatttcggcttgtattgacaagctgttttcacacagcccccacatcacccaaccaaccagcaagaaacagataaagaaactgaggcccagggaggctaagagtcctgccaggatcattcacctttcaaggtaaggagccagttccagacctgggtttgtgcagctccaagctcccccgtctttctacaatgctagatttagactatagcaatctagcaagtgtggccacacaatgatcaagttggatttagatgatgttccctataaatccattctcctctcccgtgtaagcaaggcaaagtcctccaggccatggggagtccctgaagactcgatgaactgcagtggccacatcaggaggttgcaggttgaccagaactcaccgacacagcaggagagcagcttggaacctgcaacctagccaaaacctagtgccttggattgggggagaaaacaggcagccattcctctctctctgctggctagaggggattctggcttttcctgccagagccacccctttccctcctcctaaagttgatggtggttctttaaggaaagggagaagtgcacggtgtgatagggcaggaagagaagaaaatggaggagaggaggggactttcccataagcaggcagaagaaaaggcagctgtggtgtgtgatggacatggatgcagtggtgtccaatgtggggtcagccctagaggagagacagagagagagacagaaaagtgagagtcctgacccttacgattaacatgggatctgcctgcaaatgctgtttagggccatcgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagtcttgaccccaatacaggggctggatatgaacaggcaacagctgggtttctgagtcagaaagacttggttaattgctaattgcttaggcgagtaatttaattttgttgagtcagattcttcagctacaaaatgcagatgacagtacttattcctccaggttgtggggaaaatggagattctaagcacgatgtccatttcacagaaaggtaccaatttggtggcttattttcctttctaccttcagaagtggctatccctgccacccaaacagacccttgactctcaagtggacggggtcccatttgcacagggggagaccttacagcctacgttgagtctatacttaccacttagtgagcattgtgtccgctcaggggcctctgtgggcatccgtctcctctgcagcatctttcctccccactgctgggtctgcacatgaccccctccttgggttaggcctctgatcagtgatgaccttggtatggtggtgatggtcagtcttggcatcaaatgagccagtttatatcatcagctattcaataaaatactaatctaggtgtcaccgtgaaagtattttgtgacattgttatgtacgtgttgttacaaatgtgcatgatgcatttactacagcatagaattttgcctgggtgccagcctgaagtctgtccgacagatcatagccatgttagtcccacagtcacaggggccaattgattaaattattttatctcccttgaaaactaaaaataaaatcctaagccccccacccgacttaacagaccccctgttggccaacggaacctcaaataaatcttaaaattcagttcttggccatgacaggacaggaggtcagacatacctccctgtacctccctccctcttatggtttagaccccacaactgaacagcattaatgttaaaatagagatcatgagactgacagaacagactctttgtggcaataagacctcaaattataaacaggagctagggccatgccaggcgagcgttaagtcttgtaccctactcttaaagaattaactagattctaactaccacgtgggttttatttttctctagcaaccaagcaagcactggctgtgagagaagcaagattaaaacaattacaactcacccagttcacagacgctgagtaactgatctcctgccccactaaccttaatgacagctttctctggacaagggactgatttcagtaactttctcctgataagagaccatcctccatggactggttctggccagttttggaggctgtgcctgtacagaggctgagtaccttcatgtccctgcttcactttttgatgtgtagggcctaattataatacatttaaatgtcaagtctccaccccagaatgaacatgcatgtttatggaatatgcatgcattaggacctcttttatgagtattctcataaaatgatatagctcctctgatatcctattgagtatgtatatgtagccaattcatttggctcaaattcctgtcctctccttccctccctggaaatgcctgcctctggccttggctgtaggccacacttcccagcctgtcataatggccaccttgcagactgcaaacctatataagaaataaagctctcttttctaaatttataaaattgtgtgatttttcagttgatgctctctttctacacacacacacacacacacacacacacacgcaatttatacagaaggaaatctggagaatatatgtgggaatggatattaagtgtgtggcaccgtggtggaagtaacataaagttggattaggctaaatttattaatgttggcccactaaacagagattctggactcagggttgtaggtcaaagctttagaaagggctccaagggttggtttgatcggttacttggttggttgcttgcttggttggttggtgcttgcttccttgcttggttgtttggttggtttgttgcttgcttgcttgttggttgattggttggctgtttgcttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactggagggtctacggaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatggtttgactcacagacacccacggcattgtgtagtccatggtatccacagggagagctaatgggctgtaccaaagtcttagttgttctttaaaaaatgaagaattctaggtcaactgaataaaagactaactcaaattaatgaaacacagatctaaaaccctcaatcaattcccagacttgagccagttcacaggcccacaaccccttaagtgaaggggaggctgggtgatcttggggaagtacgctgctacgttgccaaaaatttacattgttaatctttttcccagtcttccccaaagggacttacagccttctgccaggatgactgtgacttaaagaaaagaaaattctcagatatttggggaattactggacactggctctcatttgacactattatcactatgttgcctaggatggattcatgctcctgggttcaagcagtcctcctacctcagcctcccaaagtgctgggattacagacatgagccactgtggccagcagagctttgaaactagaacatggaggtccagtggtaaagatttgacaagtctgggaagagattgggccaaggcaatgttgatgattcttttttttttttttttttttttttttacaacagagtcttgttctgttgtctaggctggagtgcaatggcgcgatctcggctcactgcaacctctgcctccggggtccaagcaattctcctgcctcagcctcctgagtagctgggattacaggtgcccaccaccacaccaggctaattttttatttttttgtgttttttgagacagagtctcactctatatcgcccaggctggagtgcagtggcgcaatctgggctcactgcaaaccccgcctctcaggttcatgccattcttctgcctcagcctcacgagtagctgggactacaggtgcctgccaccgtgcctggctaattttttgtatttttagtagagacggggtttcatttcaccatgttagccaggatggtcttgatctcctgacctcatgatctgcccgcctcggcctcccaaagtgctgggattacagggatgagccaccatgcccagccacaccaagctaatttttgtatttctttttttagttgagacagggtttcaccatgttggccaggctggtccctgaccttgtgatccacccgcctcagcttcccaaagtgctgagatgacaggcatgagccaccgtgcctggccaatgttgatgattctaaacagcagccgttaatgtgaaaaccatccaactggaagccctggccttgcccagaggacacagtctgggtggtgggcagagacttcagctgccttccaaggcaagcagctccttgctgcccgcttgctggggattttacttacagggcagaagctggcaggtgatttgggggcaggaattgcttcctggatggtataggatgaaccacactccccaggaaggcactcatcctggtggcctaacagaagcagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttgttttgttttgttttgttttttgtaatggaatcaacctaggtcctaagcctagcaggttgttattattatttttatgattattttttgagatggagtcccactctgtggtccaggctggagggcagtggcacgatctcagctcactgcaatgtctgcctcctgggttcaagagattctcctgcctcaacctacagaggagccaggattacaggcatgcaccaccatgcccggctaatttttgtacttttagtagagatagggttttgccatgttggccaggctgatctcaaactcctgacctcaggtgatccacgcacctcagcctcccaaactgctgagaatacaggtgtgagctgccatacccagccacaggttatttttgctgatcttctccctcctcccaccctcaaagaaaacgcggtacatctacaccatggactactacgcaaccctgaaaaggaacaaaatcacggttggtttttttttttttttttttgcagcaacatggatgtagctggaggccattatcttttttaattatttttattattttttttctattctactttaagttctggggtatatgtgcagaatgtgcaggattgttacatagatatacatgtgccatagcggtttgctgcacccatcaacccatcatctacattagatatttctcataatgctgtccctttcccagtcccccacccctgcagtaggccccagtgtgtgatgttcccctctctgggttgatgtgttctcattgttcacttcccacttatgagtgagaacatgcactgtttggttttctgctcctgtgtcactttgctgaacatgagggtttccagcttcatccatgtccctgcaaaggacatgaactcatctttttcatggctgcatagtattccacagtgtctatgtgctacattttctttatccagtctatcactgatgagcatttgggttggttccacatctttgctattgtgaacagtgtggaggccattatcttaagtaaattaatagaatgctgcgtgttctcacttataagtgggagctaaatgttgtgtatatgtagacacagagaagggaacagatattggggtctagttagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccatcatttgcaccagcaattccaagactgggcatctacccaaaggaaaagaagtcattctaccaaaaagacacatgcatggtaaagttccttttttttgtttgttttttgagatggagtctcgctctatttcccatgctggagtgcagtagcaatctcggctcactgcaacctctgcctccagggttcaagtgattctcctgcctcagcctcttgagcagctgggattacaggcatgcgccaccatgcctggctaatttttgtatttttagtagagacagggtttcaccatattgaccaggctggtctcgaactcctgacctcaggtgatctgcccaccttggccctccagagtgctgggattacagtgcctggccctgtaaggttcatcacagcacgacttacaataggaaagtcatggaatcaacctagttgcccatcagtggggtaccggataaagcaaaagtggttcttctacagcatcgaatactacacagccatgaaaaagaacaaaatcatgtcctttgcggccacatggatgtagctggagggcattatgcttaatgaattaacacaagaacagaaaatcaaataccacatgttcttgtctggataaagcaattgtggcccttctacaccatggaatactgcacagccatgaaaaagaataaaatcatgtttttgcagccacgtggacacagctgaagggaattatgcttagtgaattaacgccaggaaaagaaaatcgaataccacatgttctccactagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaacgccaggaacagaaaataaaacaccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttgggtcacggatttttctgttgcattttcttgcttgtttgttttctatctctctctctctcttttttttttttcttttttttgagatggagtctcactctgtgacccaggctggagtgcagtggtgcaatctcggctccctgcaacttctgcctcctggattcaagcaattcttctacctcagcctcccaagtagctgggactacaggcacctgccaccacacctggctaatttttgtatttttagcagagacggggtttcaccatgttggccaggctggtctcgaactcctgacctcaggtgatctgcctgccttggcctcccaaagtgctgggattacaggcatgagccactgcacctggccctcttcttatatatttctagaactcctctcgaatttggggtttgtttttcttaattacaaggaatcaagttgaatcattagtgcatatataaatatacattttattttagtacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcctcacgcccaggggacactcagaatgtcgtttgcagaacacgggttgtttttcttagaaacgccttgcaaaacaaaataggaagcaaaatctttctcactccttccactccataatagacaaaataaaatgagggggcaggaatccagagactttgaccacagttggcagatttattgtggtacagacatgaaggcaagcagtgttctctctgattctacgaaccgtacagcccgggccagctgccttctgctttctggatggtgcaggcgtgagctccaagcccaaatttcactggagctccaagaatcgagcctggcccaggcactcactgcacgggggccaagcgtgaaaccagtgatcgctccagcaaggtaacaggacagcttggtgatccttcttgccggccacaaaaggttatagccagaattccaccgaatgtggtctttctgtgtctctccccagatagtgaagctgcacaaacctgggggtggggggtggggggtgctgacctcagtggggtgtcctggagaggcaggaaccagagtttacagggtgcagatcctactgaagcaaatggacgtggcatccgtgggcagagctggctgtggctggccttccagcctggatgtctcccccccccccgcctggggtgtcaccaaatgcacccagagaccccttctaaacctggggggatgtgctgacctcagtggggtttcctggagaggcaggaagctgggtttccagggtacatatcctactgaagcaaatggacgtggcatccttgggcagagctggctgtggctggccttccagcctggacgtctcccccactgcctggggtgtcaccaaatgcacccagagacctctcttctgaaagcccattcatgggaagcctccaggtctcctcagcaggcagcatcacgtctgatttcactgcgttatcaggtaatgcaggcctgttctacctgtgtgcgtgagcgcgtgtgtgccgtgtgggagtgtgtgtgttgatgtgggtgtgggtgtgtgcttgtgtggctgtgtgtgtgtgcctgtttatgtgatgatgagtgtgtctgtgagtctgtaagacaacgtgtgtttccatgcgtgtttctgtgtgagcgtgcattcctgtgttttatggaagtgtgtttttgtgatggtgtttttgtgtgcacctgcgtttatcgtatttgtgtgtttgtgaatatgagtgtatgtgtgtgaatctgtatggcaatgtagaaattcttttttttttttttttgagacggagtctcgctctgtcacccatactggagtgcaaaggctcaatctcagctcacagcaacctccacctcccgggttcaaacgattcttctgcctcagcctcctgagtacctgggattacagacacccaccgccacatctggctaatttttcttttttgatatggagtctcgttctgtcacccaggctggagtgcagtggcgtgatcttggctcactgcaacctctgcctcccaggttcaaatgattctcctgcctcagcctcctgagtagctgggattacaggcataagccaccacatctggctaatttttgtatttttgagtagagatggggtttcaccatgttggccaggctggtctggaactcccgacctcaagttatctgcccgcctcggcctcccaaagttctgggagtacaggcgtgagccaccttgcccggccccagtgtgtgaatttttatgtttgtgtgtctacatgattatgtgagtctttttgtgactgtgtttccatgagtgtgtgactgtatttatgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcctaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttaatataaacatgatttttatagttcatataaataaagttatatatagtgtatatgtaaaatatacttttatttgtgatacataattttatagattaaattttatatactaagcaaagttacatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgtgtgagtacatcagtgagtgtgtgaatgtgtgtgcatgtgtgcctgtgtttgtgtgagtgtaagagtgttgtacatttatacactcacattttgttttctggttaataacaagatctatctttgatttaggatatgaagaattcttataagcaaccccccacacaaaatttgtatttattttaaaatattcttaaaatatgggttcttttatttttgcacaaacagacaagagtgttttttctttccaaaacttttatttcaaattctgaccctgaggagcagaaaaagaagaaaacattgtgtaaccttatatacattagaaacataagtagttactaaatgcaatacagattttgacaacatgcatttaggaaaaatgaggaattcaaactcgtagctgcctcaatattgaactttctaaagtttaattttttttaattaaaaaatattcatttgggttcaatatgtatggatctccagggcagaaatgtctctccaaaaagtgaaccactctgaaaatcaccgtcatttgggaaagggtgatgccccagctgtcttctgaaaaatagcagaggcttccggccagtggggtgtctctctctttccctgaggccgaaatgtcagggaatttttcttccccacccctaggagcccagtaaatgcagaatatttcagaaggatttgcacagggtcccggcttctgctatttatgagctccatggattcttggctcaggcttgtgatcagctcacctgctccagaatcacttcccatcttagcttctgggctaagacacctcaaaaccagcaaaggaaagtcctcactggtcaacgcgtccatcccaactcccccatctccccttagggtgggtttggggttcgggactgctttactgttcctttcaaagcagactgggaggtaagattttattctgcttccagaggttcaggatttctgcagacggtcagcaactctttgcatcctactggtaaaagttttatatactttgtatttatagaaatacgcattgtgtatattttatatgaatagattgatataaattattttagtaacttaaccatatgacttttatatttttatataaataaagttatatgtagtgtatatgtaaaatacttttatttctaatacataattttatagattaaatttaatatattaagcaaaaatatatgtaacatatataacatataacatcatttctataatatataacttaatgtaaataagtatataaaattgatattatatttgttaatacataattatacatatatactgtgtaaaaataaaattacatattgtatatgcataattatatttctataagtacaattatatactatgtataattatgtataaaataattgtataataaaattatataataaattttgaaacgttataaattattatacatagtattttattgtattaaatttagaaatgtgttatatgtaataaaattttattataataaatgtagattatataaaatcttatttataataaattaccttatgtataattataatatgagaaaataattacatatcattgtattataataaatttagagatgttatacattattacatataaaatttcattatattaaatttagaaatatatgtaataaaatggtattatgttaaaatttttatgtaacattttattatacatgtataattttatataatgttttataatatatagaatataagtacacagaatataagtacaaaaatatttatatacagctacacgtaatataaatacatcagtgtaagatgttttgtgtgtgtgagatggagtctcgctctgttgcccaggctggagtgcagcaacacgatctcgtctcactgcaacctctgcctcctgggttcaagcgattctcctgcctcagcctcccgagtagctgggattacaggcatgcaccaccacacccaatcaatttttgtatttttagtagagatggggtttcactgtgttagccaggatggtctcaaactcctgacctcaggtgatccacccgcctcggcctcccaaagtgctgggattacaggcatgagccacagtgtaagatactagctattaaaaaataaatatatatatatactgcaacagctgatttgtctggaagagtttggtcagaagacagtgtattaagaagactgtgagttcccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacagcataaacataaagtacaaaaatatttgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatattatataattaatatattctatgctatataatatataatatattctatgcaataaaatatatagcatatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatatagcaaccggtgatttgtctggaagactggtcagaagacagtgtattaggaagacaggcagtctccgcaggaagcatggtgcaggtgggatctggaggtgactctgggctgccagaagacgccccactgctttgcggcagacacaggtggagaggtcctctctgtagcttcagcatggacagtgtgtgtgtcttgctgtgggaacacttctttctgcttccctctccactgtgaccccatcacactcactgacctgccctcctccttcctctcgctctccggggcccctgtggaaagagggtcttccctccgtgcagcaggaacccccaggaccatccccatgctcctgggttctgaacttcagggacatatgatcctacctgaccgggcacaggctctgttcaccctcaggaacccctgtcctcccaggccaccgtggactggagaactggcctcctgaaaatccagagagaacttagcactcacaacttctttctttttttcttttttctttgagactggatcttgctcttttccccaggctggagtgcaatggcatgatctcagctcactgcaacctcctcctcccaggttcaagcagttcatcctgcctctgtctcccgagtatctgggatcacagtcatccacccccgcggccaactaatttctgtatttttagtagagacggggtttcaccatgttggccaggctggtctcgaactcttgacctcaagtgatccacccgcctcggcctcccaaagtactgggatgacatatattagcatgatgtatattcttctattcctccggggactcactgtcttcttgggcagtaaaccactgtgcccggacttctctgtccacatctgcacacatctaaacctctgtagattctgaattgtttttccttttgcacagaatgagaggaactgaagtcgggaggcccagccccaacacggtccctgtggctctgtgctcaggtggtttatggctgagaaggacttggggggttgagggcttcctatcagcccaggagacattacctgggtctgggaagcctgctctgcacttgtgggtctcgaattgtctgttgcatttacctgcctcattattttttcttcctgtctctcttcttacatatttctttcgaatttggagcttgtttttcttaactacaatcaacttgaatcattactgcatatataaatataaattttatattgagtagacattatatactcaatctactacacattccaacacgggccatatctaagacgaatatttatatttaatgtttaaaatatgtttacatttcatatagaaaaatatatttatatttaatatatatgtgtatatttaatacaggaaatatatatttatatttaacatataaaaatatatgtttatatttaatatgggaaatatatgctttgtttaatatacataatacatgttgatatttaatatagaaaaggtatagttatatttactatgcaaaatacatgtttatatttaatatagaaaatatgtttatatttaatgtacaggatacatatttacatttaatatagaaaatacatatttatatttaacatacacagtatttatatttaatgtataaaatatgtttacatttaatgtgctgaatatatgcttatatttaatgtctaaaatgtctatatttaatgtactgtatacattaaatgtaccaaatgtattcttatatttaatgtataaaagaagtttatatttaacatataagatatgtttacatttaatgtataaaatgtttatgtttgatgtataaaagatgtttatatttaacgtatacaatttatatttaatgtaccaaatatattattatatttaatgtccaagccagccaagccagtcagccaagccagctaagccacccacccagccaagccagccaagtgagtcagctagccagccagccaagccagccaaaccagccaagccagtcagccagccaagccagccaagccagccagccagccaagccagccaagccagccaagcaagccagccagccaagccagccagccagcccaggagccccagccagccagccaacccaaacagccaagccagccaagccagccagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccagccaagccagacaagccagccaaccagccagacagcccagccagacagccagcccaggcagccaagagacccaagccagccagcgaagctggccaacccagccaagccagtcagccaagtcagccaagccggccacccagccaagccagccaagccagccaagccagtcagccagccagccagccaagccagccaagccagtcagccagccagccagccaagccagccaagcctcccagccagccaaaccagccaagccacccagccagccaagccagccaagccacctagccagccaggcccgccagccagccagccagcgagccaagccagccaagccagccagcctgccaagccagccggccagccaagctagccaatccactcagccactcaagccagccaagtcacccggccatccaagccagccaagccagtcagccagcccagacagccaagccagccaagccagccaagcccgccaaccagccaagacaggcatgctagccaagccagccaggcagcgaagccagccaagccagccagcaagcaaagccaggcatgtcagccaagccagccaggcagccaagccagcaaagccagccaagccagccagccagccaagccaggcatgccagccaagccatccagccagctaagccagccggctagccaagccagccaagccacccggccagccaagccagccagccaagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagcccagacagccaagccagccaagccagccaagcccgccaaccagccaagacaggcatgctagccaagccagccaggcagcgaagccagccaagccagccagcaaggaaagccaggcatgtcagccaagccagccaggcagccaagccagccaagccagccaagccagccagccagccaagccaggcatgccagccaagccatccagccagctaagccagccggctagccaagccagccaagccacccggccagccaagccagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagccagcccagacagccaagccagccaagccagccaagcccgccaaccagccaagacaggcatgctagccaagccagccgggcagccaagccagccaggcagcgaagccagccaagccagccagcaagcaaagccaggcatgccagccaagccagccaaccagccaagccagccagctagccaagccacccagccagccagccagccaaaccagccaagccacccagccagccaagccacccagccagccaagccagccaagccaatcagccagccaggcagccagccacccagccagccaagccagccaagccagccaagccaatcagccagccaggcagccagccacccagccagccaagccagccaagccacctagccagccaggcccgccagccagccagccaggcagccaagccagccaagccagtgaagcccgccagccagccaagacaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagccaagccagccagctagccaagccacccagccagccagccagccaaaccagccaagccacccagccagccaagccacccagccagccaagccagccaagccaatcagccagccaggcagccagccacccaagccagccaagccagccaagccagccaagccacctagccagccaggcccgccagccagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagcccgctggctagccaagccagccaagccacccggccggccaagccagccaagccagccaaccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccagccatccaagccagccaagacagccagccagccaagccagtcaagccagccatacagccaagccagccaagccaggcaagccacccagccagccaagccatctagccatcaagccagtcaggccagccagccagcctgccaagccggccacccaccaagccagccagccatccacgccagccaagccagttagccagccagccaagccacccagccagccaagccagccaagccacacagccagccaagccacccagccagccaagacagccaagccacacagccagccaagccatccagccagccaagacagccaagccagccaagccatccagccagccacgcaagccaagccagccagccagccaagcaatccgtgccagccaagccatccagccagccaagcgaggtgtccggccaagccaccccaccagccaagccagccagccagccagccagccagccaagccacccagccaactaagccagccaaaccacccagccaggcatgccagccaagccacccagccagccaagcctgtcagccagcgaaccagccaagccagccatgccagccagccagccaagccatacaagccagccagccagccatgccaggacgagactccatctcaaaaaaaataaaaaaaaaacagcctggccaacatgatgaaaccccgtctctactaaatgtataaaaaattatctaggcgtggtggcacacgccagtaatcccagctactcgggaggcccaggcaggaggatcgctttaaccagggaggtggaggttgaagcgaaccaagattgcaccacctcattccagcctgggcaacagggtgagactcaatctcagaaaaagaaaaaaaaaaaggccagcctggccaacacggtgaaaccccatctctactaaatatgaaaagaaattagctgggcgtggtggcacatgaatgtaatcccagctactcgggaggcccaggcaggaggatagcttgaaccctgggggtggaggctacagcgagccaagattgcaccactgcactccagcctgggcaacagggcgagactccatctcagaaaaaataaaataaaatagaccagcctggccaacagggtgaaaccccatctctacaaaatatacagaaaaattagctgggggtggtggcacacacctgtaatcccagctactcgggaggcccaggaaggaggatcgcttgaatcagggaggtggaggctgcagcgagccaagattgcaccactgcactccagcctgggcaacagagtgagactccatctgaaaaaacagaagcattccagcctggccaatagagcgagactccatctcaaaaaaaaaaaaaaaaaaaaaaaaaacaccagcctggccaacatggtgaaaccccgtctcttctaaatatacaaaaaaaatagggccaggcgtggtggctcatgcctgtaatcccagcaccttgggaggccgaggtgggtggatcacgaggtcatgagatcgagaccagcctgaccaacatggtgaaaccccgtctctactaaaaatagaaaaattagctggatgtggtggcacatgcctgtaatccctgctactccggaggctgaggcaggagaattgcttgaacctaggaagcggaggttgcagtgagccgagatggcgccactgtactccacggtggtgtcagagtgatactacatctcaaaaaaaaaaaaaatagctgggtttgatggcacacacctgtaataccaggtactcgggaggcccaggcaggatgatcacttgaacccgggagggggtggttgccgtgaaccaagattgtaccactgcactccagcctgggcaacagggcgagactccatctcaggaaaaaaaaaaaaaaaagaccagcctggccaacatggtgaaaccccgtctctactaaatataaaaaaaattacctggatgtggtggcacatgcctgtgatcccagctgctcgggaggcccaggaaggaggatcgcttgaacctgggaggtggaggctgcagcgagccaagattgcaccactgcactccaccctggataacagaattagactctatatgaaaaaaaagaagaactccagccagggcaatagagtgagactccatctcaaaaaaaaaaaaaaaaaaaaaaaaagaccagcctggccaacatggtgaaaccccgtctctactaaatacacaaaaaaattagctgtgcgtggtggcacacgcctgtaatcccagctactcgggaggcctaggcaggaggatcgcttgaacccgggaggtggaggttgcagcgaaccaagattgcaccactgcactccagcctgggcaacagagcgagactccatctcaggaaaaaaaaaaaatatcagcctggctaacatggtgaaaccccgtctctactaaatatacaaaaaaaattagctgggcgtggtggcacacgcctgtaatcccagctacccgggaggcccaggcaagaagatctcttgaacccagaaggtatatgctgcagcgagccaagattgtcccaccgcacttccgcctgggcaacagagcgagactccgtctcagaaaaaaaaaaaaaaaaaaaaaacaagaacaggttggccaacatggtaaaaccatgtctctactaaatatacaaaaaaattagttaggcatggtggcacacgcctgtaatcccagctactcggaaggcccaggcaggaggatcgcttgaacccgggaggtggaggctgcagcaaaccaagattacaccactgcactccagcctgggcaacagggcgagactccatctcagaaaaaaaaaaaaagaccagcctggccaacatggtgacaccccgtctctagtaaatatataaaaaaattagctgggcatggtggcacacggctgtaatcccagctactcgggagccccaggcagtaggatcgcttgaacctgggaggtggaggctgcagcgagccaagatagcaccactgaactccagcctgggcaacagggtgagactccatctcagaaaagagagaaaaaaattaaaaaaagaccagcttggccgacatggtgaaacctcatctctactaaaaatacaaaagtattagctggccgtggtggcacacgcctgtaatcccagctactcgggaggcccaggaaggaggattgcttgaacctgggagtttgaggctgcagcgagccaaaattgcaccactgcactccacccgagtgagactccatctgaaaaaaagaactccagccacggcaatatagcgagactcaacctcaaaaaaaaaaaaaaaaaaaaaaaaaacaccagcctggccaatatggtgaaccccgtgtctactaaatatacaaaaaaattagctgggtgtcacggcacacgcctgtaataccagctacttggtaggcacaggcaggaggatcgcttgaacccgggaggtagaggctgcagtgagccaagattgcaccactgcactccagcctgggcaacagggtgagactccatctcagaaaaaaaaaaaaaacaaaaagagcagcctggccaacatggtgaaaccccgtcaatactaaatatacaaagaaattagctgtgcatggtggcacacgaatgtaatcccacatactcgggatgcccaggaaggaggatcgcttaaacccgggaggtggaggctgcagcgagccaagattgcaccactgcactcgagccagggcaacagggccagactccatctcaaaaaaaaaaaaaaagaccagcctgggcaacatggtgaaaccccatctctactaaatatacaaaaaaattgctgggcgtattgctacacacctgtaatccccgctacttgggaggcccagacaagaggatcacttgatcccgggaggtggaggctgcagcgagccaagattgtaccacagcacttcagcctgggcaacagagcgacactccatctcagaaaaaaaaaaaaaaaaaaaaaagaacaggttggccaacatggtgaaaccccatctctactaaatatacaaaataattagctgggcgtggtgacacacacctgtaatcccaggcaggaggattgcttgaacctgggaggtggaggctgcagccagccaggattgcaccactgcactccaccctgggcaaaatgtgagactccatctgaaaaaaaagaagcattccagcccgggcaatatagcgagactccaactcgaaaaaaaaaaagaccagctggccgacatggtgaaaccccatctctactaaatatacaaaaatattagctgggcgtggtggcacatgcctgtaatcccagctactcgggaggcccaggaaggaggatcgcttgaacccgggaggtagaggctgcagcggagccaagattgcaccactgcgctccatcctgggcaacagagtgagactctatatgaaaaaaaagcactccagcctgggcaatagagcgagactccatctcagaaaaaaaaaaaaaaagaaagaccagccttgccaacatggtgaaaccccgtctctactaaatatacaaaaaaattagctgggcgtcatggcacacgcctgtaatcccagctactcggtaggcccaggctggaggaatgcttgaacccgggaggtggaggttgcagcaaaccaagattgcacctctgaacgcctgcctgagcaacagggtgagattcaatctcagaaaaaaaaaaaaaaaaaaaaaaaagagcagcctggccaacatggtgaaaacccatcaatactaaatatacaaagaaattagctgagcatggtggcacacgaatataatcccagctactcgggaggcccaggtaggaggatcccttgaacccgggaggtggaggctgcagcgagccaagattgcaccactgcactccagcctgggcaacagggcgagactccatctcaaaacaacaacaacaacaacaacaacaacaacaaaaaacagcctgcccaacatggtgaaaccccgtctctactaaatatacaaagaaattagctgggcgtcatggcacacgaatgtaatcccagctactcgggagtcccagacaggaggatcgcttgaacctgggagttggaggctacagcgagccaagattgcaccactgcactctgctctgggtaacagagtaagagtccatctgaaaaaaaagaagcactccagcctgggcaacagagagagactccatctcagaaaaaaaaaaaaaaaaaaaaaaaaaaaaaagaccaggttggccaacatggtgaaatcccgtctctactaaatatacaaaaaaaattagctggacgtggtggcacaggcttctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctcagaaaaaaaaaaaaaaaaaaaaaagaccaggttggccgacatggtgaaaccccgtctctactaaatacacaaaaaaattagctgggcgtggtggcacatgcctgtaatcccagctactcgagaggcccaggcaggaggatcgcttgaacctgggaggtggaggctgcagcgagccaagactgcaccactgcactccggcctgtgcaacaaagtgagactccatctgaaaaaaaaagaaacactccagcctgggcaatatagcaagactccatctcaaaaaaaaaaaaaaaaaggaaaaaagagcagcctgtccgacatggtgaaaccacgtctctactaaatatgcaaaaaaattagctgggcgtggtggcacacgcctgtaatcccagctactcgggaggcccaggcaggaggatcgcttgaacccgggaggtggaggttgcagcgaaccaagattgcaccactgcactccagcctgggcaagaaagtgagattccatctgaaaaaaaagcactccagcctgggcaatatagcaagactccatctcaaaaaaaaaaaaaaaaaaagaccagcctgtccaacatggtgaaaccccatcagtactaaatatacaaagaaattagctgagcgtggtggcacacgattgtaatcccagctactcgggaggcccaggcaggaggatcgcttgaactcgggaggtagaggctgcagccagccaagattgcaccactgcactgaaccctggacaacagagtgacactccatctgaaaaaaaagaagaactccaaccagggcaatggagcgagactccatctcagaaaaaagaaaaaaaaagagcaccttggccaacatggtgaaaccccgtcagtactaaatacacaaagaaattagctgagcatggtagcacacgaatgtaatcccagctactcgggaggcccaggcaggaggatcgcttgaacccgggaggtggaggttgcagcgaacaaagattgcaccactgcactccagcctgggcaacagagcgagactcccactcagaaaaaaaaacaaaatgaaaaaaaacaccagcctggccaacatggtgaaacaacgtctccactaaatatacaaaaaaaatagatgggcgtggtggcactcatctctaatcccagctactcgggaggccaacgcaggaggatcacttgaacacaggaggtggaggctgcagctagccaagtttgcaccattgcactccagcctggcaaaccaagccagccaagccaaccagccaagccagtcaagcgacccagccagccagccagccagctaagccacccaaccagccagcctgccaagccagccaagccagccagccagccagccggccaggcagccaagccaagccagccaagccagctagccagccaagtcagccaagccagctagccagccaagtcagccagccaaaccagccaagccacccagccagccaagccacccaagacacccagccagccagccagccaagccagccaagccacccagccagccaagccagccaagcaagccagccaagccagccaagccagccaagccaggagccagccaagccagccaagccagccaagcctgccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagcaagccaagccagccagccagtcaagccagccaagccagccagccaaccaggccagctaaaccagccagcctgccaagccagccaagccagccagccagccaggccagccagccaaacaaggcaccgcagccagcccagccagccacacaagccagccaagtcagccagccagccaagccagccaagccagcccgccaaggcagccatgccagccagccagccaagccagccaagccagccaagccagccagccacccagccagccaagccaggcagccacccagcaagccaggccagcctgccacccagccagccaagccagacaagccagccaagccagccagccacgcagccagccaggacatccagccacccagccagccaagccatgcaagccaacaagccagcccagacagccaagccagccaagcaagccagcaagccagccagccaagccagccagccaaaccagccaagccacccagccagccaagccacccaagacagccagccagccagccagccaagccagccaactagccaagccagccaagcaagccaccagccaagccagccaagcctgccagccagcagagccagccaaccagccaagccagccagccagccacttaagccatccaagcaacccagccagccaagccagccaagccaccgacccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagcctgccaagccagctagccagcccagacagccaagccagccagccagccaagccagccaagccagccagccagccaatctagccaagccagccaagccagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccgccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagctggccacccagccaagccagacaagccagccaaccagccagacagcccagccagacagccagcccaggcagccaagagacccaagccagccagcgaagctggccaacccagccaagccagtcagccaaaccagccaagccggccacccagccaagccagccaagccagcgaaccagccagacagccctgccagacagccagcccaggcagccaaaccagacaagccagccagccaagccagccaagccagccagccagccaagacaggccagccaagcaagccatggaagccagacagccagccagccaagctagccaacccagccagccaagctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaacccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagccccaagccagccagcaaagctggccaaaccagccaagccagtcagccaagccagccaagccggccacccatccaagccagacaagccagcaaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccggccaagccactcagccagccaagatggccaagccacccagccagccaagcctgccaagagacccagcaacccaagccagccaagacacccagccagccaagctagccaagacacccagccagcgaagccagccagccagccagccagccaagccagccaagccacccagccagccaagccaggcaaacaacccagccagccaagccagtcaagccacccagccagccaagccggccaagccacccagccagccaagctggccaagtcactcagccagccaagccagccagccagccaagccggccaagccactcagccagccaagatggccaagccacccagtcaagccaactaagccagccaagccacccagccagccaagctggccaagccactcagccagccaagccagccagccagccaagccggccaagccactcagccagccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgaagccagccagccagccagccagccaagcctgccaagccacccagccagccaagccaggcaaacaacccagccagccaagccagtcaagccacccagccagccaagccagccaagccagccaagccacccagccagccaagctggcaagccactcagccagccaagccagccagccagccaagccggccaagccactcagccagccaagatggccaagccacccagtcaagccagctaagccagccaagccacccagccagccaagccagccaagccactcagccagccaagccagccagccagccaagccggccaagccactcagccaaccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgagaggcagctaggcagctagccaagcctgcccagccagctcgagccagctaagccaggccaagcaagctagccatccaagcttgacaagccagccaagcatgccagccaagccagcgcagctggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagccagccaagccagccagccagtcaagccagccaagccagccagccaaccaggccagctaaaccagccagccagccaggccagccagccaacccagccaccgcagccagcccagccagccacacaagccagccaagtcagccagccagccaagccagccaagtcagccaagccagccagccagccaagccagccaagccagccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagccagccaagccggccaagccagccagccagccaagccagccaagccagccagccagccaagccagccaagcaagccagcaagccagccagccaagccagccagccaaaccagccaagccagccagccagccaagcgctttacccgaacgtccgtgaggcagtgagagccaaagcagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaacccgccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaacagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagccaacccagccagccaagccagccaagccagccaagccagtcagccagaaaagccagccaagcctgccagccagtcaagccagccaagcctgccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccggccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagcctgccagccaagccggccaagccagccagccagccaagccagccaagccagccagccagccaagccagccaagcaagccagcaagccagccagccaagccagccagccaaaccagccaagccagccagccagccaagccacccaagacacccagccagccagccagccaagccagccaagccacccagccagccaagccagccaagcaagccaggcaagccagccaagccagccagccagccagccacccagccacccagccagccaagccagccagccacccagccggccaggccagcctgccacccagccagccaagccagacaagccagccaagccagccagccagccagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagacaggcatgccagccaagccagccaggcagccaagtcagccaagccaggcagcaagcaaagccaggcatgccagcccagccagccaggcagccaagccagcaaaaccagccagccagccaagccaggcatgccagccaagccatccagccagctaagccagccggctagccaagccagacaagccacccggccatccaagccagccagccaagccggccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccaagccagccagccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccagccaagccagccaagccacccagccagccaagccagccaagcaagccagccaagccagcgcagccaggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacccaagccagccaactcagccagccagccaagccagccaagccagtcagccagccaagccagccaagccagccaagccagtcaagccagtcagccagccaagccagccaagccagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagccagccaagcctgccaagccaaccatccagccaagcctgcaaagccagcccgccagcaaagccagccaagtcagcctgccaagccagccaagacagccagcaagccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccaactcagccagccagccaagccagccaagccagccagccagtcaagccagccaagccagccagctaaccaagccagctaaaccagccaagcctgccaagccagccaagccagccaagccagccagccagccagccatcccagccagcccagccagccaagccagccagccacccagccggccaggccagcctgccacccagccagccaagccagacaagccagccaagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagccaggcatgccagccaagccagccaggcagccaagccagcaaaaccagccagccagccaagccaggcatgccagccaagccatccagccagctaagccagccggctagccaagccagacaagccacccggccatccaagccagccagccaagccagccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccacccagccagccagcccagccagccaagccagccagccagcccagccagccccgccagccagccaacccagccaccgcagccagcccagccagccacacaagccagccaagtcagccagccagccaagtcagccaagccagcccaccaaggcagccatgccagccagccagccaagccagccaagccagtcagccagccaagccagccaagccagccagccagccaagccagccaagccagccaagtcaactgagccagccaagccagtcagccaagccaggcaagccagcaaagtcagccagccagccaagccagccaagccagcccagccagcccagccagctaagccagcccagccagccagccaagccatccaagccagccagccagccagccagcccagccagccaagccagcccagccagccaaccaagccagccagccagccatgccagccaagccagccagccatccaagccaaccaagccagccagccaagccagccaagccagccaagccagccaagccacccaggcagccaagccagccaagccagccaagccagccaggcagccaagccagccaagccagccaagccagccagccaagccagccagccagccaagagagccaagccagccatccagccaggccatccagccacccagccagccaagccagcctgccacccaaccagccaggccatccagccacccagccagccaagccagcctgccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagcaagccagccaagccagccaagccaggagccagcccagccagccaagccagccagccacccagccacccaagacagctaaaccagccagcctgccaagccagccaagccagccagccagccaggccagccaagccagccaagccattcaagccagccagccagcccagccagccaagccagccagccagcccagccagcccagccagccagccaacccagccaccgcagccagcccagccagccacacaagccagccaagtcagccagccagccaagccagccaagccagcccgccaaggcagccatgccagccagccagccaaaccagccaagccacccagccagccaagccacccaagacagacagccagccagccaagccagccaactagccaagccagccaagcaagccaccagccaagccagccaagcctgccagccagcagagccagccaaccagccaagccagccagccagccaaaccagccaagccagccagccagccacttaagccatccaagcaacccagccagccaagccagccaagccaccgacccagccaagtcagccaagccacccagccagccaagccagccaagccagccaaaccagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccaaccaagccagccagccagccaagccagccggccagccaagctagccaattcactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagtcagccaagccagccagccagacaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccagccaagccacccagccagccagccggccaagccactcagccagccaagccagccagccaggccagccgggcaagccattcagccaggcaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccagccagccaagccagccaagccagccagccagccaagccaggcatgccagccaagccatccagccagctaagccagccggctagccaagccagacaagccacccggccagccaagccagccagccaaggcagccaagccagccaaccagtcaagccagtcagctagccaagccagccaaccagccagccagtcaagccggccagcctgccagccaaccaagctggacagacagccaaggcagccaagccggccaggcagccaagccagccaagccactgacccagccaagccacccagccagccaagacagccaagccagccaaaccagcctgccagccaagccagccaagccatccagcctgccaagccagctggccagccaagctagccaatccactcacccactcaagccagtcaagtcacctggccagccaagccagccaagccagccagccagcccagagagccaagccagccagcccagacagccaagccagccagccagccaagcctgccaagccacccagccagccaagccaggcaaacaacccagccagccaagccagtcaagccaaccagccagccaagccagccaagccacccagccagccaagctggccaagccactcagccagccaagccagccagccagccaagccggccaagccactcagccagccaagatggccaagccacccagtcaagccagctaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccagctcagacagccaagccagccagccaagccagccaagccagccagccagccaagccggccaagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagcaagcaaagacacccagccagccaggttagcaaagacacccagcagggagccagccagcaagccagcgagccaagctgggcaaggccaccaagcgagcccggcagctcagtcagtcacagaggccagcagaccgtggtcaagccacccagccagctaagcagatctacgcacaagctctccaagccactcagccagctaagctagccagcagtcaagccggccaagccactcagccagccacggcgccaagccacgcagtcaagccagccaagctagccaggcagccaaggcagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccacccagccagccaagccaggcaaacaacccagccagccaagccagccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccaaccagcaagcaaagccaggcatgccagccaagccagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccagccagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccaagccagccagccagcccagacagccaagccagccagcccagacagccaagccagccagccagccaagccagccaagccacccagccagccaagccagccagccaaaccagccaagccacccagccagccaagccacccaagacagccagccagccagccaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccggccggccagccaagctagccaatccactcacccactcaagccagccaagtcacccggccagccaagccagccaagccagccagccagcccagacagccaagccagccagcctagacagccaagccagccagccagcaaagccagccaagccagccagccagccaagccagccaagccacccagccagccaagccagccagccaaaccagccaagccacccagccagccaagccacccaagacagccagccagtcagacaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagccagccaagccagctagccagcccagacagccaagccagccaggcagccaagccagccaagccagccagccagccaagctagccaagccagccaagacagccaagccagccagccagccaaaccagccagccagccaagccagccagccacccagccaagccagccacccagcaaagccagccaagagacacaagccagccagcaaagctggccaaaccagccaagccagtcagccaagccagccaagccggccacccagccaagccagccaagcctgccaaccagccagacagcccagccagacagccagcccaggcagccaagagacccaagccagccagcgaagctggccaacccagccaagccagtcagccaagccagccaagccggccacccagccaagccagcaaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagtcagccagaaaagccagccaagcctgccagccagtcaagccagccaagccagccagccagccaagcggccaagccgcccagccagccaagatgccaagccacccagccagccaagcctgccaagagacccagcaacccaagccagccaagacacccagccagccaagctagccaagacacccagccagcgaagccagccaagacagccagccagccaagccgccaagccagccagccaagcaagccatggaagccagacagccagccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccaagccagccagccagccaagcggggggagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccgcccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccagccaagccagccagccagccaagccaggcatgccagccaagccatccagccagctaagccagccggctagccaagccagacaagccacccggccagctaagccagccagccaaggaagccaagccagccaaccagtcaagccagtcagctagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccagccagacagccaaggcagccaagccagccaggcagccaagccagccaagccactgacccagccaagccacccagccagccaagagagccaagccagccaagccagccaaaccagcctgccagccaagccagccaagccatccagcctgccaagccagctggccagccaagctagccaatccgctcacccactcaagccagccaagtcacccggccagccaagccagccaagccagccagccagctcagacagccaagccagccagccaagccagccaagccagccagccagccaagccagccaagccacccagccagccaagccagccagcaagccagccagacagccaagccagccagccacccagccagccagtccagccagccacccagccagccaagccagccagccatccagccagccaggccagcctgccacccagccagccaaggcagacaagccagccaagccagccagccacccagccagccaggccagccagccactcagccagcccagacagccaagtcagccaagtcagccagccagccaaggcagccaagccagccaaccgaacaagagagccagccaaccaagccagccaagccagccagctagccaagccacccagccagccagccagccaaaccagccaagccacccagccagccaagccagccaagccaatcagccagccaggcagccagccacccaagccagccaagccagccaagccatccaagccagccagccagccagccagccaagccagccaagcctcccagccagccaagccagccaagccacccagccagccaagccagccaagccacctagccagccaggcccgccagccagccagccagccaaaccagccaagccacccagccagccaagccagccaagccaatcagccagccaggcagccagccacccaagccagccaagccaaccaagccatccaagccagccagccagccagccagccaagccagccaagcctcccagccagccaagccagccaagccacccagccagccaagccagccaagccacccggccatccaagccagccaagccagtcagccagcccagacagccaagccagccaagccagccaagcccgccaaccagccaagacaggcatgctagccaagccagccaggcagccaagccagccaggcagcgaagccagccaagccagccaggcagcgaagccagccaagccagccagcaagcaaagccaggcatgccagccaagccagccagctagccaagccacccagccagccagccagccaaaccagccaagccacccagccagccaagccacccagccagccaagccagccaagccaatcagccagccaggcagccagccacccagccagccaagccagccaagccacctagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagccagccggctagccaagccagccaagccacccggccggcaaagccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccatccatccaagccagccaagccagccaggcagccaagccagccaagccagccagccagccaagccagcgaagacaccgagccagccaaacaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccggccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccgctcacccactcaagccagccaagtcacccggccagccaagccagccaagccagccagccagcccagacagccaagccagccagcccagacagccaagccagccagccagccaagccagccaagccagccagccagccaagccagccaagccacccagccagcccagacagccagcaagccagccagacagccaagccagccagccacccagccagccaggacagccagccacccagccagccatccagccagccaagccagccagccatccagccagccaggccagcctgccacccagccagccaagccagccaagccagccaagccagccagccacccagccaagccagccacccagcaaagccagccaagagacccaagctttttcagccaccagccatcactatcctcttgttttcaaacaggattgggatttgattatttcaaacccttcatgggattgaaactttgtcttaagtcagtgactactacatttccaagtactttcgaggagacatattttcatgtgtttttttgcatagctctggatttcaacttacacacccagaaatgtcacctttagaggcccctttgttgagtacatttgatctcaagtattccaggtctggggatggatctagctggaaaatgttcagacactgaagtttctagagcctgaagatgctcccctatcaggtaccaggaccagccagatctcattctctgactctacataacttctgacaaatgaaatgaagtttccgtttttggccaaccatggagcctgctccgtgtctgatattcttctttgaagactgaggatgtgacctgattgttctctgcctcctttttctagctacatttttttttttagctggttctcacacgggctttccatggcctctctctgattgtggggactggccgtttcccaggcacagcaccttggcctgggggagccgtgagaactgatgagtgtcttttgaaggagtcactgggcttctgcaatgggaggatcttggtgtgtggggagcgtgggaacttttccttttgttggttcaggaatgaaattgttgtgtaaatggaccaagagacctaaggaaagggacagtccttttggctggtgggtcctctccactgatagatccaaacaacagagtggaaaatgtaccacaagaagactacgctcgttgcctggaactcagtagcccctgtggctggtgttggcacttgccttaccagtgtgagcctggttttcccgatcatttggccttccacaataaggacaatttaagagattatttctcaatgttaactacttccttgattaattttgtgatctacctttctcctttctgaccagtagtagaatccatttatgttttcaagatgttgctacttaggatacaattatttctaagaaatacaagtgacattgctttgtagaatgggaaccatgttctacagccctgcaaagacctgtcctgagagagctggggggacgcaggcttggaggaggtgagggcaggcactgagtgggtggagggaatcaaacggctgccagaataaacatcagatggagctcctgggcttcttgaggggtagaatttcctctgagctctctacaagacctcagccacaaccattcatctacttaatacattgaagcaattcacataaaaagccagacagatttttttctctgaatttaaaactggatttagagactagattaataaatattgtctttgtcatgtgagtcactttggagagaatcatgtccccactgtatggcaatgcagcagatcctgaccatgcatatttagtgtgtccttcctgctctcttgggcagaccatcccatcaggctatagcacggagctctcacccatctccctgctctgccatgcaccctccttcttgcctgctctttcttctccctatggccagcccctccagccaacatactttttatctctctttgttttgcaaaatccttttctcctatcacttccatcataaaactagtatttggcaaacaatcacatgtcggcataaagctcttaaattgacctgctttagattaaagcacaatatgggttttatagtttgcctcaggtgaccatttaaatgtcttgaataatgaaatgaaaaactggacagactaaaataagagtcctgtctgcctgtgacagtgaagaataagagtcctgtctgcctgtgacagttaaagaatgatccctcattgcctctcacacagctgcagtcagggttcccaccaccctttctgctgattctgaaatcagccctagttcataaattatcagggaatttggtgagttttctcttttaatgtcagtctgtttatttgactggtagtttctggccttaacacatcccactaatgtgttgtttagttgagcacaataataaatagaacttttgtttacttttacatccaaagataaatgttgagtgctattaaaaacttttctaacatagtaggcctccaatgaggaattttccttcagcaaatcataaaactgggtctagaagtgccaacccaagtaaaattactgatgaactaatcatagttgttatttttccttcatcttttcctttttttttttagacaatcttgccctgtcgcccaggctggagtgcagtggcgtgatctcggcttgctgcaagctctgcctcctgggttcacgccattctcctgcctcagcctcccgagtagctgggactacaggcgcccgccaccatgcctggctaattttttttgtatttttaatagagacggggtttcactgtgttagccaggatggtctcaatctcctgacctcgtgatccgcccaccttggcttcctaaaatgctgggattacaggtgtgagccactgcgcccggctccttcatcttttctatgtgctttgtttgacacttattgaggatacagttgctgaagaccagctgagtaggacataggctctgtcatgcattaactcatccacccattcatttattcactcatctattgagcatctgctatgtgtcaggctctatgccaaactttctgttcaggagccaatatatcaataactacagtgtaagctaagtcatgcaatgaaagacttagagaatagacaccaagttgaatattaacccaagtaaattattggaagatatattagttatctaaaataggcttaaaacaataaacatttattatcacaatttctgtaggtccagaatctggacatgacttagcttgatgtttatggctcaagacctcttgaggtttcaataaaggtgttagtcagggctgcagtctcatctgaaggctcatctggttgggggtggtgtctgtatctatgtggttattggcaggccttggtcctcactacactggaactcttcaaagggttatctcatgacacagaagctagctttccccagggtgaagaatgtaaaagaatgtgagaactcttaagacagatgctatagtcttttctataacttaattttggaagtgatattccatcacttctgccatattctttgttagaatcaagtcagtaaatccagcccagattcaagtgaaaggattccacaagagtgtgagtaccaagaggtagggatattgggagccatctgagaggctgcttaccacagagggccagccagttaggaagtgggttcagctgctgctgttaacaggctcgacctaagtggcttaaacacagaagagttgttgttgttgttgttttttctaatgagaaatctggaggcagtcagttgctggccttggctcaaaggctgagggcactgtggttcttgtagcctttcgcttatggccctaagctgctggaactcttgccatcatgtctgcattccaagcagcagaacaacaagaaaagaacagggggagaagagaaagagggcaccagcccactgactatcctgttcatcctgggaagtaccactcaacaagctcaactctcatttccacagccatctccagctgctcaggagtctgggaaatgtaatcacatgcaccattatccccaagtgcaccactgcctccagcccctttccacctttcagttatagccataaacatccagttagccataaacattcagctaatgcatgtgcagattcttgatctacagaaattgtgatagtaaatatttattgttttaagtctatcttagatcactaacatatcctctacttaacatttcacttgggttaatattcagcttagtgtctattctcaagttttccattgtatgtcttcgttcgcactctcctcattgaaatattggctcctgattagaatgcttgagtactgttcttttataccaccaagcctgctcctcaagccgattttgtgccccgcaagccagcgatggctctattaatggttgtccttgtcttttatgagttcatgtgactgggtgggggagattcaacacccaccctcatgctgctcactctcaagtaaacaagtaagccaacattagagtctcagggctatgaatgggagcacagaaatcacagtgcaacctcccaagtacaggtcaggaagcctggtttaaatatttgaaagcaatttgaggaagttcccagtgggaaatgaacttgagaactaggtcattcatatgtccattcaacatctaccttctgcttatctggagtgtgcatggcactgcctggggccactgcagtgaataagagagatgagaacccaggcaactccgagagacccagtcccacctgctttgctggcaggggcttaggatgcagtcactttccattaaagtcagagtcctggagtcccatctgctttgcttctgcattccctacaatgatgagtggttaggagtccaggtctcagagaaagactgtctaggtgtgggtccccaccttgtcacttctgtgtccccttgtgtgagctgctggacatctctgggcctcagtttcctaatttataatgtggttgcctgtcagaggattacatgagaagatgcatattgcttagcgtagtgccaagggcatagtaatagcccaacacttattaaccacgttgatgatggctatggagatgatggtgatgatgacaatgatgttgatgatgacaatggtgatgattatgattcagtttctattctaagatgtggttacagtttcctaactttgggagatatgcctatctgtatatatcacggcatagtctctttctcttattgtagagaaaacaccttcacattatagatgcaccgcttggccttcctatctctcagtgtagaggagactctggaattcctcttgactggtccagatgcccacaaaattctacagacaagcagcaccaaacttaagagcatacatgtgatccaaaatattcttttaaagtcaaagctgtcattgcatttttccagaaataaaatgataaaaactgtgcacaggactgcttatcatacttaactcttaacacagctgacctttaaatggcattaagagtaccaacctgagttctgggtcctaggaaccaggaggagataaaagattaagaaatagggaaggagagcccgggtgtggtggctcacgcctgtaatcccagcactttgggaggctgaggcgggtgcatcacctgaggtcaggagttcgagactagctggccaacatggtgaaaccctgtctctactaaaaatacaaaaattagctgttctgcagacttgggtctagaggtgatcagtttttccccagccaaagcccaagggcagccttgctcctctctccctcccctggcttatgttcccctgtgtatgactgtgtccctccagcccatgacctatagagaatgcagaccatctctctgccagtgttggagaccagatcccatggaagggcactcatgtccagcctggggccccctgccttggcagacactactagttgacataatccagctacttgggaggctgggacaggagaattgcttgaacccaggagtcagaggttgcagtgagctgagattgcactgctgcactccagcctgagtgacagagtgagactctgtctcaaaaaaaaaaagaaaaaaaaaaaaagagaaagaaacagggaaggaaaaatgactggaagaagatgaatatgctgagccacattctgagattgagaagtctatctatgatcacttgcacctcttctcttctgggtagtgtctacttccccacgtccctctgccattcttttgctgaagccatgcccaccttaccatggggtgcagggcagtgaagaagcagcaagctgcgaaggctgagccatacctggaaagagtgactgctaagtgcgtgtgtccctggaggcatttgttccttcacaaggaaatggttgtgaactcaaactgggttctaattgtcaacattcaagggagttggcaaaaagagtcattattcaataaactataccaaatactacagtatgtgcctggcatgttgtagatgctggagacacaggagtgaacaaataagcaaagcccctgccctgtcactgcatttctgcagaaaagatgttttgcttcagggaagccaaatcgctcaccaggagcctggccccgagtccactcttggggtcaacacccagggctgcccagtgggctgtgtctgctgtccccccggtcctagcccacaggctttttgaaatctccagtgtgctcgccatgaggaaagcaggggtgaagtctgctgggcagcctttgtcatgtctgtgattaaggacgactcttttctggaaattaaaatgagcagtcctgctatctcaccgtacaatcactggcatagtttacttttttattctgtgtctggattttccccctggggctgcagcagtaagcctgcttccttggttcaaagccagtgtgtgtttctgcaagaaagaacttctggatcagcagggccccttaacaggctgcaagctggctcttgagagggagcaggcagccaaacaatatttggcctgtccttcccctccatgccagccttagttctggttcctgctcagtaggcaaggggcagcccaggacttcagagggaacctgataacttgtctttgtgtgattaaggctgggtagcagagcccactgagaaccagctatgcttcaccataaaaatagaacttagctctgggtaccagggagttttaataatgtggaaaaatgcttatgttgtcatgttaagtgaaataaagtagagtcctaagcaatgtatacagtgtaactacaactctgtaaacagagagagagcagaaggaaatataggaaaatattaatagtgtgtggctttggaaggtgggattaatatgctctacttggctgggcacagtggctcatgcctgtaatcccagcactttgggaggctgaggtgggtggatcaagaggtcaggagttcgagaccagcctggccaacatggtgaaaccccgtctctactaaaaatacaaaaataagccaggtgtggtggcatgcacctgtagtcccagctacttgggaggctgaagcagaagaatcacttgaacccgggaggcagagattgcagtgagccaagatcatgccattgcactccagcctgggtgacagatgagactgtctcaaaaaaaaaaaaaaaaaaatacgctctactcttctaattttctaggttatccccaggcagcatttataacttttataatcatacaaaaataaactttatattaaaatatacatattttgcatattttaatacttttccccagctttaagaatatctgataaaagaaatttatgttactctaacgagcagctgctatcttggttaattcatattttttcacaattaataatataaacattaaacagaaactggtgggagcaattgtccattgggtaatcagtgggcgaaactgcccatgaaatgaaagcaaaacaaaaaacaatatgaaaataaaaacaaaaaatccacaaactacatcagaaatgaatttcctctttgggacatgctgaaaaatatcctgggtaaaatcaaggtattttgcaattatttttcaagtaaatattgtacagagggacgcagtgatcaatgctgctttcctttactgctttgcaggcctgtctagaaactttagtggccagagaggcggcctgcaggctcagggataactgtcttgccaacaaggaacttgttaagttccttgttgcagtttcctactatgaaaatgtggggtagttttgtgggaaactgttagttccctagtcaatttctgaaagatctaagagaataaggaagttcaccaaatcgcaaattacggtggggttacagccacactgcagatttttacaatgtggtacccagagttgattaggatggggcccactgtatcaattacacttaacggttcgttgcatatagcagaaacctacaataacaaaggctcgaatacaagacattttattgtttcacataaaagaaatccagaggataatgggtctggggttacctggccactgctcatccctgctaactcaggctccttcgacctcttcaccctgcctctccccagtggtggccacccccagctgcaagggcgataacacacgtggagttgttctaggaagaattattttgtgcccagctgaaaatcaggggcttgattatcagggaagggggagaacacatgtggggttaggcaatcagcagtcactgccgtggccatgactggagcatgtcgaatgttctgaggcctccagggggtgcatggcagtctctcagtagtgtgcaacttggcctttctcgacccagaagcctataaacagataataaagcaataaattagctgccacacacagctcggtaccctacagtagaacaggggcaggataatagcaacagcaccaccattccaagaggagcagacaggaggcacacaggggcccctgcctagcaataaaccttctgagcatgcagtgggaggcctttccccctggttttctggtttatccctggggaacctctctactcactgtcctctggggcccctagcttgtgctcagagagaccctctggtctctcactctggatagctgtgtatgatatgggattagggacatgcccttagtggggtctgcacagctcctccttcccacttgctgctgctgaaggttggaggttccacagttgaatagtcgaatgcctttaaaaaaattgagatgtcgtggggcacagtggttcacgcctgtagtcctagcactttgggaggctgaggccggaggatcccttgagcccaggagtttgagaccagcctggaccatgcagtgagacctcagctctacaaaaaaataaaacaattagctggatgtggtggtacgtgcctgtagtcccagctactcaggaggctgaggtgggaggattgctttagcccaggaggtcgaggctgcggtgagtcatgaactcaccactgcactccagcctgggtaacagaaccaaacactgtctccgaaagaaaaaaagaaaaaaaagggagggcggtgaaattcaggtaacataaaattaccatttaaaaatgaacaaattcagtggcatttaggacaaccacaacatcgtacaaccaccacttctgtctggttccagaacattttcctcaccccaaaaggaaaccttgtactcattaagcaattattctcattcccacctccccccccagcccctgacaaccgctaaactactttctatctgaatggacttgcctattctgaatatttcatatcaatggaatcatgtagtgtgtgtccactttgcataatgtattcaaggcttgtccatgttgaagcatgtattaatatttcattctttttatggctgaataatattccaatttatccataaaatatatttttaactcatggtttctttgacaattcaggatccacaaaaacacagtcagcttctgacctagttgcttctcatcagctccctggctgcagtcacactgaattcttgccaagacctatgcctcagacctgctttattgcttttcttttgtgccccttccctcactctcatttgatggaatggtggctaccttgactcttcccggaacaccatatggcaaacgccagtcctttcccttcatctcattctgagccgcttcagaccttgaccactcaaaggccagcacagtctcatctctaatatttgggctttataagcagtcgacttttctgactttgcaaagccctgaatttctgaactctattcctttcctaagaacaacaattccgttgacttctaaacagcattggttgcatcaccaaggggaaaaaaataaaccaaaaaaacccaaaaaacccaaaaaccccaaacctctgccagttaaaccatgtcatgccgtataaagcaagtgccattacaatgtgaaaaagaaatatgcaccgcagagttgacgacgtgcagtaaaacagtaccgatatgaatggctgacattagttgaggttctacgctgtgtcaggcattgtgaatcttttgagagagatgtcagaattgttatctttcttttacagaggaggcagtggaggcagagtgaggttcacacccagcaaccctcactcagaaggcttctgcttgggtagagcttgcattggccaaacctcatccacttgccattcattcagtcattcagtgacaagtgtttatggtcacctgtgggagtgtgtgtgtgggaagggtggaaaatttccctcttggtgttttcaatttagtggaggagtaaagccttgcagcaaaatatgaaagatcattcaaacattagggactcaagtgaacgcaaaggagttggggaaagttccgcttaggaagtgacatttgaatctggtcttcaagacgaagaaggaatttgcttggagagaggggctggaggagaaatgagcaggctgggggtggggggagcacaggtgtaggcagggagaaaagaaaaggggcttttggtttgagaccctgcgaggaggcagcatggaggaaggggctgcagggagctttggggttggggagaggatgcagctggaggagtccctgatgtcacttgggtattattaatgtcaataatcagcttatatagaatgaccttctcactagaataaacagtcataactgtggtgctttaatcaacatgacagcattggagaatctactcaaactcacttgggtctagaggggatcagtttttccccagccaaagcccaagggcagccttgctcctctctccctcccctggctcatgttcctctgtgtacaactgtgtccctccagcccatgacctatagagaatgcagaccacccctctgccagtgttggagaccagatcccatggaagggcactcatgtccagcctggggccccctgccttggcagacactactacttgacaacagatacccctctccccttcttgcttaatttaaaaaaattctatttcagatggcattgtgtcagttgaaagatcacattttctagactagtctgcagctaggtgagcccaggtgatctagttccatatgtggaaccattatgtggaattttcagtaggctccgtcacggtgggaagagatggcgttacacatttttctgtcgtccctcacttcctcctactgtcaatatggggaatacggacttgctggctggagtgccagcaggcatcctgggctgtgaagccactttgaagatgaaagccaggctctgggatggtggatcaggaagacaggggcccaatttcctagcaatgctttggggctgcacccttggcctgtgcttcctatgccaggctacttttacatgaaagagaaaaagaagtcctgacttaatgcattgctgtatttttccagaaatgtgcagccagacctaatgataggtggtttagggtgggaagcagagtaagatgacagaactttaggaccacatgaagggaaggagagggtcccccaggaaagggtgcagtttgttagacagaacaatagcatatccgttacaaagagctgccatttgctgggcgctaagggcctggccctctgtgaacctcaccatctgcatcatctcacttcatcctcaccagggtgggggcatgaggactctctcatgaccagggctattctcaatttacaaatgaggaaacaaaggctcaggaagggctctttctcaaggccactgagttgggagctacgttccactctgggtctgtttgtttcagggacaaaccttgaagccacacaagggccccgagaaactgtgcagatgtgaaacccagagtggcccgatcagatctatgactttgtgtcatcacaaaagtgaaagaagcagttcacagaaggagtggagtgtgcaggtcagaggcaggaaggacaggcagacactgtgatgatgataggctgtgaagaggtgggcgatgcctgggatgggagggactgtgttggacccagtgctgacctgagaacctcctctcaggccctcagtcaggctggcccctgttagacatgagatttgactcactggttcccattaacagccactagagatgaatgcactctatcaagtccatgtctgattaaattcaacaactcaggagtagtggtcaggaagtgtgctgattttttttcaatacaggtaaagtttttaattatgaacttttcagagggcaaactcagattgcttagggtgtatttgtccttgtagtgtttttgagggagtcattaggggcatggaataattaagtgaaaattaagaagctatgaaagaatcactcagctaagaaacaagatggtagatcaggctccgtctgatctcttggcagtatgcattagaccaaagggttatttaggtgtcaaggattttgttttgccagttatcaagcctaagaaacttcccagttacatcaaatcaagcaaaatgatgaaggctatcatccacccttgcttacaacaaaaagaaaccacttataagttcttcccgttagccaaaactgaagaatttaaactgccttggctcttaataatagttttactttatggttttcttgctagtatttcaaatacatagtctgtcttcaccaaactagaaatagttgataccaagaaaaacgtgtttgcccggactgaatgatgtcattgcacactcacggaccatgcactctttagcagcacccatctaattccatgctgacctgccttctccatttgtaggataactgcaatactcagaagccggctggtggatcccaggcctctatcattcaattgccatcactgtacttggtggggcctcaaaggatgctccagatcccattttcctgcttctctttttgaaagcattgtctatgggtgctgcacccactccctgcagccaagctcctgtgcctcactcatggaggctgccggggccatctccctggtcaccatggcctccatgtggccaggtcagtgcatcctgctctgctcctgtctgacttgacctctcagcagtgctggcaggtggacctctcctgccttcttgatacgctcactccttggcttctgagcggtgattttcttggtgttcttccaacctcaccctcactggctgagggtgctgggttcccttctcatctttctccacatattctctctctctctctcatccaggccaggtctttaattccatctgtagaacattaactcttgaatctgcctctaatattgacttttcccaagaattctaagcctactcaacatctccacatggatatctgataggcacgtccaaattaagatggccaaaaccaaatctgggatttcacaccacccatctctgtaagtggcactcctcagttactcaaaccaaaaatcgaaggattatgcttgattcatctctctccatcactgccctcgaacccaatccatccaacaactctatctccaaaacattactcaaacaggtcctcatctttctgtctctgttacactcatcagaccccaaggggacccactgatctcccttggttccacttggtcctacacaagggcttcacacttagcagtaagagttatcctcagaggctgggcatggtggcacatgcctgtaattcccgcactttgggaggctgaggcagctggatttcttgagctcagaagttcaagaccagactgggcaacatagtgaaactctgtctctataaaaactacaaaaattagccagcagtggtggtgtgcatctgtagttccagctatttgggagactgaggtgtgaggatcacttgagcccaggagattgaggctgcagtgagccatgatcacgtcactgaactccagcccgcaacagagcgagaccctgtccaaaaaaaaaaaaaaagaaaaaaaagaaaagaaaaaaagaaaaagttgtcctcagaaaattcaagtcagatcatgtcactctcctgtttaaaagcctccagtgtctcctcatcacacctggcacaaaattcaagctccttccttgccaccttctccagccccatcccatcttctcttgctgttgcttactaagcagcagccatcctggggactcttacttgttcctttgtgtcttggggtcttggcgacagctgctctcttgtcctggaatgctgctgactggctcctggacatcattcagatctcagcttaaatggcacctctccagagtgaccttcctagatgacctgcccatctcaagtatttccctcctaccctatgctaattttttgcactgttcaattcactagcttgtacttttctcatgtacttattttctgtctcaccctcctagaatataagcttcacgagaacagggatcttttgtgccttcttcttgctgtgtcccaggacctgagttggagcttggcatctggtgtgtattcattaaagattagttgaatggttgagtcccaaacttactgtcttttgctccatgtgttctgatatcttctttattatggtctgctttgttgagtaatgtgttatgatcatcgagatttactcataggcactgagtttcaaaagatgatgcatatttagtgtatgattcatttatttaaaattctagacttttgactgcagcctgtgactcaaatactgtattggtggaaaaactttcaaatcatcaaccacacgtatttgggttttaccagctccatggcacatacgaaaaatagccagtacttagagattgttcttattatcatcctagacatttgtggatattaatttttaattcttatataaccctatgagtatgaaactcttatccccattttgtaaattggctgaatgtgtcagttctctaatgctgtgtaacaaattcctgcaaatggagtgacattaaaacaaaccccatctatgagttcacagttctgtggggcagaagtctgggcagactccactgggttctctgctcagggtcacacaaaccaaaatcaagatgtcaaaggggttgggttcatgtctggaggctttaggggaaaattgacttgcaagctcatcggagttgttggtggaatccaattccttctggctataacctagaggtatctgttttactgctggctgtcagctgggggttgctcttagtgcttaaagacctcccgaattcctgacacgtgaccttctcctgctttgcgtctctgacttcctcttctgctttcagccagagaaaacgcgctgcaattttttttttttttttttgagacaaggtctcattctgtcacccatgctggagtgcaatggcatgatcacagctcactgcagcctctctgagtagctgggactacaggcatgcaccaccatgtctggctaaatttttaattttttttataggtaaggtctcaccatgttgctagctggtcttgagctcctagattcaagtgattcttccgcctcaggcttccaaagtgttgggatttctggtgtgagccaccacgcctggccaatgccttgcttttaaagggctcacctgactgggtcaggcctactcatctattctccttattttgtggtcagttaacttggactttattatacttacaaaatcctcttgcagtattacctattattagtgtttgactgaaaaagcagagacaggaatcttggggaagtatctttagaattctgcccactgccctgaggttcaaagaagttaggtgatttatccaaggtcatacaaccagcagtggaaaccagattcaaatcaaggcattctggcccccagagtctatgaccttgaataataccctgcagtgtgatgagaatccagtgctgcattggaaattctgctgggcagattttctgacaatctgatgtagccatgcaggtgagacgcactgggctactttgttcataaggaccggaactatccatggtgccttgtctcctcactcccatcacctccgatgtaaccgaagacagacatgaccaaagaagtcaggactctgcttttcaatggattgaacccacggatgctgcaccattttccacgagtcagcagcaccatttccaggtttttgctgcccccagaacttggttacccctcaaatcctttcatcatcagcatgagtgaaatcaatgtgactcccattaacaagaatattattattgtgcacatgagaattaagcccaaaatgcaatctgtgctcacacaggtttgatgatggatggatgcagtggtgtgctggcagtgacttgttctgggttttggaactaatttgttcatctctgcccaactcactttcagtgagagcatgctggtagtttgcaattggcaattggggagaatttacactagagaaatcagcaaacactacaaatcagggtttgctttattcatttatatttgaagatgtgattgctaaacatttgccagcacacctctggatggatggatggtagatggaagcggtgagagccaagagagcttggggattccagctttcataaccagaagcatggacattcttggaatgcttatgggggtgtggagggaggacccccagcatcagcccaggagaatgagtcttgtgagctgggagatgaagtctctaaataagtgagaagggaggtgatttgagctaggaatcttggcaaatagccccagggcagaggcagaggggaggagaaaaaagaaccatcagagccaggaagatcagtggaaaactggaggcctcacagaaagcaagggccttgcttgagcagaatgatgcctcttgagtttcttaaaaaggaaaaggtaggggtaaggggctgtttaatctattaatacttcagcccactctcagcacccaaataatagggtgggtgcatcaaatcttggtagccatatacataagaatacttgtaggggttgtttaatttagggccttataaagacaataaaatgacttattgagaatcactaaaccaacacccaagtatttaatgaaaatactttttagctcatatagcttgagacaccaaactatgactatgtaaatagctataccatgtttatagattggaagacttaatgtagtaaagaagtagattctacacaaattcattgataggtttactgcagttcctttcaaaatccaagggggggacattttgtagatacaaatgaactgatactagaatttatatagaaaaaaaccaagaatagccaaaataattttgaaaaaagaagaataaagttggaggaaacatactacctgattttaagatttaacatatagctgtattaatcaagattgtggtgttgggaaaggaatagactggtagattaatggaacagaattgaaagtccaaatataaatgcacataatatggccaagtgatttcttttttttttagacggagtcttactctgtcgcccaggttggagcgcaatggtacaatctcggctcactgaaacctccctcttccaagttcaagcaattctcctgccttggcctcccgagtagctgggactacaggcgtgcaccaccatgcctgtgtaattttttctgttttagtagagatggggtttcaccatgttgcccaggctggtctcaaactcctgacctcaggtgatctgcttgtcttggcctcccaaagtgctaggattacaggcgtaagccaccatgcccagccagccaagtgattttttttacaaagtcccaaaaacaattcaatggaggaaagatagactttttaacaaatggtgttttattggatatcctcagtcagaaaactcctcaatctaaacctcacatattgtgaaaaattaacttagaattgataatatgcctaaatataaaatgtaaaactctaaaacttttagaataaaacaggagaaaaatcttcattactagagttaggcaaatattccttagaagacctaaagcactatccataaaaaaaagataacatcaactggatttcatcaaaatacttttattctgcaaaatatattgttaaagaggatgaaaagaccagatatagactgggagaaaatatttgcaaattacatatttgatctaaaaagttgtacctagaatgtataaaggtggctctaaactcaacagtaagaaaacaaagaatccgattaaaaagtggagaaaagaatgagcacacggaaagatgctcagcatcattagtcattagggacatgcaaattaaagctatgaggagacaccatgactcacatgttagagcagctaaactaaaaatactgacaataccagcaggggaaaggatgaggatcaactggtctctcatgcatacattgctggcggaaatgcaaaatggattgtatggtcactttggagaaagtttgacagtttcttataagggtaagcatacagttaccatatcacccagcagtaaattaactatttactttagacaaaagaaaaacttacatccatacaaaaacatgtacacagatgtttacagcagttgtgtttgtcacagccaatgtggaaaacaaaacaaatttccctcaacaggtgaatggatgaacaacctatggtatatccataaaatggaatagttctcagacatcaaaataaataaaatcccacaacatcaccaaaggagactttagtttcatctgtaatgttttaaggttttaagtagacagactattttcatgttctatttgttgttgaatttttaaaattgatgtttcttttattacaaagtatgaaaactacaagagcatatctctgtgcctggtcaatgtcctgtcatgtagatagattctccctcaccatagccaaaccctctctttgagcagtaggttctagccttctttctaccccaccaaattccttctcattctctcttgcatcatcaatttttctctttctaccaaattatttctatcaacaagtacacggatgggctattatttttcccatcttaacaaataaggaaatctctcttgacctcatttccccctccagctatagctttatttctagaaagcagtgtctgttctgtcttcaatttctttcccctttctctcctcactcaattcagagtttcaccccctcttccccagcaaatccttttttttgccaaatccatgtatacttttctgtctccaccttacatgacctttcagcagtgattatgcaggtgatcagtctctcctccttgaagcaccttcttcacttgcccttgaaggtcctacactctccaggcttcccttccacctcaccagcccttacttcccccactcccatctttgctggctcctcctcactccctgacctcttaaagctgcagggcagggctcagttcttgctttctttttctacgttcatttctgtggtgaactcatgcaattccctaactttacagactacattagatccaatttaagatgtcctcaattataagatgcaccattaagttaaagttccactaaggaagaagaaagcactgccaattaaactcttttcaaactctttttttttttttttttgatatggctctgtcacccaggctggagtgcagtgacagtcttgggtcactgcaacctccacctctcaggttcaagcgattctcctgcctcagcctccccagtagctgggattacaggtactcaccaccatgcccggcaaatatttgtatttttaagtagagacagggtttcaccatgttggccaggctggtctcgatcacctgaccttgtgatccacccaccttggcctcccaaagtgctgagattacaggtgtgagccactgagcccagctgccaatcaaactcttacatcctatcatcccaatttcagatgtctctttgttctcagagtccctaaactgctctggagtgagtgatgatgcttctccttcccagcacccctcttggggaacagggttcgcacccttccttctatctctttccttctaactctcttcatcacccagcctgtggaatccttatatgagcttgggatggtatcgcctgtttctacacctagctttgccacatatggttgggcacatcacaacttgtatggatttactccattgggttgtgcagtatataacctgtacaactatacattgttgcctgacttcacccattcctccaaggttttttatttttctctttataatactgtcttagtctattttttgttgctgtaactgaacacctgaggctgactagtttataaagaagataaatttatttttagcaattctggagtctgggaagtccaaggttgaggggctgcaactggtgaggggcttcttactggtagggactctctgcagagtcctgagatggctcagggcaacacacggtgagaggacccaccagagacggccaaagtggctttcatatgagacccacttttgtgataacccattaatccattaatttatgaatgggtccattcatgagagcagagccctcatgacccaatcatctccgaaaggccccacctctcatattgctccattgggatccaagtttccaacacatcaacttctgaggaacacatttaaactacagcaaataccttgtcctgaacttttgaaactttaaagcaagaaggagactctttagttctgtgcattcttccctgttatttcttgcctgaggcaatcgctgtagccttggggtttttgctccagttgggcacccctgagcttaccacggtggctagaaaaaacatgccctcactgacataggcctgggagcccatctaggagccattcacagtggcaaggggtggcccttattttgcatagccaatgagaagactcccctggctatgagggtggagtccatcttaaccaaatgtcaaggttgctgccaagggaggaggaatggaatgaatgtgggggaacccattgggtctactccacagtgtcaaaggcagggatagtattactgggatgaaagagacttgagcctgtgtttaggtctacagacaggaagcgattaaagacgttggaggaaagagcctaaatttggttaggagcaaaatcctagagaacaaatgaggtgtacgggggagggtctagatttgaaatgaaggcatgaaacttctcctggatggaggatgatgaagagacctgctttgaaggtgtaagcgaaggaagggatgtgagggcctctaacagtcttgtgtcctccaggtaggaggagcagcgcagctggagatattggtagtgtggacagcttcatggtactttctgggaagtgtccaatgtgtaattttaattggctcttttcattaaatagaattgatattattttaagagacagatcacttgaaaattaggattttgattcacttctcaaatgaagagaaagtgcctttgcctcatgtatgtgtgcagaatttgggagaatacatcatgagctcagggaatgtgtatgcgaagatgtttgaaaagtcacttgtgggaatttgcctggcttggtggttaggaatgtggactctgaagccaggaggcctgggctcacatccaggctttgcagccttgggcaggctcctgaacacctctgtttctttgctaaacagtgggcaggatatcactatttttggtatagacctactggaaggatcagaagacttaatacctgtgtgtgttttggagagttattggcacatattagatagttttactgtgaatcatcattatttataataattctctgacatgctggaatgtacactgtctttagaaatgaaatttgttttgttttcctaatttcgtgcaacctacatttttccagtgctattttctttggggaaagagcatgcagatgttccgtgttttcaatgtagcggtgtataaaatgtcatcattgtttcctttctggtggaatattaagagccagcttaaagataatctactcccagaaagttccatattagcaattatgtggggctggtgctcatatgcctcaatgaatgatttatttattagtatattgggaatggcctccctcttctcacactagcaccttttccccactttccagcccatttccaaatgagaagggctgaagtcaatcaggaattaagatttagcatttgtgggattatctttgaatgcgacactgggggggacacagtttcactcactctccatggtggcagtccaaattgctctttcgggaccctggctgtgtctaaagcctcagaatgatccagaaggctcctataacagtgccactgtggaagaaaccacttctaatatggcaggaaggtgtggccctgcttggagcccatgttttctaactatttcacatttctttctttcatccctggtgttattttttgaaattaatttttattttcagttctcctaggaattaatgagttaacttaataaaagtaaaagtcttcataaagaaggtaaaggctggctttccacatagagaacaaacataacaacccacatcctctgcagagctcctggtcaatgcattcttctagtggggctgccacacccctggggcctcaggcaagcaagccccttgtggatgacaggggctgggctcaaagcagtctctggggctgtgcctccttcctgttctccactcttttctctaaaggaaatgcactgcaatgaattgcacaatacagacattcctaaattctggaaaaccagcaggctttgaactctcctgggggaaaaaacccataaaacacaaaactgcaaggaatgagactatttggccaaatggccaatatgctacaactttcatagggaactcaccgcacttggtattgcctgatggaaaaaaatgccctgaatttcccaataaaatatttgagatgtggcaaaggaataaatattttttccctaagataaatctagctgtagatgaaaactgggtctcatgcctcggacaaaatattatttccttatttactctaagtctatatcagaatatagcctacacagcatcaggtactaagccaaaaaaggctccaagggcaccattgttcatccatgactttgactgtgtcaccccccagaaaccttgagttgggcagatgtaatcacagcagcctttggtggtttcttgagcagctgctaaggatcacatggattctgctcacacccagtgcttctcataatttaaaaatgcttgaagctgtgggaggctgcccagccctctgcattattcaaaagaaaaccaggaggcagcgacaattcttgattcttgcagataaacattctccaacaattattaagagttggattgctctaccttcatttaattccttggtgctttactatttgaatctagaatattcttgaagtctgaaagatggatagaaaagaggtaagtcatgtaaacttataaacagggcacgaaccccgctaacagacagctttgaagagatgatgattttagatcttgtgaattgttatgtcagaggaatacatgcagaagaaaacaggcaccgaaatagttattaccagagcaaagtaaatctgaacacctaaaagaataagaaaatatcttatgcttctctctactctgaactgccttgaaaagagcaagaatttcatacatgagcctgtagcacattacaaaatctgagtatgtatttgaaattcaaatgcacacaaagttcatgcattttattttccagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacatgaagcattgaatgctttatacgtctccatcctgattgtttaggctttgaatgctgagaagtatctgcactttgttggtcaattgtagatggtgctaatttgtggggagtttttcctgcaaattccccctgtgccataatccagaggacctccctctgcccccagtgctgtaggctaggcagctatgggcctggctcagggctgtcgggcaaggattggactctctataggttccgtttggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgctacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactcagccatccttagcactggcttccttcctccaagttatcttatgcttcaagaaggctgctggagctcctgccatcacttctgcattccagacagaagagaggaaggaagtggagggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataataggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtcttctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgtggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaaggttagctagggattctagaaaagctctctaaaggagactgacatgtaataggcttagcattttgcacctgaattctctccttccccctgtctggaatgcagacgtgatggctggagctccagcagcctccatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctttgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattatcatttatttgtggttttcctctgattttaaaataaatcaaaattaaaacacttttgcaggcccctaacagtatcatgggccccatgcactgtgcccagcatgcccaatggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattccccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcggtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcagcaaatgcacccagcaatgtctgattgatagggcaccctctgtgggctttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcatacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccacgagtggccactagtggaagcctcaatgtctccacttccagtgggctctcaggcctcacatgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagatttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcccagtgatgaagccaccgccagggctgagcctcagctcagccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccacatttcatttgctgacacccaggggcagcattaggtgtagagtgctggacatctaagggaagaggttcaattgtccatctgtttagttatttactcattattcaatgaatgttaattgagaccagtcagggcagctgagaagcagtgcggttgtgaggagggctgttagtaggggagatgcaggtgctggtgtgcttccgtgtatgaatatggcagctagtgcagggtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctctgcccccgaagtcatataagcatagccacgatgggaaggatggtcataactcaacatgcccattcatataccttgagcacatatcctgtcccagagactgctgaattattgcatgagccccagctccttccacaccaaagcccttccgactgcatggacctcaccacttctgttcaagctcttccttcttctcatggttcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtatatatatatcttttagagacaagatctcactctgtcactcaggctggagtacagtgaagcaatcatagctcactgcagccttgaacttctgaactcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgacttttttaaaaaaaacttttttttttaacctaagtagaactttgcattatcgttggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaacgtatcatatgatcaaatatgtgatagtgatcccacagacaaatggagcgtgtggggatgatttagacactcagccagccttgtcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacggatgcttttcagcatctcttgggatgaggatacagaatttctctttcaccctgtaaatgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttcagagtttctttatgcaaatacagtataagcaaaaaagaatgggcctttttcttttcttccttattttccacaaaatctatcaaaatgggttttttttgttttgttttgtttgagacagggtctcactctgttgcccaggctggagtgcagtggcacgatcacggttcactgcagcctcgacctccccaggctcaggtgatcctcccatctcagccttctgagttgctgggactacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtggattttgagctgctttttaaacaaccttctccttagcatagacactgacactgaagggaaagaaagcaaatggtctgttcttagtgggaaggcaacttgctttcaggggaacgagtttgggggaagaggactggtagaagacacgactaagaaagtgagtaggagtccagacgtgtgtgattcatcctttagggcctctgtgtgtgatgggttgacttgtgtgtcccaaaattcacatgtggacgtcctcgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtacaccatgtgaagactggacttaaacagctacaccaccagaagccgagagagaggctggaacatagccttccctttggaggtagcctggcccggtgggcactgtgatctcagacttccagccttcagaactgtgagacaatattttattgtttaagccacttattttttggtactttcttacggcagccctagcagatgctaatccagcgtgcgtcctgacagaggttgaagggggcttctcaagtcccaggtccagcttggtgtggttcagctactcaagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccgtgcgaggttggcggccgagccacggttcccatgtgagcaggacagcacagtctcacctcacacagagaacctcgcccgaacatggaactttcacccacgttgccattttcccgctccctttccctcctttgaggttcacactcgtctctccaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcaccttgaaaatccggtggagtcagttacacaagacataaccgcacacaaacatggcatttctgatagtataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacaggagtgggccaaagagaggcccatggatccctgcccacctcagaaatgtgagcaggcagctggggggcatttggactctagccgggacaacctagtggccgggcaggggatgcaggcaccacaggtcacagtggtttgctacgagcgtcagcttttaaaattttaaataatcctcttattgtaaaattgaggacattatttgaagcaacgcaaaaaccatgtaaaaaaatgtctgtaggatgtgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccagtcaggcatatttcctcccaatcctgtcctctctgtgtatttggtaattgcgtaaatcatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccttctttgctgaagagttagttttatggtaaaaatccaataaaattgtagctaagcactgaaaaaaagtaaagaattaagctcagcctccagaaatactgattttatatatatttgctctggggaagattggtttaagaagacctatagcctgttaattgcccttttataaattgcctccctatattttttgccctcttttcccctccctccctcctttattccctctgtctcttccctttcccctccctccctcccttcattcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcacatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgactcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgccggacccgtggccgatgttgatatctgctcggccggcctcacaggtgtgcgcgctgtgcagtcgcttagggcctcccctgcgcagaaggtcctggcttggtttaatgccctgctgttaccatcttaaaattcttaatggtttttgaacaaaggccgcacatgttcattttgcaccgctttgtaattacatgatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaacatgcttctagtcacctagcataggtctctagggggcctctgccacaaggcagggccaacgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaactctctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgtaaagaagcaccctacctgggagaaacttactgtctagttgtaaagaaagcaccagggggccatgatgcccatcccacccatgttcccacccaaactctcctaaacccacagctcccaaacaagttctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgttcgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcgataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcagaaggctggggacatgtgtgtagagtcccaactgtcagatcacagtgttgggttgggtctttcacctgcaggggcgtgtgtgtgtgtgtgtgtgtgtgtgtgtgtgtgtgtgtgtgtgtctgtgcacatgtgtgtgtgtgctgcttagagtttttgagcaaagtttggaatgatcaatgtgcagctttagaataatgacttggtgggaagaattgaagtgaggaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatatcacactgacattttgagaattcagaacagatggcaacacctgggcccctgcctgtgcagatgggccagaaaaacgtgacatgtgtgaaggtgggcatggggtggcagcagtttctctcgcccaagcattaagagtgttacagagcagaactgttattacggaattggtgaagcacctctgggggactccctctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggtggcccagcccggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaagaacaggagataatttaaacagccctgtggtttggaagtcacaggttctgctgcttcatgttcatgcacgagactaagagcctttgaagaagatcacttcctagaccaaggctttatgtttggattaaatgcagctcctccagatcatctcccgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattggaaagtaatgacattgaaaagaagtgaaaaaaatcacaggtatataattcagcaccaaattgatgaggacacagaggtgaactagaaaggcatcccagcggaaaccacttacagccccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtggatttggatgtgcagtggtggtccgggtgtgtggagtgggggtcagcatgtgcaaaggcatggaggtcagcaaaccaaggctgagagcacaagaggttcgctgtgtgtcttccagctgcccagtgagcacatggaggtaaaggtgcacaacttggtaagcgacaggagtttgtgtggatcaggcctgctgtgacataaatatgcaaatgatgtggtccctcgtggtagcaccctcaggatgacgcactcttctaccaaaacatggctgaaaatttttggtgtgtgggggtgtaccctgggagcccatttagaagctacagtgaaaagagccctcattgcttcagctttgagccatctgggccctcccacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcctgctcctggcacagtcttttctctgtacgtgctcatgtctgtgtcctgatttccttttcctagtagggccagtcaaattggattagggcctaaagtaattatctcattttactttacttctttaaaggccatatgtccaaatacagtcacattctggggtgctagaggttaagatttcaatatataaatttgcaggggacacatctccacccataacaatttgtttttcgtaatacgtttaaaatacccatttctgggctggatgcagtggctcatgcctataatcccagcactgtgggaggatcacttgagcccaggagtttgagaccagcctgggcaacatagccagactctatctataaaaaaaaatacacacacacacaaacttggccagatacagcggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgtagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcagcgattctgaccagtagtcaacaattgcaagtatgtggaatgtgattctcctgctttgggaacaagggagctcccagttttgtgggcaggatccgacattcccatcataagggcggcctcacctgtctgtacctctgacacctcagtcagagcccttggagtcggctaggccagttttggccctccttactgagacctagtcattctgtagacatacttcattctcccaggcttgggcttctggttcaacctgtggctctgtcattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatttttttttttttttttttttttttttttttttgagatggagtcttactctgttgcccaggctggagtacagtggtgtgatctagattcactgctacctctgcctcctgggttcaagtgattctcctgtctcagcctccagagtagctgggattacaggcatgcaccgtcatgcctggctaatttttgtattttcagtagagacggggtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtttgcatccctaagcctcaatgtcttcatctgtaggatggaggtaaccataatgcctgtctcagaggctgctgctagtgttaactgtgggacacaacacagagtgaggcacagacgaggtatgcagaaaacatcagcttcgtggttttttactcttctgcacttgctgtagcattctgcaaaactattattcctttcctagactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggcccagggttcctttgaccacctcacacctaacaagttccctcactgtctctcactctcccctgaagattctaagctgcctctgtcctgctaaaactgtagacctgagaatgaagtaaggtgcttcaggtgaggcttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcgctgagcctgggaggcagaggttacagtgagccaagatggcgccgttgtactccaacctgggtgacagagggagaccctgtctcaaaaacaaaaaacaaaacaaaacaaaacaaaaaccaaatacacacacacacacacacacatacacacacacacataaaagtctcatattttacacttatgaagttaggtgggttttttttgtttgtttctttgttttgttttgttttgttttgtacccaaaagtacataacctactactacctacctttttggtttttttttttttttgagatggagtcttgctctgtcacccaggctggagtgcaatggcgctatctcagcttactgcaacctctgcctcccaggttcaagcgattctcctgcctcagcctcccgagttgctgggattacaggcacctgtcaccacacctggctagttttgtatttttagtagagacaggatttcactatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctgatgtcttatggactcctgagaagtttgtggtggtgattcttagagctcagctcccgactgctggactgtcggtcactgggcagaaacagaactcagttctcatcacctggatgccgtttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcagtggctcacgcctgtaatcccagtgctttgggaggccgaggcaggcggatcatgaggtcaggagattgagaccttcctgactaacatggtgaaaccccgtctctactaaaaatacaaaaaattagccaggcgtggtggcgggcgcctgtagtcccagctactcgggaggctgaggcaggagaatggcgtgaacccaggaggcggagcttgcagtgagctgagatggcaccactgcactccagcctgggcgacagagtgagactctgtctcaaaaaaaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacacacacacccacacacacacacccacccacacacacccacacacacacacacacacacacacacacacatccaattgattctgtttctttggagaactctgactaacacagtctccttctcagtattaatgtttttttcttggacagaaaatatagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctctcaacaggcagcaggcaccttttccctaatgaactgtctttccaggtttcactcaagccctttctatcagacttctaccatgcagctctgccaatttctttaagcatctctcccttcttcctgactgtcctgaccaggaaactccctaatctctaatatctaaagtcatgaagccaattgcatcattagatgcgcagtatatataaataacatttacttacaagaatatttttatagaaatgtatgtaaacatacttacatacatttctataaatacatttaaattcctaaagacttgtttgagcaatttaaaaaaaaaatgctccagtttaacttcctactacaattaggaatttggggcagggtgcataattgccagtgtactcacagtgactgcaattagaatgtgctgtggagtcagaggaactgcctgacagtgccgggcagttgaccctgggctgggttcagagctctccagtggccactgagaagtaggagagtgtttcctgcacaatcctgatttcttgggggaggaggtactactgcacgctgctgggaggagcctctgaaactctcctgggccaggtctcctcccgtgcttcctctccctgaggcagcctcacctcttgacgcctgtccccagcacacccttctgtagctttcctctgactcacccctctgtgtgtctttctctccaactcggggtcctgtcacctaggcctctctcctttttcctaggtggctggcagttgctcttcccttggttttctctaatttgatctctttcccacccttccagtctgccacagtcacccttgatatccgcagaatccaccctccttggaagggatgaggaagggggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttatccagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcttaggggttggtgggcagactcattcatgttcccatcccaggggtgcaggggacccttctcccttccccacatcagcccagggccacagaagctcctcaggaggcaaggaagggaatggagaggacaagagtgcctacagagtgggaaggagacaagcattctcaggtatttatccagggtaagggcaagggcttttctgcagtccaggacattagaagagtcctgaaccaagaactccacccctgccccgatatcagctgtttttattgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtatatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagcctgggtgtactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattctaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacaattatctgaatctcataaataaaataatgattacagctgcatggaattattcaggtctaaattcatataaacatatccctaacaaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagagaggattgaaggggcccgaggctgtctgtcctctctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacctcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacacacacacatgcgcgtacacacacacgagcgcgcatgtgtgtgcacacacacacaaattagccaggtgtggtggcatggtaattccagctactctgggggctgaggttgggaggatggtttgagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacaactcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaatcacaagtggctctagcatttatgtattctatgatattgggactcgtgatataaataatacaaatgcttttacatgcataattcaatttatactatgttttatctttaattactggataataaaaacataactactctcaggaagtgtgggggattgtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgctcttcattctctataattaatatacttttcaccgtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaatgttccagcttctgggccaggttaattatctgaattatcttatttcatccttacattgggaaccagatgtccccaatgcccttcagtgatttttttggtggctttgaggaaaaatgaggcccagagaggttatgtaacttgtccaaagtcacacagcaggtagatttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttggatacacatatcaggtggcatttattgctgatgacagtaaaagaaaagtgtaaaacaagataatttgtttacatttcaagatacattaagtttttttttttttttttttttgagataagagtcttgctcggttgcccaggctggagtgcagtggcgcaatctcagctcactgcaacctccgcctctcgggttcaagtgattctcgtgcctcagcctcccgaatagctgggactacaggcgtgtaccaccacgcccggctaatttttgtatttttagtagagatggggttttaccatattggtcagtctggtcttgaactcctggcctcaagtggtccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacatgtaactctgggtgtaaagtgagtaaaaatatgagacttagaagaatatttcatcatggtatgctgactggggatttcacttactgatactagaaaggttttgcatttcagaacacgatgaaataggtaatatttatctgaaagacgcagacaagtggtggaggaaccagacacccccagtgccatttgctggcttttatcagacagaaagcagaaaggagaaacatgttttatcccatgagaaggaaatattggcttgatgcctaccatgcccagccttgcactagacatccaggtagctgctccatggagaagttcacagggtggtcaggatagcacagggaggaggtaatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgacttgtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacatgacaacatagcaagtaggtggtcatctacaagccaaggagagagggaggcctcagaagaaaccaccctgccaacaacttggtctcagacttccagccatcagagctgtgaggcaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccggagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatccacacccatggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaagggggaggcccatgggcagcagaggctcaacgaactccgtggcctgacttggccactaggttttttcagctcttcagccactgcctgtaggaggctagctggcattccttccttggcccttagcttgcatggatcggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaatctgagcctgaaggaaaataaattccttgagttgaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccatcttaattttccttataattgttgtgcaattataaaagacaatctgagggacccgccttgacagcctggggtaatatcactgggagtaggatctctcagaatgctaaggagcagatgcactaagagagctgcatttcactccattttattggatcttttggtatatacgtttctgtgactttagttcaatgggatggactgttgcataatactgagggctatatgaaggaggagtcgtctacacttgtaaaaaccttcttctttaggggtgggtagtgtataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggtgcctgtagtcccagctacttgggaggctgaggcaggagaatggcgtgaaccctggaggcggagcttgcagcgagcccagatcgcgccaccgcactcccgcctgggtgacagagtgagactccgtctcaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatgaagtcaagatatttcagatctgtcttctcctcctggcccagtttttaatgctttgaccccattctcaaataaactcaaccctcatgatcccgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcattccatcccctgtgtgagatggcggcagaacagttcctattcagacacctgccctcatgcctcttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttcttttttttttttttttgagacggagtttcgctcttgttgccctggctggagtgcagtggtgcgacctcggctcaccgcaacctccgcctcccgggttcaagctattctcttgcctcagcctcccgagtagctgggattacaggcgcctgccactgtgcccagctaatttttggtatttttagtagagacaggatttcaccatgttggccaggctggtctggaactcctgacctcaggtgatcctcctgcctcagcctcccaaagtgctgggattacaggcatgagccaccgctcccagcattttgtttgtttgtttgtttgtttgttttagacagagtctggctctgtcacctaggctggagtgtagtggcgtgatcttggctcactgcaaccttcacctcctgggttcaagccactctcctgcctcagcctcccaagtagctgggattatagtcacccaccaccgtgcccagctaatttttttgtatttttagtagagactgggttttgccgtgttggccaggctgatgtggaactcctcacctcaggtgatccacccgcctcggtctcacaaagtgttgggattacaggcatgagccaccgctcctgacccaaaatacctttttctttttttttttttttttgagacggagtctggttctgtcgcccaggcaggagtgcagtggctcgatctgggctcactgcaagctccgcctcctgggttcacgccattctcctgcctcagcctcccgtgtagctgggactacaggcgcccgccaccacacctggctaatttttttttgtatttttagtagagacggggtttcaccgtgtgagccaggatggtctcgatctcctgacctcgtgatccacctgcctcagcctcccgaagtgctgggattacaggtgtgagccactgctcccggccccaaaatactttctgatgctgataaaatgttttgtctactcttatgcccaaggaacagttcctcccttagcagaagttagtggttaaagcttcctctatgtttgccagtcaagaatgccacagggccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcagggatagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgctgtgattgttctgttcagttttagtccctcacagcactttcggccatttagaaagacagtatttgttctgctagagcatttgcaatctgtttctgattagcttaactggtcttgaccagtgctaagttcacacttcagctttgatttatgccgtctctatctgcagatatgtttcttgttacactatacaagaggaggcctcttcttattgacttcttattttcatgtgaacgaggtaataggtatcaggaataattagacaaggccatacgcgctaatgtcataggagactgagatatggagagtaaataataacaaaattcctgattactagggcatagaaaaaaaatcataggcaactccccaagttgataatcccaaatgtctaggcgtccttctcaaatagggaaacgtgacattaaaactactcaaaataaatgagactcagtggtatttataaccatagataaaaaagagcaagggtcctggggaactgtgccaaggcccagccctttgattcacaagtatccacaaaaacagactgtacgggctgctttcaagagaaaatgtggccatcaaggtcaacactggaagccctatggccactcattcattccatctcattggccctgagcctttcgaaaagtaggcagagaagaagcccaaagaacaacatggcaggcaggttaaggaagaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaatacaaattcttacaagatgttgacttgtacagtgtggcaaggaatactgtcatacagttgtgccaaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttttcccatttatacagacttttgttctgctcttagataaaatactaataaacaggaagttgaaaaaaaaatgtggtgcaattgttctgaatgttgtttttcttgcaaggctttatgggctacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcatagctgcaaagaaacctgaattgcccaggattaaccacctttcctttagacggtgagcagtgtgtttcacgaacacattacacattttagggttgtctatggaggtatcggcactttcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagcggtatttttggaacttgcccacccccgttcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgaacctcatcagcatatttttatttttgacatttcatattttagagtggattgaaaactaatttgatccatttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtaggggacttgggtggtgtaattttagaactttactgttgggttgttggcttgaaagatccattctcttctataaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctatgaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacaacaaatacataatcaacttcagtcatctcattttcaggggagttactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaggggttagattcatagagaaagaaattagagcagtggttactagtggctggaggcaagggggggaatgaggagttattgtttaatggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcctttaatctagacggttcacgagttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgatttttgtaggtggctcacaaaacaaatgtcagtagccattctatggccttggagtatcatttcccacaccttttctatggactgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcatggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagaaaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcagagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccaggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtgggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccttgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggctactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctcctcaggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctccgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattagggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctcgaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaaggcctttttaaagcaaactatggaaaataattgatgagtagcgcagttttataaaacttttttttctattaccctttaaaaactatgttgctaactgcacatcacactgcattcatatcctgggactaataccccttgacctctgccatatgaattaaggtgaaagaagggtcataagtaacaaagtttcaaagttgaatgaaccttttttttcctgtaattttactgaccatttccctttctgtttgagagatctgtgcggtcctgttgctgaggttctgtggttcaggggtgttatcggcgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccatgttcctggttgaggatacctgaaggtcgacatttatctgggatcttttgctgctgctttggtatgacttctatcaagatagctttcgacgaggtagaacgtttgctttcactctgggttttccttggtttcgacaatttttaagtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggtatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggcgacagagtgagactccgtctcaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcaatgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttagtggaaaacagaaaatgaagtgcaagagaccctcatttccggggcaagaattctgagttccttggcttctttcattcttgtctgactttcccccctccagttgcagttatttctagattttggtaaattattcattgcttttaaaagagaaaaagctcgattttctaaatctacagttgagctagccctaacctctaaagccagattgctttaacaaaattgtcatcattttatacatgacagattggcttcaaataaaatggtaaatgggaggaaaagtatattttgcttacacttaggaatgcctgtaaacgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaaggctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcgtgtttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctactggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcacctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttcattttcaatctgttgttgaaattcagcaaaacaaatattttaaaagccaagtcagctttctaccgttttgatctgaatatttaatgctttataaaataaaaccctgtgttttaattttaactagtttcattctttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattattctttttccaggaaaaaactgatgaggttgtttcagaatttgaatttactagaattccttttttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaaactcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaaaagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctggctgggacagccacacctgcagagagggccctgattggggtcgtggtcctgccccacatctggcaagcctgtgcctcatgtactcacagtcaccttttttatttgatccccatccatcctaagtccccaccccaccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaactattttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcatagggttgcagtgaggagggttgagctggtgaaaacacttctgttctcctatttgagagagatgcagcagaattcatggctgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaactgcagcctagagccagggtgctggaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaaatggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacgtaagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccggcttgagatggtcgtcttaacagagccttgctctgttgttgctcgtgatcagcacctggcatctgctgccaaagactctgcccacatcagagactcttgatgtctgtccggaacaggccaggacactctcatccacgttgctctcattggattggctcattaaccctttcttctatccccttctcactctttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacctggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgataccaatagcaccaacctgagagggctggggagatgtttgaaggaaagcttggctggggagctgtagctggcctgtggtacatgcttggtaactggtggccaggagacccgggtgtgtgtcctgggactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctgatgtgagtcaagaatggacaggctgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagctcgtggtcttcacttcctcctaccttgagacttactgcgcagaaagtagaggcttggatggttcaacttcaggggcaaaacagcctgccttgggggtgggactgggggtatgcatctgtgccactgcttctctccctttgtcagtttaccatgccagcagccttctgtctgttatcgggaacagaaagagcacgatttgggagctagctggggagcttcccgaaggttgcctgagctgcatttggggcccctgatgagggcttctattcagggtgatgtgtgtgaccctgaggccatctctcagatctggggggaagtgaggttgtgtacccacagtggggagacctacctggcggctcatcaatattagacacctgcaggaacagcaggtcagccaagccaaagagtaagagtggccctgtctgtgactagacgcttcttcagggttgcctcaacaccggagtggcgctggtggtctccacccactcccagtgtacgctggcgtctaggaagccatgtgtgtgatcggccctgaattaggggcaaaacttttagttctcagatgaactgtcgtgggtttattcagtgataactagacagccaggccaacatggagttgattcatccatgcaaaacctcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcgatttttcactgtcactagccaatgaggcctttaaggaaaaaacagataagactgtaggagtttatatggatccgttaactcacttgtacaagacattgggaaagatactgggggtgggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgcctttggccacatttcctaacaccactcagcagagccctgccagcaaaggtcattgtgcaaaaaatgttatgccccatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcgctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgtacctgggaggccatgtctcccggggaggctcaggacctcattgggctggaattccacagggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgctgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacaagtgtgtagcctagaagcaataggccataccatatagcctaggcaggtagtaggctatgccatctaggattgtgtaagtataccctgtgatattcgcatcacaaagaaattgcctaacgatgcatttctcagactgtatccctctcattagcaatgcatgattgtatctgtaaaaatctaaggcccagacctcagtcttttggtgttcattctgctggtttactcagtttgcatcgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactccactcgttggggttagagatggagaattagaaccaaagctgaatcactttctgcttatcactcatagactgccagattttcttttttttgttggagggaaagcaccttacaacaaataataatactattttgaatttcagagctttccctttttcaaagcactttaccacctatgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttccctttggttccatcccaggtttctaaccttgtgcctaaatttttgggggccctttcttcctcagagctttgtgtgatctgcaaatttggtaaatatgccttcatttaccatgtctctttccaaggtgggtttcaccatgttggccaggatggtcttgatctcttgacctcgtgatccacccgcctcagcctcccaaagtgctaggattataggcgtgagccaccgcacccaacctccaaggtgttttttaaatggtgaatgggacagaacgcaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactagggactcaggagcagcctggctgtctgcagcagctgcaaagggagcaaaggcaagcaggacttccatgagctaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggagtgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagctttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaatggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacccctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcacttggcatcccttcctgctgcagaccccactggaatctcctcagaaggggacactggtggcttccattggccctgcctcccgccagggctgtgtgaggatccacatgggctgggatgagggtggatgttgttctctgaaaactgtccactactcaaaagtgatgttgtggccgggcacggtggctcacaactataatcccagcactttgggaggctgaggccggtggatcacgaggtcaggagttcaagaccagcctggccaacatggtgaaaccctgtctctactaaagatacaaaaaattagccaggcgtggtggtgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaatagatgttgctgggtcaaaaagggagaggccccaccctggccccctagcaccagaatctgcatttcagcaagatcccagggggctgtcacagttgctagctctgctctttatgcttgcctcagctaggtgctgagtacctgctagaggtgtgaattcggtctttattcttcagaggcactggtcagagggtggaaacatcagacagggactcctgggcccccaggcaggactccatggggatggagcgggggatggaacatttgagaatcaccaacatgcagcaaggacattagtgagaaatgagttccacctgccagaagggaagctgagaagggaatgcacaaatcaggaaaatataccatcaaaaactacgactcttctacctccagccctcgccaccaattcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgacgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacgaaagtgtgcactcaagcatgtgtgtttggggtgtgtgggtatgggtgtgagacatggtcttatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgtggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggctttgggaggcaggaatctctgaatggatttccttcctcctgccctgcttggataggggcacttgtggatgcttctggctccaacttttgtgtgcagtgactatgatggagaagcaatgagctccctctacagccttctgggctgctggcatccccagtatgtttctccctggagacactctcagtgaggccaattccaggctgctgggggcttttccttctgtcactgtcgggcctccgcagggatctgcctggctgcaagatgctgatgggtggaggggtggcccacctggcctccagaagcaggagctccctgcccactgcccgcatggccctcagccctggccctcacctgttgcccctctggaagaacgttgctcttgttagctaacaaccacctgactttcctcgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaagccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacaggcactgcttcctctccctttgacaggcaggacagcggcccgctcccaaatctgcagggtcagacgtggtagatgaacagtgatttgcctgagtgtaaatattgtgatgtctttcttttcttgaacttttaaccttgctggtaaacagggtgcatccagaattgtttttctgagaactgagttttgaggaaataggggggaaaagggtttttattagctaattttcagtcttgtgcgtgactcaaaaccttcttattctgtttcttaactttgcttcaggagacacttggccaaaaaatagctttgtttttaattgatgaaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacctctgccctgtaatttcatgaattgttcaatgaagatgtgacttattggcttccaagcttcatggaggtgttgtccaaatacaaggtccataaagtgctttggaaggcttggaggaacaaagaaacactcttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcagaccgtctttcaaataatgctccagttggaaagtaaactgagtacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaagagtgttaaaacaggcagcttgcgggaagccaattgctaacattctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggctttactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatgcaagatttgttgagagtggtacatttgaggatttatttgtaggctgtgttaatatactttcgagaaattcagttgtatctaattaatgcttttttccctttgattcattccaaactatttaaattggaaaattgtgtgctatttgaagatgcacttcaaaactccttttgttgtcatggtgcctgttgtcactgctttttgttggttggttcttgtttctatagggcccctcctctttgggatcgtgtgggtacagatgagactcacagttccctagccagatgatctatagaagtttttcaaagactgcataggtagtgttactgaacatagttcatatgtggtgtgtgtttctaaccttgcaagctccttgcaaaactacataaatacttgtatttaagttgtgctgtgcatatgaacataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaaccgccgggcagggcagagggaagtagtgtctactttaaatctgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtctttaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagtcagtttgtttaaccaaactgcttaaaatgtcaacttagtttgcaaaacagccctatgtggttggtggtattatctgcaattcatcaccaacacactaggcccagggcaaagctaaaagcaaagctaaaaacaaagctaacagccagagtgaccagaactgggtctcacctctgctacacctgtgccagggagaggagatgaacactctaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccatctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacgtcaggaagagcagtgtagtcagagagcgtggcaaccaccattcgcctggtagacagctcattccatctgccttgcatattttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttccttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacatggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcccattcccagtctctccatgaacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaagaccagagagtaaacattttaggctttgctgggctgcatggtctctatcacaatggctcaactctgccattgtagcatgaagcagccaccggtaatacatagaggaatggcagaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagaattctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagaatctcccagaacctcacaaatacccccgggctcctggtttgagggactagatgggaagcccccctccctgggagaacacaggcctagagcttcctggaacttaggcagcttggtcagagagtgtgaggactctgacaggagcacgggtgtgggacattcatgcctggaaggccctcgacacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagattgtggaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcattatttctctaattgaacgttacttttaaaaacagacaaagagaatcaggaaaaatgatgtgaggactttaggcccagatcagtttccgtttcaacaagatgtgtcaggatgatgaaaatgtcgtttggttgagccgtggtcatcaccccgcattgttgttctttcatgtgtttgtgtgtgtgtgtgtgtgtgtgtgtatgtgtttccctctgagtttcccagtagtcattactaaaaaaaaactcctaaactgactcaaaacaacaatgacaaaaacaaaagcaaacaaaaagacccaatcaccacaggcgccattcaggccctcttgtctgacggtgttcacagactgtgcttgtgtttttggatgtacccgcttccttttctctcttactcaccagatatcactgggaatccctccttcttgctccaggaccctaaaggagacactggggtaagactcatgtgggtcttggggcagcccatttccaggagagcatgacccccaccccccaagccccaggaggacggacccttcccagctgaggtctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaagtggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcataccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgcaagggcacacgcagggtgagtcttggagctggaatttgaacctggggaatggcactcctgggccttccctcctaactcatagtatctacaacctggattgtagacctagctagtaggtcttgggggttcttccctcctaacccctggtatctagaacctggatcgtaaacctagctagtaggtcttggtggttcctcacatggatggaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacgcatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatggacacaggagagcgagtgagcaccccaccccacaacagtgtcctgaggaaggcccctcttttgtcccctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacatctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcatgggccccagactcatgggaactgggggagtgcccaagtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggacctcggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccctcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgctgcctctcctttcttggtacatgccagcatggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcaggacttgaggaatccttgtagtgccaccttacaaatgggttggtgccttggaaacccagtcctggcatcaaggccttggcatctgtcaagcagaagtgtgcctggggtgtattggggggggggcagtgttggagccgatttcaccgatttctgtccctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtgggggtggtaggctggcggcacaggggctgctgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttctggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagttcctctagaaacacaagcatagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagaagagcttctccctcctggtctttaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggaaagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacagtttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttattagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacacacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctctgtgtgtgtgtgttcatcttctttggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttccttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttatttcaaaggtcaaactccagtttctctctgccagtgctttcaatttttaaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataaattataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggtgaatgaattttgattgagcacagattcatcatatcttgccaggtttgtcctttatttgtctccaatgctgatgcatctggattcacatcaactccatccactacacttacaaaggcaaatgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgtgctgtgtgtgtgagactgaatgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccccactagatgtggcccctccaccttggatttcttggcctccagaagaaaataataaatgcctggtttcgagtgctctgttatatgccacagaaaaagacaggagtggagaggcttataacccccaggatggccacaggcttatatcccttttatcctcaggggtgaacccttgcctacctgtttttccatccagccaggccagcactgtagcagagggaaaacccaagggccccatatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcgcaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacactggtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttagacttgtccatttggctctgtggatatgggttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagacttcatctcaaaaaaaaaaaagaaaagaaaagaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggagctagaggccctcgtccttagcaaactaatgcaggaacagaaaaccaagtatcacatgttcttacttacaagtgggaacaaaatgatgacaacatatggatacttagggggaacaacacatattggggtctgttgggtgagtaggggatggaaggagggagaagatcaggaaaaataactaatgggtactagtcttaatatctgggtgataaaataatctgtacaacaaacccccatgacataagtttacctatgtaacaaacctgcacatgtacccgtgaacttaaaataaaaatgaaaaaaaacagtgatagtacctacctcatagtattgttcttggaattatgttagccattatataattcttaaagagttcttggcatgtagaaagtactatgtaagtgacagccatcgttgcttttgtaatgattattttgcttcctttctttttgttcattgcacatttaaatttctaaaagagattccaatgtctttattattaaggtgagaggaaagcctgaatttaccttccccctcttcccagctctgcccctcacagcccccagacctttgctttgcttgctggacccaaagacacacaattcttgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccgcctccccatcccttgtctgatggctagtctccctcccctgagggccgacgccactgcttgccaattttgacataaggcttgaaaccaatgagtgtccagtgactgggtgagtttggttcctcctacttgtcttggcaatctcaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggtctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagccctgggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttacttctcaggcatgagccaagggtcacattataaaagctatgccagattccccatagatgatcctctatccaaaaattaggagctcttaagtcataagatgagtcaaatctacccccttagaactcaacatagctatgttcagttttactggaaaataagtcactggaaagcactttttatggttttctaaatctctcttatgcccaaagaagtggttcagccctggtctaaggcactgctcacttactctgattgccatcttcagcatcatcgtgatgatgataatgatgatgatgatgatgatgatataacaagatagtagcaataacaagagctgcctcctcccagttgtgaaattatgtttatggatatctggggctcactgttctctttaggaatgacccctgagggctcatggctcccagcccccagtaccgcaggtaaagcagtgaccctatctccagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatcgactgtttctttttggttgtaaaaccctgaggatctctctgcatttcttcccttcccacccccattgtttaagcctcagtttctcctttgagctacctgggattctgatgggcaggattgctcggtaagcgctaagctctgtccacaactcagccattttgtgtctctggtttgctttggatggcagttttccccttatcctgcccagatttccagtatccaagcccgttattttcttatattcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggccgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcgtgaaccctggaggcagagcttgcagtgagctgagatcgcgccactgcactccagcctgggcaacagagcgagactccgtctcaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacaggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaatttccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctgggcaggatgcgggagaggcagctgagctgcttattcctcagtgtgagggctgctgggagcgtggggtgcagctcagcttggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtggcagatcgcttgagcccaggagttcgagaccagcctgggcaacatagtgagacccttctctatataacataaaaatttaaaaaaaaaaaaaaaaggagaagaaaagaaaagaatctcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagcggcaagagaataatgaggaaaaagcaaaagtggaaacccctgataaacccatcagatctcgtgagacttataaactatcatgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagatattaagagggctgccaagggaggaggagggaggggttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacatgatgtatttattaccattgaacaatacacttaaaatggtaaagatggtaaatcatatatgtatattttacctcaataaaaaagaattaaattaaaaaaataagcaaaacaaacgatcttattttaccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcacttttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctatttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagaaaatatactgtgtgacctttatccagtttcccctaaagataacatcttatatgatagtataatagcactgccagaatattggcattgatatacttttacttgtcctcattgtgtgtatgtgcacacatgcatgtgtatttagttccatgcaatcttatcccacatgtagggtctgtgtatccatcaccacagggttcctcttgctgcctttttatagccatacctccttccatactcttctccttaacccctggcaaccaataatctgttcttcatttttataatgttgtcatttcaggaataatagactcgtggtgtgcatgtcttttttgctcagcacaattctctggagatttttccacactgttgggcacatcattatccaatgcccccttttcttgctgagtaggactctatggagtggatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacagacatgcctgtgaagaggccaaccccagtgtgcagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcacccccaacattctgtgcctatgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagagactcccaagccagtcctcacatatcttgctctcattactagggcagagggttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggaggttgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcccgggcaggcgacagagagagactgtgtctcaaaaaaaaaaaaaaaaaagagaaagaaagaaagaaaagaaaagaaaattagcagggtgtggaggtgcacacctgtagtcccagctactcaggaggccaaggtgggaggattacttgagcacaggaggtcaaggctgcaatgagttgtgattacattgctgcactccagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacatgaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccatgagcaaggcactggcagatttggtatccagtgagggcctgctctctgcttcataaatggttccttctagctgtgtcctcacatggtggaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacaccaaaacctgctaatgacattttaagaaaggaaaaactacagaccaatatctctcataatcatagatacaaaaaaatctttgaaaaaattattgaatcatattcagtaatattatataacataaccaagtgggattcattccatgtatacaaagctggtttgacattcaaaaatcaacgtaatttaccatatcaatgggctaaagaagataaatcacatgactatatcaactgctagagaaagtatttgaaaaaaatcaatacctatctacaataaaatctctcggcaaactagaaacagagggtatctcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaattttaaatgaaatttacattaccatttacaatagcatccccccaaatcagtatttagttacaaatttgacacaatctatggaaactgtaggcaaaaagctagaaaatactggcaaaataaaataatctaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaagcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaatagagaagttggactttattaaaattaaaaacttctgctctacgaacaattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtaaacggatcagtggtttccaggggcctgtagagatggaagagtagagtaggcaaagcacaagagatttttttttagaatggtaaaattattgtgtatgatactgtggtggtgaatacataacactgcatttttcaaaacccatggaattttacatcacaaagagtgaaccttaacatatgcaaattaaaaaaataattaaagatgttgggggattccaagatgggatgctgagtatgacagaagactaactgtattacaaatgtataaaataattccactgaaggggtgggaggaaagcgtgctgaccaagtggcattggaagtgagtggagactgtaagactaaaaacataaggaactgtccacaaccctgtattctagtagataaagctctttcccaaaaggatataaattctgaagccactagtcacacactctgaaatgtgaagtcactggatggaggatggtgggagccaggtttatctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcaaaataaatttccccccagaactgaacagaacttcacgtacccagttaccatgacccacgagggtcatgaggcacatgccggtactgacatcccacatcttaatagtcttgtccctggatccagacagcaagaatggcccagatttaccactattttttagtctcagagcctgttgcttcagagatggaggaatatgagctttctggagcccaggaaatgcattctaccacatgctcatgttctcggagctcacccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctctatgtccttcctttaagagttctttcaaaatctccagtctcataatcccacaccttaactgtagcatcctctgaagcagagaccataacactgaacacaggatggaaaatgactcgaatgattggactcctgtgaccactcaatgtgtattttttctggcagaaaatacccattcttttgggtcttgtttctgaccaagaggtccacctgacgtaaattcttcttttgcttcatttagcgttgattctaattccataaacttcttttgtaatctaataacagatgtccattttttccccaaaacaccagcctactttatttcttcattcatatctaattcagcttcctttttaaaaactgaatatgcctcttcgtagccatttgaacgaagataatctgctttagcttgatttagttcatctcgttgtctctgggacagcaccatcttggctgtaatgtcaagcttatctcatatagtggtatgtccctcctttgggaaatgaaaaagctttttgatccgtggacgtataatataaatatgacactaagtgtcttccactcagcggaaaatgattcttttacaaatgaatccaactagtaaccagaagatattcaacaagtaagattcattctactctcccggccgctggattctgccactgccccgccgctccagctctgtctgtcacaggagctgccccaacaccctgacgtcactgtgccaccaccgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttagttaatcacatacatatgaataagtaaatggcagagaataggcacatctccagagtggtggaatttcaggtaatttatgtaatagtgcacccccaaggaggtggagcataattctcccctccttaaatatgggctgcacacagtgacttcctttcaaagtgtacagtgtggaaagggggcaggggagaaacttcacagtggagacgtccaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatggtgttctatggtggaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctctctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaaggtgaaggggaagctaacacatcttcacgccggagagagagagagataagggggaagtgctacacactttcaaacagccagatctcgtgaactctatcaagagcacagcaaggcggaagtccacccccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcatttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgcccagtgcatggcacttttacaagaaatcttatttggtcaaccccccaaatatcacagaaggacattattattatctccagtctgcagttgagaatgctgaggctagaaagtggttaccactaaaagcaaaccttttctctctttcccattgcctatccaccctgactctgggctctgacccatacccacctgctcaaggtcccaggtaggagttgcccattcttttaagtatgagttcattcatacacatcaccatgtgaggcttgatgtgacctcagtaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccatgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggggtctgtgcagcctgattgtattggggatgggcccctcgtccagttgcctatgaggataacctgcggagaagatcagatggagatacctggacttatgcagaggcgtgttcgggttaaatagaaatgcccagggtccaatagagggaaccttccaacaagtgtatgagttggcctctcacccgacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagggtgccagggattttggtaggttccgtgcggacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgaacttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggttaaaacaataaagcagaatcgatgtctgtagaacagagctggaaggggcctcatggttggttttcaaggtaaactaaccacagacatcagttttccactcctctgcctttttagcatctgggttcatcttccaggaaggccataacaaaactccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtccgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccactgtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccaccctcgatggcagcctgcccgctgcgggcctgcttgtctgctcaaagcagaggttgacttgcgcccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcagagcagggaattaacctgctgcccagggccgggccagcgaatgcttggaaggaaagcaaagcgcacgggtgtgcattttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagggctgggcctctctcaggaggtgaaccatcccaagggtcatggaaagagctactcattgtgggcctggggtgacagtgacccatcctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcacgtcccactgcccagggctgggaaggtccagtgtgcccagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaactcaaacccaccttgtcacccctctccacccaggccccacttcctgctttgctggggctggggggtcagaagtaacatagctagagacagatgtccatcatctgtgcttgtgatgacaaaaggaggtaacaggagtacagtcagaccctcactccttggagccctgttgtgagccgctcatggcatgcaccattctctgtcctcacaacagctcagacgggtaggaattattggattctttctctaaacgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctggctctatctgtgaaatgtctcaagagtccatcctgttgtctcccatcccatgtctcccacttggcccacagtccagactcttacctgtccagactcctactccagagagagccggcaagatctttgggaaaggcacattgagccatgtccttctcccccttggaactcaacagtggcttcctgtcactctgagaacagaatgcagcctcctccctgtgcatgacaagcacctccctgaggtcacagctgtgtctccctgactctgcactggtccagtccagcctcaaggccttaaatttgccactccagacccctggtttggaccctggactctgaatacattctggtcttttcctcagggaggtcgaggcactgtcctagcttgtgacctgctcccatacctattttctcagggtggaagcagacgctccaactcccacactgtgaggctggtaccattacctccaagacccaaagcctgtaggaagtatagcaggcctcacccaataccctgcagttccctcacttgctccaagtgggaggtgggtcttcacgggtccccaagatgagggtcagtggctttcctctttcacaggctacagtgggagcgagtcttccaccatgggacctctggccagatctcagggctctgtggttgggggaaaatggctctctttcatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggttgggttaaatattcagtggctgcccacacaccacttactctattgcttcaaaataattggctttcacttatcaggtctactagaatgactgtcttaaaccagtcacgtggtggaagcgtcaccatgtttcttgctcagaaaataccctttcaagggcttttctaggggagccggaacagtagccaattctagtgggacctttaagaaacaactttgcccaggatgatatttgagccccctaaagggccaataggggtccctctattcaactttccctccgagtcccaccaacctccccactttggttccatacagcttggattattgccctactagttcaaaactgaaagtttcaaataaaaaccaaaagacaaatgttaagtcacattgaattgataactgagacaatctgtcaagcatattttgctttcctgatttttcaaaaaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggtcatgagactgccattcctgtgtcctgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagaccctgtggatatttgagtcatgaccttgcctcaaggcttattcatgtattatttgtttatttattgttaacataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattattggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacagcctcaagagaacatggagtcctttgggatgctgaaaactgtaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcatgcggagaccaagtgtggaggggatttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctatgaacacagagtgtgcatttgatggacagtatttgctctgagactgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccattagaatggctaatagcaataaaacggaaaatatcaagtgttggcaaggttgtggggaaattggaacccttctgcacttttggtgggaatatgaaatgctacagccactgtggaaaacaggatggcagttcttcaaaaaatcacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgcgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctataatcccagctactcgggaggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggaaggattcaaaagagaggtgcacattcagccagacactgagcctgttgcccgtggggattatgcctaagaggaatgagataggaggggttatgttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggacgtgagggctgcaggtaggagtttgatggcagatgagcctcaggggttcaatgtcagctgggagaagcaaggccacttccagactcagttctgccactgtctggcagtgaggctctgggcaaaccattttgttttgtctctggtaaaagaaggctgtgggcaggattgggctttgtaattgccaaagattccagatctttgaggggctctgtcttcctaaattctgtgcagcctgctagcctctgcaggacagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggaggtgagattagcttcctgggggcaaaaaggagccatatttgtcttaatgaggagaaaagagcaaaatcaaagcattcaaagaggataaaagaacacttcaaagaggataaaagaacatgttcagttcacaattactgcctccctaaccaggcaagtgtatgatggagaatcctgttatcctaattcaagaggacaatgccaaaggcttctcttgctggctgagaattgttggggagctccctgcccacggagggcctgtttgccagatccccagccccctgcagacctctgatctgtgaggagctggttctagtgattcacacttgcttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctattccaccagcaaatcagcctggtgagcaaacagctgccttagacaaatggggttgagtgtaggggtgaaacctgctgcaggattttagtaaattctcagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgccttttattttctttttattggatgagaagactttgaaagacacagaaaaacacagagaataacataaatacctgtgtagccacattctaggagtaacaactgtaatattttataatgcttactgcaatttattttttaaaaataaaataactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtagaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttctcatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattactgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtctcagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtactttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctatagaagccagctccttattttaaatcccatcctgcttgactatcaaagtcagacagagccttcctaaaagctgaaacacacgcacagaatgagaagtccctgcgggagcaagttcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccatctgcctgctgagtgggcaggggcccaagatcgctgtgggcaattccaagccagtactgggagctgacatcaaaccaggaaagaacacgactgtttttagctgatgtagcagtacattttctttctttccttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaattggggtttttataaacttttataatcacattttctgctgaggttatagatgactccaagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaatgtacttgaaaatatgttacttcacattggaacattcaattttatcttaaggatataaatattcaattttaccacattaatctttgtactgagataagccaaaaataacgtaaactgacaattgtttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtattttttttttctgttataaagggccagggctctatccgttggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccaggaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagttataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggttttcatccgtgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacaaggttgttaagcttccagatagctgaacatgtggaggttcctggagagtggtgcacccagggagggcatggaagctccgtgaccctttctccatacctcaccctaggcatctcttcatctgtctcctttgcaatattttttaattataaacccgtaaacataggtaaacatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtttggttcataggtatatagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagaatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcatcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaaggaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccatctaaagaaagtatgcaaaaagaaagctacagatcaatatctctcatgaactttggatgtaaaaatcaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcgaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgcttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtcaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggatcctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaattttaaaaaaatcactggattctactcaatagtagaattgatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaatcattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcaatgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttctacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggtttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaaaacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgtacccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttcttttttttttttaaatggagtctggctttgtcgcccaggctggagtgcagtggcacgaccttggctcactacaagctccgcctcccaggttcatgccattctcctgcctcaacctcccaagtagctgggactacagcgccactacgcccggctaattttttgtattttttagtagagacgggatttcactgtgttagccaggatggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgagggcagatgatcacccgctttaggagccattcttccaaaatcttaagtgagtgaaaaagaagcagagatagctttttgtatttgcgcatggaggcagagttcatctgttgcctgagctaacagtatactattcagcccctagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccgtttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaaccctaaagtataaaactcattggtaaagcagacacacaaataagaaagagaatggaaccacatgttatcattacagaaaaccaccaaactgcaaagataaacaaaggaaagaaagaaagaaagaaaggaaggaagaaaggaaggaagaaaaaggattatttaaaattatcagaaaacaattgaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaaaaccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttagcaataatctatttttaaatcaggtgtgtatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgatgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcacttagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaagatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaagtaaaataactctggtaggttctatagcaaatgctaagtaaagtaaccgctggtttctaaattattacgataatctgagaaaattatttctttgaaaaaattatagaactttcaaatatgcaaaaaactctagagagtaatataacaaatgcacttaatagggacaacctttaacattcagcagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcgtgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaacttttctgtccataaactcattgtattagtccattcttgcaccgctataaagaaatacctgagactgggtcatttacaaagaaaagaggtttacttggctcacggttctgcaggctgtacagcgagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccacgataacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtgctgggggctgggaaccagtgggaataaatcctatgggtctctgcccttgtggagattccagagtagggctgcccggatgttcttgcattgtgcacagtgcagagacaggaggctcccggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtggctccaacaccatacttaagcttacttcaaaatgacttatacatctctattttccttaaagtatgcgcacagataagaaaagatggggtgaattttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcagcctcccaaagtgctgggattacaggcgtgagccacggcgcccggccaagatggggtaattttgatgtccagacacaagttgtcatttaagatgaagcttcgattgtaactctatgaagccctgctgaatattaaaagcttatagaaagcagcttttctcccccaggcaaaaagagcccttcgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggtggtgcatcaagaccacagaagccggcccggccagccttcccacaaagttacttgaactgagctctccataagtacacatgcgcacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttgggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggcggaacaaggctggaaaactggtgcatggaggaaagaaaaaaaatgggaagggagaatggacaggtaggaaggaaggaaaggaggaaagggaaacggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaagccttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagaacgtcttaaaagatatcaactttgactcagagatttcaagaagacgctctatccgaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataacatcttatggaaactttcagagtttcaccagacaaaatgccccaggctttggctttgcagctggtgtctacagctgagcctagtccttgaagtaatcatgactcagcttattcaaaataaactcttcaagaattgcaaactctcctctcagcgcatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattttgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgattgtgcaaaaaaggaagtctctgccaagaaactaactgaatgttagtgcctgttctcaggactttccataaccctgctctactaggattcctttcaccctctttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacatgcaggagtatcaggagcagttagagataaacagctggctaataaacacatgaaaagatgctcagcatcattggtcattagggacaggcaaatcaaaaccacaatgagactctacttgactcccattaggatggcgacaacacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaatgttttggaaacagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcagggaaggtccctcagacataaaatactcacccatttagaggaatgacaacagcaaacgaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccgtctctacaaaaaatgaaaaaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaacacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagctcgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagagagagaagaccctgactccaagccaaacccttcaccgagggaaatgcaccaacactcagagggttcttgtttagtaggtgagcaagcagccaagcattggccttccccagggcaggggcataaggccggtgagcagctgagccaggatttgaacagcagtcacccttggtgaggcagaagcagatgaggatatgaatggggatggctaaggaaaggtgggcttgcttgcactggggagaggccttactggggattcagaattgagggctggggtttgcttccccggagggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaatcatttctaatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacacccccgtgggcttggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacgatggaatgctctaaacacgaggcctcaggggacagccccggtcctccttgtcagagcctgctctagtttgggatccagcaggaacctcaggagcctccttcactttggtggagaggactgagactcagagcccccaagcgcaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcttgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagcctgggaagacctctgctgacattccctatgaccactgtgacggtgcccccttcggctgcctcccccctccgtatggagagcgttccagccccaggctcccagcgcctgctcccagtgcctgctccccggcctccatcactccacgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttctagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacgtggtgcttggcatttatttattgtttatttgtttatattttgtttttggtttgtttgttgggtgtctgggctggccaggtgaacttcattttctgccctcactgagaggttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagtggccaggacagggagcagaaggtgactgctgtgctgcctggagctcttctgtccggaggcttagtgaaactagagaaactcagtggacacactacaagacttcagagatactttttgtaaacccaggaagaatcaaagatatgaaacatgcagtaggcactcactaaatgttaattttcttcctttttaaatatatgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtccctgcactggagttgccagcaatcacacgggaaggcctctagtctagagagacgggtaggagagagacgggagcacatcagaggagcgcagatgctagtgcacgggttaaatagtctcttacacatctggttaagatcacctcaaattgctgtggggttccatagctctctacagcccaattccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggcgtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagccgtggggggtctctgtgcgggatcacccctctcctaatacccctggtcccaggagatggggaggatggagacaaggccggtgtgggaatgaggtggcaggcttctcaggacatgagctgccttgctctgcccccttgggcctcatggaccccattctccctgctggagttgatgttctggcagactgggctgccccttggcccagttcctggaataccaagtaattaggtcatcatcggggcagcggaggccagcctctgatattctgcggcatgttacttgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttgtacagtcttctgtatgtgtgatgcattttataatatgagtggtatatttcacaatcaaaaacacttttaagaagctcttttgccttggctaactctcgtttgccgtttccccagggccagccagcccggcggagcatggggaggacctgaatctgccccggcactgtcctaccctccacaacatgctcaagtcacatcctgtcctgctttccattgcctctggtcactgtcacttgccaacattctgaacatcccactgccttcaaccctccccacttgttcggcacaatatggaaagtgaaaaaaaaaatgagttgcagagagccttgcttccgggtttggaatccagctccatcttgagtctgtttagagaggtatgagtgctttctgacgtagggcacttatcactttagcacacagggggctgtgtgatggcccagtaagagcctgagctttggagttacagagcctgggccttctcaactccatccctcatgggtggtatagatggttcttccctccctgctttccctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacgcattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccaccctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaagtgagaaaattgaggtaacccatgggcagagcacagggcactttgtgagcactcagtaggtgcaggctcctttctcctcccctctgcctttctctccccacttactcctgtcaagtaacttcacctctcagaaagcagcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagctcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgcagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtaccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaattgtgtgaatttagactcttggtagatgctgcctgaccctgggctgcctggagcactgcatccctgttgcctggcacacagtagggttattgtctctgagtagctgggtgaatgtaggtcagagctgggaggcgctgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccacactgcaggagctggggaaagggaaatgtggtaagaggtgaggaggagaaggacctgatggtgaggatatcacagtctgatttttattttttaaaggacaccttggttcctgcaaaggtgggaggggaggagaggggcattggtgagtccataggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcc

SEQ ID NO: 253 - DNA, 757796 bp, Homo sapiens
aaactgacttataaaaataatgtaatgtaaacatttcacaaaaataacttctattttgaatttcttgaatatcatggtattaactgctcaacagttattttagtaaaaataaggtatataaatcagtgaggaataccgatatatttattaacctacctgtagatgctttgttctttaatagttaataagtaaatgaatgatacttggatgaagtaaagtttattttttgttgttgttttgggtttttttttttgagaggggtcttgctctgtggcccaggctggtgtgcagtggcgcgatctcagctcactgtaacctctgcctcccgagttcaagtgattatcctgcctcagcctcccgagtagctgggatttcaggcacacgccaccgtgcctggctaattttttatatttttggtgcagacggggtttcatcatgttagccaggctggtattgaactcctgacttcaggtgatccacccacctcggcctcccaaagttctgggattacaggggtgagccaccgtgcccagctgctttttatcttctatattatgtcttggcagactgcaggccatgggctaaatctggcctgcagcatgtttttgtaaaacttgtgagctaagaatggtttttttttgtttgtttgtttgttttgttttttttttgttttttaagacagagttttgctcttgtgcccaggccagaatacaatggtgcgatcttggctcactgcaacctctgcctcctgggttcaagcgattgtcttgcttcagcctcccaagtagctgggattacaggcgtgtgccaccacactcagctaattttgtatttttagtagagacatagtttcaccatgttggtcaggctggtcttgaactcctgacctcaggtgatccacccacctcggcctcccaaagtgctgggattacatcatgagccaccgcacccaacataagaatggtttttaccttttaaagggttgtaggaaataacaaagattatgtgatagagtcagtatgtggacagcaaactgcactatttagtctttgatcttttacagaaaaagttcaaattttatgttgttactaattgcagacaacccgaataaacatactagggcctgggattaaatggcatgcagccttttttttttttttttttaagtacaatttccattttattttttctctggagaatagtctgtcttcaatctttttattttcattttgttttttttgagacggagtctcgctttgttaccaggctgcagtgcaatggcacgatcacagctcactgcagcctccgcctcccaggttcaagcgattctcctgtctcagcctccctagtagctgggatcaggggtgtgccatcatgcccagctaactttttgtattttagtagagatggggtttcaccctgttgcccaggctgatctcgaactcctgagctcaggcaatccacccacctcggcctcccaaagtgctaggattacagacatgagccaccacgcctcgccttgtcttcagtgtttaaggactcagctccttacatgggctttggtgggggttgtggggcagcactcctcgaaggtctaaatcggggtgggtgtgtttggtccttgtgggctttacaaggtggattcctgatgacttttctgtgaattgcacatctcacacagtaatttagcttcccatacagcttgggaagcacataggcattgaagacactcgcttcagaaatgtccctgactgctgcagcctccaccacatttcgaatgatgaattaatttctttttttttttttttgagacagagtctcactctgttgcccaggctggagtgcagtggcgggatctgggctcactgcaagctccacctcccaggttcacaccattctcctccctcagcctcccgagtagctgggactacaggggcccgccaccacgacccgctaatttttttattttagtagagacggggtttcactgtgttagtcaggatggtctcgatctcctgacctcgtgatccgcctgcctcagcctcccgaagtgctgggattacaggcgttagccaccgtgcccagcctcgaatgatgaatttcttaatggccttgtccttgggcacgcgtcaggcacagtttgtgcaacgaataggctgcatgtggctgcgcccctttttggcacgattgttgttccttcttttctttgtcttcttggaggcacggactggagggaggagtgcagccattattgatcatatttttgaataatatttagtgaactagaagttgcttatttgtaatgtcaagtaggatacaaaactttaacacagtatgattataattttgtaaaaatgtataaagtgtgtatatatgtatgaaaaaaacaaaaattctctaatgtattaatagtagatattttgagatggtggcatgatttttatttataaagtatttcttatgattataaaatcatattttaaaatttttcaatattttaactgaatgggaaacatttcctgtcaaataaggatatggagaccagtccatggtactttagattaaaagctgaactcactgggaaaaaccttattttgcatgtgtaactagtaaagcagaaacaacagtgtactgttcggcactgtctgaatagtaattatagagtacagctttcatacagaagaacagaaccaataaggaagtcaaacttggcagaatagttgagtgcaatttataaataagtcagttgaagaaatcatcgaccttttacctgtggctgattcgtgtaatggtgagagtcagcacaaatcttaacatttagcaacagcatgtatgtgaagctaaaacttgtaatgctctcatctttaatgtattttaaggaagttgatgcctaaagtaaatttattaaaaattcagagttaattatttaagatagtaatagatttcgtgctctctttggcttggttgttctttatctttaacaattttaagagctccgttcataaatatcagtcttgtaaagcccgttgttctatacctgatttttctattttatttttaaggtctttttggttcattacgggtgcaatatgttgtagatcatgcaatgaaaattgttttcctcaatactgacccctctattgtaatgacttatgatgctgttcaaaatgtgcattctgtgtggactctccggagagtcaaatcagaggtaaggagaaaggcaagtcacttctccttaacaggaaagggtaggctgggtgcactggctcacacctgtaatcctagcactttgggaggccaaggcaggcggatcacttgaggtcaggacgttcaagaccagcctggccaacgtggtgaaaccccatctataccaaaaatataaaaaattagccaggtgtggtggcttctgtaatcctatctactcgggaggctgaggcaggagaatcacttgaacctggaaggtgtaggttgcagtgagccaagatcgtgccactgcactccagcctgggtgacagaatgagactccatctcaaaaaaaaaaaaatgtatgtgtgtgtgtgtatatatatatatgtatgtatatatatgtgtgcgtatatatatgtatgtatatgtgtatatatatatgtatgtatatatgtatatatgtgtatgtatatatgtatatatatgtgtatatatatgtgtgtgtgtgtatatatatatatgaaagagtagttaatacttcataccctcacattttttttttggaaaaatcacttgtgaatagttgttttattattattatcatcatcatcatcatcatcatcatcatcatcatctctagagacagggcctcactctgtcacccaggctgaagcataatggcacaattacagttcactgcagccttgaactcctgagctcaagtgatcctcctgcctcagccttccgagtagctaggactacaagtgtgtaccaccactcccagctaatttttaattttttgtagagatgggatcttgctatgttgcccaggctggtcttgaattccttggctcaagctatcctctcgcctcaccctcccaaagtgctgggattatagatgtaagccacggcacctggcctcatttgagaaatagattgagcttcttaggaaagaagaaatactgtgtctttagtaactgacttcaacttgcattcttacaaggaaattgctattttattctaattattgtttttttttcctctttctctttattttgacttaaggaagagaatgttgttttaaagttctctgaacatgggggaaccccacggaatgtggccactagcagctccctcacagcacatctcagaagcctctccaaaggagattcccctgtgatttcacctttccggaattactcctccattcacagccagagtcgctcaacctcatcacccagtctacattctcgctcaccttctatttccaacatggcagctctaaggtagaagggtttcctggtttttctttctaagctttctgttttgttttgaaggatttagaattgctgttgacagctgtttttaggggaaatatatttaggggagttttttttaggggaaatagccattatcccaattgagaccttttttttttttttttttttttttgagacggagtcttgctgtgtcacccaggctggagtgcagtggcgcaatcttggctcactgcaaactccgcctcccgggttcatgccattctcctgcctcagcctccagctgggactacaggcgcctgccaccacgcctggctaagtttttttttttttgtatttttagtagagatggggtttcaccgtgttagccaggatggtctcgatctcctgaccttgtgatccgcccacctcggcctcccaaagtgtggggattacaggcgtgagccaccgtgctcagccctgagccagttttactaagatttctaagtttaccatgtcacattctttcctgagtcatattttgaagctgcctatgcttgtcctaaggttagttgcctcatttctaccactatgtgggcaacagtttgatgaatattaattcccaaaatattgtggcactattttatttttgccttaatttatgttagtttttcttttttttcttgttatttgatatctaaatgtatctatttctctatatagatatttatttaaatcaccagatatgtatatctggtgctacagggacattgttttgttgatatatatatgtctgactatacagggacatagtttagagctttttgaataatcattcattttccgaaaaagaagatgatctaagttttagttgtaaaagatgagttcttctaataataattctaaatctttagaatatagtaaagcacattgacatgaaccatttaaatagctactcctttttgaaaaattttaatttctgacctggattatgccatgaatgctcttctgtctgtggaattttgggaagtgtcattggagtgtgtgtcatataagcctgccctgctaactgtgatgtactctctcctctgtttcttttgcagtcgtgctcattctcctgccttaggagtgcactctttttcaggggtgcaaaggttcaacatttcaagccataatcagtctccaaagagacatagtatttctcattctccaaatagtaagtctaatggcttctttcttgcaccagaaacggagccaattgttcctgaactgtgtattgaccatttgtggacagaaacgattactaatataaggtttgttatatatattattatattcaaagaaaaatgttgctgaaagtcttgggaaatatatggcattttgtttaaagtttccttttaatgtgatcagttattaatatatgtaaaaatatatagagatatgtattaaggccacctcagtttcagtagaggatattaatgagattaaagtgatcataggctggacgtggtggttcatgcctgtaatcccagcactttgggaggctgaagctggtagatcacttgagcctaggagttcgagaccagcctggccaacattgtgaaaccctgtctctactaaaaatacaaaaattaactgggtgtggtggtgcatacttgtaatcccagctactcaggtggctgaggcagaattgcttgaacccaggaggctgagcttgcagtgagctgagatcgtgccactgcactccagcctgggtgacagagtgagactatctcaaaaaaaaaagtcatcataaaaatattattttgtcatctgatatttcttcctttatagtaataatctctcatttttcaggtgttttttgttctggggagaaacagttaatttctatccgtgaggaaatgtgggttttttagcacgtttcctaagttttatgttcatgttagttgagtgccagctttactttttgggaaacatagcttagatctctgttctgggtgacctttcttcttttatattctctttaataattcacgtgttaatttatatgccaatgtgtgtgctagttaacagtctaataagtcactgtccctgtcctcaaaagaggcagatagctgaaggatggtgacacaggagggactacttttgctggtagggctttgaaaaatgaacaggtatttgctaggcaggtaagtttagaaagaccacagacggcagctgggatcagaacaaaagttctggtgagtgcgtggtgtatttagggaattataaatactcccactctggtttttgcagaggggagggaaaaggctaatgaagaggaggcttcctaggtgcagtggctcacacctgtaatcactcactttgggaggctgaggcagatggatcacttgagctcaggagttcaagaccaacctgcccaacatggtgaaaccccatgtctactacaaatacaaaaattagccaggcatgatggcgtgcatctgtagtcccagctactctggaggctgaggtgagagagtcatttgaacctgggagttggaggttgcagtgagccaagagcacaccactgtactccagcttgggtgacagagtgagactgtctgaaaaaaaaaaaaaaaaaaaaaaaaggaggcttgagagattactgattgccctttaggcctctggtctgtttgatgacagcggtaagaaggcacttcataagtgtgtcggaagtttgggaaacagcagaacaataaatgtggaattgtcagcttataagtggtgattgaggtaagagaattagattagaattgaagaattattgtattcaataattgtgtgtacatgtagtatataggccttttcccaaggagagggttttaacagtccttagattctcaaagggatttgtggcctccaaatagttaaaatccagtggtgtagaattagaagagggctaggaactgaagtcctggaaacttaagatttggggaatggaaagagacaaagctggcgcagagagacaaagcaaaagaagtcagatgggagaagcagcaggaaatacagaatacaaaaaagaacatttcaagaatacagagatgccagtattgccaggtactggtgaagtgtggccctgagagttgaacccagagaggaggtacctgggtggcagtgggttccttggtgaccttggccagagcattttaagctgggagggtggcgggggaaagtggggtagaaaaagtaaatggggactgaggaaatgaacataggcatacagactctttaaggagtttgcctttgaataggaatgaagatacaaaattagagggagtcttggtcaaggagagttttgtttttgctgaactataataaaattagttttcatgacatcttgccccagtattttctttttctttttttttttgagacagggtctcactctgtcacccaggttagagtacagtgagtgactcaatcacagctcactgcagccttggccttctgggctcaggtgattccccaacctcagcctcccaggtagctgggactataggcacacaccgccacgcctgactaatttttgtagagaaaggattttgccgtgatgcccaggctggtctcaaactcctgggctcaagcaacctgcttgcctctgcctcccaaagtaatgggattacaggtgtgagccactgtgcctggcccccaatattttcttacctaaccacaatacaagttttatatccagtcaaattgagaaggtcttttatatactctaatgttgagtctattttatattttaagacttttaatgtgaaatagtaggctatacggactatactcaagggaaagtattgaaaatacagaagagaggaaacgattgatggaacaagtaaccagaaaggtgcacaagtggtgagattagcgttgggataaagaagtgaaggttgatcagatacgtaaggcaggaggttgagctcaagccttagagcctcattttatctgaaatggaaggcaaatgcataatcttagagagaatgaaatgggggataggtagtctgaagaaagtaaagatgtggatacaatgttgaagtagtctctctggcttgtttctcatatatcaaataaaagtatcctacaattatagatcatttttctttaaataacttatttgtaagttgaatatattatagactcttattttttagatttatgggtcttctgtagcactttatttatttatttatttatttatttatttattttttgagatagagtttcgctcttgttgcccgggctggagtgcaatggcccgatctcggctcaccacaacctctgcctcccaggttcaattgattcttctgcctcagcctcccgagtagctgggattacaggattactggctaattttgtatttttagtagagacggggtttctccatgttggtcaggctggtcttgaactcctgacctcaggtgatctgcccgcctcggcctcccaaagtgctgggattacaggcgtgagccaccacacccggccttctgtacactttagaaggaagggtttgggaattagagatacaatttcaaaaagagatgtgaatgaggtctaatctgagaaggagagggggtagataggagaaacagcattatgaaagatctggccctttgcgggataggaattcaagtttgcatgcattactttacaagtaggtggcttagtttgcattacaagtagggagcttagatagtatgtaatttaaaagttcatcagtaattgttaaatttattgtagctttccccagcaaagctgtgtaatgagctcataatcaaagaactgaaaggatcttagagatcatgaagtttaattcttagaaatgtttgtgtctttgagattattgcttgacctaagtagtttttagatttcttgcagaatattttcaaagactttttttttttttctctctctttttgagacggagtctggctctgtcgcccaggctggagtgcactggcgcgatcttggcttactgcaagccccgcctcctgggttcatgccattctcctgcctcagcctccagagtagctgtgaccacaggcgcccgccatcatgcctggctaatttattttgtatttttagtagagacgggatttcaccgtgttagccaggatagtctggatctcctgacctcgtgatctgcccgcctcggcctcccaaagtgttgggattacaggtgtgagccaccgcgcccggcctcaaagacttttaatagttactgtggtagattcttggaccagtgctgacagttactttattgatgtatctattatagagagaaaaattcacaagcctcaaaagtgtttattacatctgacctatgtgggcaaatttcctgtgcttttcagtggagtcccagctccagttatggtaggtgtatgtatttcccattgtttctgtataaataactcagcattgctttttctttttcttttctttccttttttttggcttaagtagttttatttagaaataatttacatgtcataaaattaacatgttttaactgtacaattaaatgatttttagtaaattacagtgttatacaaccatcaccatgacccaattttacaagatttatatcaccataaaaagatttccttgtgcttgtttgtagtcagtcttgttcccatttccagcctcaggcaaccatgctaggcttctgcctttatagatgagtttttctggacatttatatatatataatgtatgtacacacagtgtagctttttgtgtttagctttcacttagcgtgatgtttttaggatccaccgttttgtaacatgtatcattatttcatacctattgctatgtaatagtccattgtatagatctaccaccatgttttgtttatctgttcatcagctgatggacttttggtttatttccacctcttgactgctgagaattaggacagtatgaacatttgaacaaaggtcttgagcaaaaatgtggacatatgtgattttatttttcttgagtaaatgcctaggattgggtcattgggttgaatggtaaattcatatttaactttttaagaaatcaccaaactgttttccaaatagcctgtatcattttatattcccaccagcaaaatatgaaggttaatgtctctttatccttgacaggattggatatcatcacactctttgattgtagctattttccagtggttgtgaaatggctttaatttgcttttctctaatgcattctgatgttgatcatctcatgaagttattagccattcatttatcttcttaggtaaaatatctattcagatcttttgcccatttatttaccttcatattttgaaatacgatagatcacaggaagttacaaaatagtaaacaagtcctgtgtaccttgcattctttttccctcacaggtaacctcttgtacaactataatacattatcataaccaggagatagatgatgtacacactttatttcaaatttcatcaatttgacatgtactcatttatgtgtatgtatggttctatgcagttttttcacatatgtagatgtgtgtaaataccaccacaatcaagatacaaaacatctttatctgtcttacgttaactccttatagtcacatacaccattacccactgatcctggtaaccactaattctccatcttgataatttggcatttgtgaatgttttataaatgggctcatacagtatgtaaacttttgagattgtctttttctgttcagcataatacttttaatacccatacaggttgttgcatgtatcaagtttctttttattttattatttagctgtgtaaagtttcaagagagtaatgataaaacccagctcatctttgtttcagtgaccaacataccagcgaaggatgcagcaccagtggaggtaatgtaggcacatttgagaagttgacaattacgcttcatcagatttttcagtcaaaaaatctattaatttgctcaaatcgggaaataaatttttagtctttttttttttttttaaagaaaatagacaccatgctggtcttggaaggcagtggaaacctggtgctatacacaggagtggttcgggtaagcaataagtagcacttcatgcctttagtaggacttcaggctgcctgcatgaatatttgtaaagttactttagattgatattttaaatttgttatgttcctgtctgcacaatttggcagaagaattttgttaataattctcagtgaagcttcccatttaggtgggtcctaatttggagggctatggctcactgctattaaatgcattggtactctaaacctgtcacagatgggaaaccttcaatgagtataggtagatttttttttttttttaaagttaaactagttttgaaattgaagcatgggtacctttgaaattgaagcatgggtacctttggtaagtactaaagttttggtaaagtttcactatattaaatgtggtgtatgttagctgtattttttttttttttgagatggagtctcgctctgttgcccagggtgatctcggctcactgcaagctccgcctcccgggttcacactattctcctgcctcagcctcccgggtagctgggactacaggcgcccgccaccaagcctggctaattttttgtatttttagtagagatggggtttcaccgtgttagccagggtggtctcgatctcctgacctcgtgatccacccgcctcggcctcccaaagtgctgggattacaggcgtgagccaccgcgcccagctgttagctgtatttttttaacatttgtgaaatgtacatagagaatatacattttacaaatttaaattatgaaatttaaatacatacaatttgaataataataatgaagtgaatattcatctacccagtactctggttaagaaatagaatattgccagtatccttatttttattacattcttttctgattgcatcctatcttcccctgccctcgagatagacagaatcctgattttgtgataaatcagttgtttgtattactagtttttacagttatgtatgtatcactaaagaatgcattatttagttttccttgtttttgaatttttatataaaaaataccatgtactcgcctctgatgtacttattttgctcaacattatatttgttttagatttgtctgtgttgatgcgtactgttgtttactcattcagtgtgatgtatatattcaatagtattccatcgtacctcattttgtgctttgctttattgtacttcacagatactgcatttttttttttacagattgaaggtttgtggcaactttgtgttgagcaagtctgttggtgccatttttccagcagcatgtgctcattttgtgtcactgtttcaaatattgataattcttgcagtatttcaaacctttttgttattagtttatctgttatggtgacctgtgatcagtggtctttgatgttactattagaattcttttggggcaccacgaactgtacccatataagatgaggaacttaattgataaatgttttgtgtggtctgcctgatcatttgacccctttcctgtctctctctctcctcctgcctcactatatcctgagacaaaacaatattgaaattagaccaattagtaaccctgtaatggcctctaagttttcaaatgaagggcagaatcacaagtttctcactttacatcaaaaactagaaatgattaagcttcgtgaggaaggcgtgttgaaagctgagataggtcgagagccagaccacctgtgcacaagagccaacttgcgcatgcagaggaaaagctctcgaaggaaattaaaagtgctatttcagtgaacatggcaactgataaagcgaaacagccttatcgctgatatgaagaaagttttagtgtctggacagaagatcaaaccagccataacattcccttatgctgaagtcgaatccacagcaaggccctaactctcttcaattctgtgacggccaagaaaggtgaagaagctgcagacgaaaagttgtaagcaaacagaggttgattcttgaggtttaaggaaaaaagccctccccataacacaaaagtggaaggtgaagcagcatgtgctgatgtagaagctgctaagataattgatgcaggtggctacactaaacagattttcagtgtggatgaaacagctttctgttggaagaagatgccatctaggactttcataacctgagaggagaagtcagtgcctggcttcaaaggacagtctgaccctcttgttaggggctaatgcagctggtgacttaaagttgaagccagtgctcatttaccattccaaaagtcttagggcccttaagaattatgccaagtctgctctgcctgggctctataaatggagcgacaaagactggatggcagcacacctgtttatagcatggtttactgaatgtgttaagcccactgttgagacgtattgctcggaaaaaagattcctttcaaaatattaccgctcattgacagtgcacctggtcatctaagagctctgagggagatgtacaggagatgaatgttgttttcatgcctgctgacacatctgttctgcagcctgtgaaggagtaattttgactttcaagtcttactatgaaatacattacttaactagagctgccatagatagtgattcctctaagagatctggcaaagtccattgaaaaccttctgggccgggtgtggcagctcacacctgtaatcctagcactttgggaggccgaggcaggtggatcacgaggtcaggagatcgagaccatcctggctaacacagtgaaaccctgtgtctactaaaagtacaaaaaattagccgggtgtggtggcgggtgcctgtagttccagctactcgggaggctgaggcaggagactggtgtgaacccaggaggcagagcttgcagtgagccaagattgcgccactgcactccagcctgggcgacagagggagactccatctcaaaaaaaaaaaaaaaccttctggaaaggattcacctttctagatgccattaagaatattcatgattcatgggaggaggacaaaatatcaacataaacaggaatttggaagaagttgattccaaccctcatgggtgactttgaggggctcaaaacttcagtggaggaagtcactgcagatgtggtggaaatagcaagagaattagaattagaagtagagcctgaagatgtgactaaattgccaagatcttatgattaaacctgaacagaattgccaaacttgaacagaattgccaaaatcttatgatcaaacttgaagagttgcttcttctggatgagcaaagaaagtgggaacatacagaaaacaaacattaaatggcagatttaaatcccactaggccactaattaaatacaatggtctaacacaaataacagagactagcagaagagattagaaaatacagcccaactatatatgttggttataagaagtgttcttcaaatataatgacataggtaagttaaaggatggaaagaagatatattatgcaaacagtaatcaaaagatagctggagtcgctataaagtgggaaaaaaaaaatgaccaggaacaaagagagactttaaagggccaaatcaccaagaaggcacccttgagtattttgtaaatgtcagttcattccatttggttgataatgttgttcatgtcctctccaaccttggcaatttcttttcttctttttcgatacagtatctcgttctgttactcaggctggagtgcagtggtgggatcacagctcactgcacccatgacctcctgactcaagcgatcctcccacctcagcctcccaaagtgctgggatattacagacatgagccaccacatccagcctggcaaactttttatgtaggagttcagacaagtatcttagcctctatgggccgcatgcagtctctgttacatatttgtcttctgtttttttttttccttaaccatttaagtacataaaacctattcttagctcacagactgtacaaaaatgggatacaagccagatttggtcatggaacatggtttgctgaccaaggatctaaatagatgcagagaaatcatttgataaaatcaaatatccgtgatgaaaaaaaatcctcagcatcgagaaatagaaggggacttcctcaaatagacgagggacattcaaaattttcactgtgcctcctgatgaggaggaagggacggccatgacttttttcttggtgtttgcaaaaagtagggcagatatagtgaaaagtttctgtcctggtcggtcattcttttcccaacactttggctggaaagagtaagattttcttagggcgtgttttgtctgtgaacgttggcatgtctgtgttataggcactttgaaagcctgaggcctggttatgtaaggagtcaaaaaaaccagaaacctaggaaattcatcattaggtcattcctgggtctcaggttactagccagtttgtcttcttttcttcactttttcagaatcctctgttagttgcattataaattttattcagttttttttctttctggtgattaatgagggaatagcatggtatgtgcttattccatcttttcgtaaattaggggtttgagatagcttttaaaaaattatgcataattagttctcactgttattttgttttttaagcctaaggattttattggggcaacttctgttattttgttagctgttgagtagtgtgttaacatgaatatgtacgttgttaagatctcattttagttctgagcatctcctttttagtcttatcaagttttcagcctgtacagatgtgaatttctgtttttgctaagtaccctacagatagccaaaataaggagtggttagcacggattgtcaactcattcttttttttttttttgagacagagtttcattcttgttgcccgggctggagtgcagtggcgcgatctcggctcactgcaagttccgcctgctgggttcacaccattctcctgcctcagcctcagagtagctgggactacaggtgcctgccaccatgcccggctaattttttttttttaatttttagtagagatggggtttcactgtgttaggcaggatgctcttgaactcctgaccttgtgatccgcctgcctcggcttcccaaagtgttaggattacaggcgtgggccaccgcgcctggccgctgttcttactgtctttatgaccaataaggtagaagagtacatagtgtacagatttttatataatgtgttgactatattaacattcctctccttgccttccaaaaaagtcttcagtaatgaagagaaggaatccaaccaagagaaattataccaaggtatgagaggtctaggtgggcagatggcttcagcccagaagttcaagaccagcctggataacatggtgaaaccctgtctctaccaaaaaatacaaaattaaccaggcatagtggcatgtgcctgtagttccagctactcaggaggctgaagtgggaggatcacttgagcctggtaggttgaggctgcagtgagctgagatcatgccactgtactccagccacagggaaagagtgagatcttatctcaaaaaaaaaaaaagaaattataccaacatatttgcagttggatagtggaattcaatagattattgacatttgaattgtttctttgctgtgtttggtgagaataaacttagaaatatcaaaagaaatatatgtttatattccttaacattttatttaaggatgtgatgcattaaaggcagtattttttttttccacatgtttttattgcttaaaggtgggaaaggtttttattcctggactgccagctccctctctgacgatgtccaacacaatgcctcagcccagtactccacttgatggcgttagtgctccaaagcctcttagtaaactccttggatcattggacgaggtaagaaaaggactaggtgctgccaaaaagttaacattttttaaagaagtttggttaaatattagttctttccatggttaacttaattttagtttctacttgcagaataaatgttttcaaacagaagtgattcagttaacatacgctgacctcccttgtgatgtatgtgatactttttgaaggtgctggagagatggaaatgatacattcttttccatctagggatctcacaatcgtgtggagttgatgtactgtctgcataagaaattagaatttaagaaagactcatgactcagtaatgtggaaaagagagtaccatcgttgattgactgatgggaagataacatccaatgggaggacatggcaaaatcaaagcctcatctctgagagacatgtcagtcttcgtttggaccttggggatgagtaggatatctgtaggtagaaaggagcattcagggcaaggagaaaccacacaggcacaggcaggaaggccagataatgcggaacattttttaatggatatttgtatcttcatctcctagtcataaggactgaataaatctgtagaataaatacttataaaagtacaagtagtctgtagggtgaggcaggatagggtttggataacaataataaccttttttgagcattttctatgtgctaggcattgttctcagtgctttattggtaataattatttccttagaacagctttattgagaagatagtactatgattcttttttttacaaatgagatagaggttacaaatgaaataaacctactaagtggtagaactgggatttacactcttactaatgtgctcttaaagggagaaaggatgaaaaggtggttttcttctgaatgcaattgacagggcattacaggattttgagaaaggagttacgaggttttggatctgtgttgtaaataggtgtattttgggattcaagataaggagaccagttagcctccaagtgaggttgtctgtgtcagtttaagaagtatgaagagggtctgagctagggcagtatatgtgtggaaaggagggattaatatgagaggccttgagaggtggaaatgagtttgtcagctgattggttttgtgctgctgggctggggaaaggtgatgtggaaggaggctctgaattctctgaacgacctgggaaggtacctggatttaccaagttaggaagcctggagaaaagtggtttgtatttaaaggacatgtgagtgtggatgtttagggacggttcaaagggaaggttagtgctatctgttgtatttgataatgtctatgtcttcattatatttttaaacatgtgccacattgaattttttttccttcaaaccagcacatttgcagaacattcaaagggggaactggagaagtgtcagagtgttttgtgtgatttggaagaatttcttttataatggaaaatggtttccaacttttttagaattctataagcctggtaatagtgcctttttgataggtgtaaggtcatggaaatgatagtctgacacattggctgatggcttttccacttctctggaagattttgctagtagacttagagccaggaccagtggagctgaatttttcctggtgacttttagagtagaatctggaatagaataaatacatcttagtcttgattgtcagtgttgacaagatattcacttagagatatataaattgaattaaaggaatcaaaaaaggatcagtggtcatgactagagattaagattggaagcatctgcatgtagatagtaactaagaccatttaaattttttgtttgcatatctgcagttaagcaaataaatgctgttcctgtatttttgaataaataattgcctataggggaaataccactaaatcctggtctcatttgttggctttttcattactgtcctttcttcctgggctcttagttcctcagctgcctcaaatcacagtttagtcttttgttttttgttttttgtttttttttgagatggagtcttgccctgtcatccaggctggagtacagtggggcaatctcaccgtactgcaacctccacctcctgggttcaagcgattctcctgcctcagcctcccaaatagctgggactacaggcacctgccaccgcacctggctaatttttgtatttttagtagagatggggtttcaccatgttggccaggctggtcttgaactcttgacctcaagtgatccgcccacctcagcctcccaaagtgctgggattataggcatgagccaccacgtgccccggctcacagtttagtctttagccctgtaaggttgctaacagtgctgctggcttctctccctcttagctatgactttccttgcatattgtcagcctttccatatgttcctcttaccaccaaaatttgcagatggccagagcagaaaaagcaaggttctccaagaacgttggcccctttccctgcagttgccttctctcctagatcttggtccctcaagtccaggttgcttccacagcttttccacagccaccaatcagatgttttccttttacctaccttttctagctgtttcctgtgaggaccttggtttgctggtacttcattgtatctggaacaaaatgttttaaacagcctgggtcttgccgtgtcatccaggctggagggcagagactattcacaggctcactacagcctcaaattcctaggcttaagtgattctcctgtctcagtcttctgagtagctgggactatacaggtgtgcaccaccatgcttggcttggagcagaatgtttttgaatcattacatattattgtttgttagaccatatgcaaaaaagaaatagttaaatttccttgtccttaatttctcagaaaacaattcatttgtgttgtatttacgactttttacaggttctcctgttgtccccagttccagaactgagggattcttcaaaacttcatgattctctctataatgaggattgtactttccaacagcttggaacttacattgattctatcagagatcctgtccataacagagtcaccctagtaagtataaacatttggtagctttccaagaagtgggctggcatttcaaatttgacagaatacagaattttgtctgaaaaatgacaacaaacatttctcatgatttaaaaaaatctattgtgtcattttttggcactattttactttttactatacagtaattctgcttgttttctacagtttctgtattattaaaaacttagtgaaaacaaaagcttgttgagtcagttgaattgtaaattgatgtgattttttgtcgtctcattaaaagtaaatgtccttttgatgatggtgactcactgtataaagattagacactttttattaaaacaagcattttggaaaacattttgcaaataattacatttaaagtttctgaaatttggaagtgttcatttctgtttgaaaattgtttttcatttattttattgctttgatgggcaaagtcttgtaccagctatttttaagacattcaaagacttagaatgcacagattttatttactttctcatttgtttccatctaggaactgagtaatggctccatggttaggatcactgttcctgaaattgccacctctgagttaggtacgattgagaagtttcatttataagacatgaagtaattgtgatttacattaataattggggttttaaacattattttgccatttttgaagccactggatcaagttcttagctttgtagaggagccttaaagagctagggagtgctttgtgatgtccactctatgtgtgctctaaggctggagtacaggtgaaggatgtgctatttctgttctctgaggttcttctgttggggaatattgtgcagtataataatatatggacatgcctgctgggcatggtggctcactcctgtaatcccaacattttgtgagactgaggcaggtggatcgcttgaggtcggtagttcgagaccagcccggccaacgtggtgaaaccctttctctactaaaaatacaaaaatcagcggggtgtggtggtgcacttctgtaatctcagctacttgggagtctgaggcaagagaatcgcttgaacccagaatgcggaggttgcagtgagccgagatcgtgccactgcgctccagcctaggtgatagagtgagactcagtctcaaaaaaaaaaaaaatatatatatatatatatatatgtatatatatatatgtatatgtatatatatatgtatatatatatatgtatatgtatatatatatatgtatatgtatatatatggacatgcctcttgcaagaacatctgggaaactggaagcctaagcgactaagataattcttggcatatttaatgtttttttctgtaatgtattaatgatgtttttaattttaaaatgaatatctcaattttcagataaattgtgaaagtaacctaattgccttaattgaataaaacttaatattattgtcaaaatacaatcagaattatcttaataaatattggattctgcttgaattattcctgagatgcaatttcaaaaatgctagaggagaatatttctgaacatagcatagtaaacaaaatgttagaattgaagggatttgccaacaaacgtaggttaagaaaagaatgcctgtatgatataaggaagttcatgacatatcttggtttccaatctaactgccaaagcaagacattggcagattgtagacaagaataactttttcattttaggaattttcactgctggtaaatggtattccaagttgctatagagattccttgccttctaaaaggtatttcgtaatcacaaggccaggtacctagaagtatgataagcctaagcaaaatatataaaaacaaataataatggaagaaattaaataaataaaaacaaaaaatcttacccctttatagccaaatagaagccccatagtttatgcacataagtttatgtactttacctgcaaagggttctcacacactcatgcagcattgggtttacacttattttggattcagctatgacatacttggttatatggtattttaatattatttgcttccaacctgtgctgtgtgagtttgcatattgcaaactgacgggatagaggatatgctgatgagggtgggcccagtggcatgacagtggaaagggaaaaaagaatcctggaagagaggatatgtgagtacacaaacattgcagtttgggattatttactactaaaagcagatttgggtctcttcacagtggtagccctggccactctgaggggatcattgtatgacagtgtagtgctataattgatgtggagccactgagaatggtataaggccaggtgtggtgggctcgtgcttgtaatcccctccctttggaaggctgaggtgaggggattgcttgaggccaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagcctggggacagaggaagaccctgtttccacttaccaaaaaaagaatggtgtaaattatgtggtatcaactcttaacccttttaaggcagagagcatgtgaaacattttagaaactgaacgacatcagaaataaagttataaagctttggttaataggcatgttaagtcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttgagacagttttgctgtagtcatccaggctggagtgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctagaacatctttaagagtgaaggggagcagttagtaattgctaggcaatggatgtaaatcaggactgtctctggcaaactgggctatttggttactttatttctgatgcaaaattaatgatcaaaaagctgtccttggccgggcacagtggctcacacctgtaatcccagtgctttgggaggccaaggcaggtggatcatgaggtcaggagtttgagaccagcctggccaacatggtgaaacatggtctctactaaaaatacaaaaattagcctggggcagtggcagacgcctgtaatcccggctacttggtggctgaggcaggagaatctcttgaactcaggaggcagaagttgcagtgtgccaagactgcgccacagcactccagcctgggcaacagagcgagacaccctctcaaaaaaaaaaaaaaaaaaaagctgtcttcagacccctttcaagccctgttgaattcagtagttggttttagtttcagatgatgggttaggtaatgtttgcatctcattggctctttaatgacagttttcttttcataataattggcctttacatagtagaagttaaagaaacttggttattgaaaggggaaaagaaatgcatgcagagtaagaatactaaaattaatctttgcttttaatagtacaaacgtgtttgcaaacaattaagtttatcctgccaaaagaaatagcagttcagatgcttgtcaagtggtacaatgtccacagtgctccaggaggacccagttatcactcagagtggaatttatttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttgggatgtgaagaggaaggtttgatttgagggagatttaaagtgctttagcctgagtatctactctgttaatggtagaaagccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatccttttttttttttttttttttgagacagaatgtcgctctgtcgcccaggctggagtgcaatggcacaatctcagctcactacaggctctgcctcctgggttcatgccattttcctgcctcagcctcccgagtagccgggactacaggtgcccgccaccacgcccggctaattttttgtatttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggttgcgttcgtcacgcctctgcgtagaatcccccagtgacttcccatgtcactcagagtaaaggccataggcctataagatgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactatatgttttacttattttgttttgtatccctcctcccccaactggaatgtaaattctaggaaggcaaagatttttgcttagttttgtttactactctctctctccaggacctgtggtattgcctggcatagaaggatactcagtgaacatttgttgagtgaatgccgttttccatctgagtgaggtactgtttttaagagtttgtgtctatttcagcacatgaaggaattgctgtctgcaatttcctttagaaaaatcttatgggaaaatagggacaattttcttttcttttctttccttttttaagacggggtttcactctgtcgtctagggtggaatgcagtggcgctatcctggctcactacagcctctgcctcctaagttgaagcgattcttgtgcctcagcctcctgagtagctgggattacaggcatgcacctccacgcctggctaatttctgtatttttagtagagacagggttttgccacgtgggctatgctggtttcaaactcctgagctcaagtgatcctcccaccttggcctcccaaagtgctaggattaccttcttttcttattttaaacaattgtatccaagtgacattatccccaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctagggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattcctttttttttttttttttttttttgagacggagtatcgctcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaggtgatccgcccgcctccgcctcccaaagtgttgggattacaggcgtgagccacggcgcccggcgggcaagacaccctcagagcacagggtgctgccaagagcccggccgagtgcagctggagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacctcgcctcggtgcagggctccgccccgtcgcctggaaaggtgagtggatctcgaagagaccgacggcctcgacctggcggggcggtggcctcgacctggccgggcggcggcggcggcctcggcctcggcctggccgggcggcggcggcggcggcggcggcggcggcggcggcggcctcggcctcggccccggcctggccgggcggcggcggcggcggcggcggcggcggcctcggccccggcctggccgggcggcggcggcggcggcggcggcggcggcctcggcctcggcctggccggacggcggcggcggcctcggcctggccgggcggcggcggcggcctcggcctggccgggcggcggcggcggcggcggcctcggcctcggccttggcctcggccgggcggcggcggcggcggcggcggcggcggcggcggcctcggcctggccgggcggcggcggcggcggcggcggcggcggcggcctcgacctggccgggcggcggcggcggcggcggcggcggcctcgacctggccgggcggcggcggcggcggcggcggcggcggcggcggcggcggcggcggcggcggcggcctcggcctcggcctggccgggctgcggcggcggcggcggcggcggcggcggcggcctcggcctggccgggcggcggcggcggcggcggcggcggcggcctcggcctcggcctcggccttggcctcgacctggccgggcggcggcggcggcggcggcctcgacctggccgggcggcggcggcggcggcggcggcctcgacctggccgggcggcggcggcggcggcggcggcggcctcgacctggccgggcggcggcggcggcggcggcggcggcggcggcctcgacctggccgggcggcggcggcggcggcctccacctggacgggcggcggcggcggcggcggcggcggcggcggcggcctcgacctggccgggcggcggcggcggcggcggcggcggcggcggcggcggcctcgacctggccgggcggcggcggaggcggcggcctcgacctggccgggcggcggcggcggcggcggcctggcctaaggtacttctgttggggaatattgtgcagtataataatatatggacatgcctgctgggcatggtggctcacacctgtaatcccaacattttgtgagactgaggcaggtggatcgcttgaggtcggtcgttcgagaccagcctggccaacgtggtgaaaccctttctctactgaaaatacaaaaatcagcggggtgtggtggtgcacttctgtaatctcagctacttgggagtctgaggcaggagaattgcttgaacccagaatgcggaggttgcggtgagccaagatcgtgccactgcactccagcctaggtgatagagttagggttagggttagggttaggcaagacattggcagattgtagacaagaataactttttcattttaggaattttcactgctggtaaatggtattccaagttgctatagagattccttgccttctaaaaggtatttcgtaatcacaaggccaggtacctagaagtatgataagcctaagcaaaatatataaaaacaaataataatggaagaaattaaataaataaaaacaaaaaatcttacccctttatagccaaatagaagccccatagtttatgcacataagtttatgtactttacctgcaaagggttctcacacactcatgcagcattgggtttacacttattttggattcagctatgacatacttggttatatggtattttaatattatttgcttccaacctgtgctgtgtgagtttgcatattgcaaactgacgggatagaggatatgctgatgagggtgggcccagtggcatgacagtggaaagggaaaaaagaatcctggaagagaggatatgtgagtacacaaacattgcagtttgggattatttactactaaaagcagatttgggtctcttcacagtggtagccctggccactctgaggggatcattgtatgacagtgtagtgctataattgatgtggagccactgagaatggtataaggccaggtgtggtgggctcgtgcttgtaatcccctccctttggaaggctgaggtgaggggattgcttgaggccaggagtttgagaccagcttggacaacatagtgagactcggtctctacagaaagaaaaataaaatcagccaggcatgctggcatgcatctgtagtccttgctacttgggaagcttgagctggtggaccacttgagcccaggagctggaggtgacagtgagctataattgcaccactgcactccagcctggggacagaggaagaccctgtttccgcttaccaaaaaaagaatggtgtaaattatgtggtatcaactcttaacccttttaaggcagagagcatgtgaaacattttagaaactgaacgacatcagaaataaagttataaagctttggttaataggcatgttaagtcatttagaacatcatgtaatgctagctaagcattgctattcgtggatgcatatattgaatattatatatttactgaagtatgtaggcagtattttatataaatgtataaacatagaagttgtatgtttttcatagtgacttttttttttttgagacagttttgctgtagtcatccaggctggagtgcaatggcgtgatcttggctcactgcaacctctgcctcccgggttcaggcgattctcctgcctcagcctcctgagtagctgggattacaggtgcctgccacaatgcccaactaatttttgtatttttagtagaaatggggtttcaccatgttggtcaggctggtttcgaactcctgacctcaggtgatccacccgccttgacctcgcaaagtgcttagattacaggcgtgagtcaccatgcctggcccatagtgacttttaatttgtcacccgagctagaacatctttaagagtgaaggggagcagttagtaattgctaggcaatggatgtaaatcaggactgtctctggcaaactgggctatttggttactttatttctgatgcaaaattaatgatcaaaaagctgtccttggccgggcacagtggctcacacctgtaatcccagtgctttgggaggccaaggcaggtggatcatgaggtcaggagtttgagaccagcctggccaacatggtgaaacatggtctctactaaaaatacaaaaattagcctggggcagtggcagacgcctgtaatcccggctacttggtggctgaggcaggagaatctcttgaactcaggaggcagaagttgcagtgtgccaagactgcgccacagcactccagcctgggcaacagagcgagacaccctctcaaaaaaaaaaaaaaaaaaaagctgtcttcagacccctttcaagccctgttgaattcagtagttggttttagtttcagatgatgggttaggtaatgtttgcatctcattggctctttaatgacagttttcttttcataataattggcctttacatagtagaagttaaagaaacttggttattgaaaggggaaaagaaatgcatgcagagtaagaatactaaaattaatctttgcttttaatagtacaaacgtgtttgcaaacaattaagtttatcctgccaaaagaaatagcagttcagatgcttgtcaagtggtacaatgtccacagtgctccaggaggacccagttatcactcagagtggaatttatttgtgacttgtctcatgaacgtgatgggttttaacacagaccgcttagcatggactagaaatgtaagtaaatacaattgttttctttatgagttattctgttaatgtaatggttgcataattggtaatataacattgagactatataataggcgtaccatattcaaaataatagaataatattaaggtttattgtatctatatgttgtaaatcaaatctcacttaatatttaatgttaacattttactagtgattataattactgagctttagaatgttaaagcatatatgactatttctcatttcacctttgtaaaatgactgcaagttatgctaggattagtgatagtcttggttttattgatgaagaaactggatcacaaagaaatcacagatctgtgattttttaaaaactatgactagactgcatcttctgactccttgtttaacattgttttctgaagataagattgtctttttacacacatattgcttaggatgtgaagaggaaggtttgatttgagggagatttaaagtactttagccgagtactataccatctactctgtacttataccatctactctgttaatggtataaggccttacctctcaccctcttcccccagtaacatccttacaggcccttattagattatttacaaaatcagcagagtggtgtcttcagtattggtgatctccttctagctttggagatcactcccaggacaactttgcctgggtcactctgaaaaaaaatcactctagactataattaccccttttccaggtagctcagctgtaccattctatatgttttagccttgcacaccaaatcttttttttttttttttttttttttgagacagaatgttgctctgtcacctaggctggagtgcaatggcgcaatctcagctcactacaggctctgcctcctgggttcatgccattttcctgcctcagcctcccgagtagccgggactacaggcgcccgccaccacgcccggctaattttttgtgtttttagtagagatggggtttcaccatgttagccaggatggtctcgatctcctgacctcgtgatctgcccgtctcagcctcccaaagtgctgggattacaggtgtgagccaccgtgcctggccagcaaatccatttttaaaacttgttttttgtcttaattatgaaaggaaaatgtggaaaatggaggaattaagaaaataattatactactcagagataaccactctaaatatttttgatgttaccttctatataaaaataccaatgaaaatttcccgttatcattaaaaattttttctaaaatatctccatcatttcttcatagtgtagttttatcataattaaccaatagctaataattgtaccttgtgaatctgttgttttcgttattggaatttataaacatcctttttcacgactctttaaccacatctctagttacttcccaagaattgaatcttaaaagagaaactgtgaggtcaagtaatgtttggaaaggggttcccaggtgacattcttactagcatcatttaaaagcgcccatttcaccacagtgtttatttgtggtgtggtgaacctttgccagcttcctgagaaattttatcttatttctctataagtaaatgggaatggttttttcaaaatttcatcagttatttatagttcttattttttgattcgtatttcatgtcctttgtctatgttccagtctcttctcagaccagtggccaaagtaatcctgtttgataacgtcaggtagcgttcgtcacgcctctgcgtagaatcccccagtgacttcccatgtcactcagagtaaaggccataggcttataaggtgccatgtgacctagcccttgctcaccttcctggtcttatttcttaatgctttgcacacatcatcccggccacattggcctcagctctgttccctgagcactgccagcatgtttctgcctctgagtgtttgcacttgccattacctctatggagaatgctttccctccgacaagacgtgcttaggtctttattcagatgtcacctcagtgctgcctgtcctgtctctctctatagaattacacctgcctccatacctttagtgccatttacctgtttttctttcttctcacttaattaaatataatatactgtatgttttacttattttgttttgtgtccctcctcccccaactggaatgtaaattctaggaaggcaaagatttttgcttagttttgtttactactctctctctccaggacctgtggtattgcctggcatagaaggatactcagtgaacatttgttgagtgaatgccattttccatctgagtgagatactgtttttaagagtttgtgtctatttcagcacatgaaggaattgctgtctgcaatttccttgagaaaaatcttatgggaaaatagggacaattttcttttcttttctttccttttttaagacggggttttgctctgtcgtctaggctggaatgcagtggcgttatcctggctcattacaacctctgcctcctaagttgaagcgattcttgtgcctcagcctcctgagtagctgggattacaggcatgcacctccacgcctggctaatttctgtatttttagtagagacggggttttgccatgtgggctatgctggtttcaaactcctgagctcaagtgatcctcccaccttggcctcccaaagtgctaggattacaggtgtgaaccatggctcctggccttcttttctaattttaaacaattgtatccaagtgacattatcctcaatttttctgttctttattacatgtgaaaagattaagcctcatagaaactggatttctacattatgaaaaagcatgtcagctttctgtagttttgtgtatcattgtccttggaacttgttgatgagtacagattgttgtgtcctagtctctggcagagaacctatgccccctcgcgtttccatgttttggggaggactgagcacctacccattttttcctttgcaaagaaggacatggctctttgacttacttattgcatgataattataaaggaaggaataaggaaatcaattcttgaggccaagttgctttgccatttatttataggactgcgtggttaaacccttgctatcttttgtcctcatagtcaaagcttaggatgaaatggtcctcattggcaaatggttttcattttgctttgttcagatttattctttttgttttcacatatataatgtggtggagtacagaatttctgccaatgactcgttacacaatttttggcatttctttgtgctttctttaatttgctgatgtgttacatgagtgcactggactgtacattgtaggaacagttgcatttggggttaactttttgtggcttttgggctgctctttttttcattagataaatattgaatccctgctgtgggccaggcatgatgccaggtttctcacatataccccagacaaaacagattgttcctctggaattgactgtcttgagggaaacaaataaataatatttgatacatgtgttatgatagatgaagggtaagggtccataggagcatataacagggttggctaacctgagacacattgaaagagtgaagattaaacagatccatgtatggcacaaagagccatccttatcaggcagtttctactttctcataactccaggccttatgaatctgataattatagcagggacattctttttgactgtgggactttgtgtgtgttacattttggttgaagttttaggttagatagttactgttatatttgttgctttgatttcactgttactaccaggttttttataatatatatgagttgggctgttttttatttgaatgcttcacaagcaaatcttctctctcaataacattcggttttaaaaatcactttattgctacctatgtttagtttttatatagaaatcaactctgtttaggtgagtgagttgataaatatgtaagtttttcagcataggaaaatagccattgccatttatagagttacagtttattagttgatggtcaatgtccatgtgaagtagctggggcagcaaagattatgccaggggaaattgaagaagagcaacttgcagaaaactgctttgatgtagttgtactagttaaaagataggctcactattgtaatagaaaggcctcaaaagatacaatggctcaaacacaataaaaatgtctgtcttgtttacataacagggcttagcagataaacaggccacacagttattcaggaacccaggttgatggaggatcttttgtcttcggttcaaagcttgccgttggttgactgcattccagtcaggtggaaggggcaaagagcctggaggagcaggggtaggactggactggtcctggaagtgatgacagtgacttccatttataattaactctgtcaaagggtcacacctaacttcaaaggaggcagacgtatgtatgtagtctggctgtgggttcagtagaaagaggagaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgatgtaatctatgtcgttacagaagtaggagagggaaggaaactaccattaaaatcagtccttaggagcccaggcactgttctagatgtttgcatatattaatatgatttcatttcatctttacagtaacctggaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacttttcagtttgactttgaaggatcactttcccctgtcattgcacccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttttgagacggagtatcgttcttgttgcccgggatggagtgcagtggcacgatctgagctcactgcaatctccgcctcccaggttcaagcagttctcctgtctcagcctcctgaatagctgggattacaggcgcccgccaccatgcccggctaatttttgtagttttggtagagacagggtttcaccatgttggccaggctggtctccaactcatgacctcaagtgaccttcctgaccttggtgtcccaaagtgctgggattacaggcatgagccactgcacctggcctccatggtgttattcttaagtggtccaaatatgtttttttaaattgtggtgtaatttacaaaaatgaaatacatcttgagtttacagtttgatcagttttaatatatgcacactcatgtaacctacactcctatatagacacagaatatttttataactccataaaatttccttgtgcggttttttttttttgagacggagtctcgccttatcgcctaggctggagtgcagtggcacgatgttggctcaccacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatattgttacagatacccgtagtttgtgcttttttattgctgagtagtatgaatataccatagtttgtttatccatccttcttctgctggtagatatctaggctatttccattttttttttttaagtcatgaataaagcaagctactgccaaaattcactggcaagtctttgtggatatatattttctttttttgggggagggggacagagtcttgctgtgtcatccaggctggagtgcagtggcacgatctcggctcactgcaacctctgactcccaagttcaggcagttctcatgcctcagcctccccagtagctagaattacaggtatgcgccaccatgcctggctaatttttgtatttttagtagagactggattttgccatgttggccagcctggtctcaaactcctggcctcaataatccgcccatgttgacctcccaaagtgctgagattacaggtgtgagccaccatgcccggcccgtggacatacattttcatttcttttttaagagacggggtgtcactttttgcctacgccggactgcagtgatgctatcgtagttggctgtaatctcgaactcataggctcaagccatcctcctacctcagcctccaagtggctaggactaccggtatgctccatcatgcctggctaatttttaaatttttttggcagagacaaggtcttactataatatgttgcccaggctggtctcaaactcctgggctcaagcagtcctcctgcccctatctcccaaagtgctgcgattacaggcatgaattttaatttcttttaatttaatttaatttcttttaaattaaaattcacatctgtaattttaatttcttttaatttaatttcttttaaatgaaaattcacgcctgtaatcacagcactttgaggggtaggggcaggaggactgcttcagcccaggagaccagcctgggcaacatattatatagtaagaccagttgtctaccaaaaaaatttgaaaattagccaggcatgatggcgcataacctgtagtcctagctacttggaggctgaggttggaggatgttaaacactctttcatgtgctcattagctgcttatgtatctttttgtgaagtttctgttcaaatctttatcaacttgtaaattagattttaaaaaatttgtaagctggtgaagttcttacatgttctagacatgagttcttgaccatattttcccttagaatgtggctttaacagtgtctttgatgagcagaattttttattttagttatccaatgtatcagttttttattttattttattttatttttgagatggagtcttgctctgttgcccaggctgtagtgcagtggcatgatctcagctcactgcaagctccacctcccaggttcacaccattctcctgcctcagcctcccgagtagctgggattacaggcacccgccaccacacctggctaattttttgtatttttagtagagaccacgtttcaccatgttggacaggctggtcttgaactcctaacctcaagtgatccaccagccttggcctcccaaagttttgggattacaggcatgagccactgtgcccagccaaggatattctttttataacattttcaaaaattaaggcatattgtatatacaggaaaaaaaatgaagcctatgatttatatttacaattgctttgatttaatacaaattaaaatattactgtttatgagaatgagattctaaatgtaaatggaattcacagaatgcataatttttttctcgtttaaagaaatagagtctcgctgtatgcctaggctggtctcgaactcctgggctccagccatcctcccatttcagcctcccagagtgttgggattacaggcgtgagccaccacgcctggccttgtacatgttatatagtgaccattttgcacaagattgtttgccaaatgaataattaaaaaaatccatttagtgtactttcctttaaatattttcacacctggagttaaaacattgtattttataaaatgttattaatataaaaatacttgtaaataaacttgtggctatgtagaatgtagtagaggacttttgcataagcccagagcctagtttctaaaggtctttagaaatatataatagacatagaggggaaagagttgggggaaatcagagggaggtataattctggtctctcgtcgttcagttctttttcattcagttctctcaggcacgactccagccacttagttttatatttcaactggatgttgacccaattaaaacaattcacagctcctgaagatgaaatactatgagtccctgctttggacacatctgtagtagagtaggaaaagataaatataacccaagtaattgttacagaatcttctgaaatatacaaatggtaaaaggttttgtagggcgtgtactggggaaaaagataatttttcaacatgaaccttttaagagcttgtgagtctcaaagagtctttaattgataggtgatatggataatactcccctttgggaggaggtttataatacataaacaacctccccacccttccctcacagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagtattacaaggttcagtgaattgtctgagatctcacaaatacaacctagataagaacccaggtattattattttcagtcttgcaatattattttcctacttgcaatattatcttcactcttcattaagtttgcacagcaaagtaatggaataagttctgggctttaatccttgagtagtttggaactgtaatgtgttacatttgagagagagcccttcattttgaataaaaccttggtactgttcctgatcttctaacttgggttaatgctcttcccattttcatgatttttttcatttgtgaaatgaagtagttgcactagatcattttcaattttccttcccacttaaatcagttttaattaaaaaaattgcagatgccttttctcagattggagtacactttttgctccacacaatatctggtgtgtaaattggtatgttccgtggagtaaatacctttcctgactagccattaacttacttctgattcctgaatccactaatttaactattgttgaaattactaaaggaaatttttctttagcaaatgtaaaaactcatatcaggtctcaggtttgatgttgtaaagcactctgactcttaggaagactctttttttcccccaacctctcataaacaaattatttcattcattataaaatttcattcattacattttcattcttcagacttgcagtgtttcctctctgctaagtatagtgttaaacactggcaaaagaactctggacacaacatcatgaacttgctctctgggatcttataatctagttgcagaagcagattggtaaatacatagtatagcacaagtactataatggaggcctgaactgagtgctgtgggggtacacagatgaaggcttctgggagacatcatggcataactagacctggaggatgaataaaactttggccaagtaaatacagagatacatgaaaagcatggataaatggcacaagtaggttcagggatgataaaagtgttagtatgtggagagtgtacaactattttggggaatggggaaacagattaaatttggggccagaccccgaaggatgtggggatcccatcaaagtcttttaagcaggagaatgatcagatgcattttttggtatactacctgggggataggaggaagtggactacagaaggggagatcagtagaaggaagacaagttaggaagcttttcagtcattttcattaaacatgaagcttaatacatattgttctaagatcaggaatacagcaataaagaaaaaaacttgctgtaatgaaacttacattttcttgggagagacagaaaataaacatgaaaaacagatgtgttcaatggtgataaagcagaaagggagatggggagtcaagtgcatgtggggagggtgtttagggaagcacttatgaaagagtaacatttgagcaaagagccctgatacaagacaacaatccagacccaagacatttgaggaaagagcatccatataaagggagtgggaggtagagaaaacctggaccaggaatgagcctggtatgattgaggaaaacacaagggatgtggccagagaataataagagaataaattagaggggtaataggcaattgtatagggccttgtgagccattgtgtggaccttggatttcactcttgagtgacctgggagctaatgggggattaaacagaggagggacaggatcctctatggtatatggtaaatgagtagtatggtaaatgaggtaaatgaatagtaaaaggaactgctgtggtaatttaggtaacagatgatgatggtttaggtgaaagtggttggattgtggatatggtttgattggtgttagaaccaataggatttagtggtggctggatgtggacaatgggagaatagaatgaaccaaagctattgtaaacgtctagaaatcagatgaggacttgacgaaaggcattggcaatgagaaagtagacaggcaccattcatgaggtatttcttagcattgatagagttggatataaatatctggaattcttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacgctccacagtcttatcgttcatagtttcttggcaaactcaccactcaagctgtgcctcacttatttaggagatctgcctcactagggtagacattttaggtttatgactcttaagttttcacctggacagattggctaacaaaaagaacctcacaggtgggtgaccttgaattcaccaggtcatgccatcagttcagagcggccggagaactctgttctcttgtgcattgatgcccccggagttgtgaaacacagtggccctgcttcagttttttagatttagaaactggtcagtgtcagagcgatcagacacagaaatgttaattcatgttcaaaaataataaccaggctagcatttgtttagcacttgctatgtgacaagtactgttttaagtgctttacatgaattgtttaatcctcacaacaaccctgggaaataggtcctattattaggcgccctttctacagatgaggaaacagacaacagattggtaaatttcccaagatcacaaagtaagtcagtaggagctcaaagtaacctgactccagagcccacactctttttttttttttttttttttttttttagctggttcacgtctctttaatgagatcaaaggctcctgtgtatgtcttgcgggggtaaagctagcacagtcccccaatactgcccctctcctcagggctccagccctttcaggcagattctaggtaggcagggaggggccaaaaggaacgcaaggagttgggactagggctgtttctggtgggcaagtaacccatccaccctctcaaaactacttatgggatgtccccttcactggaagacagccccatgggaaagacctgcggtacagaatctgggggcagtgcacacggggagtagtcctccagatctggcagggtggcactaaccctcacctccttgactggctcagcctcaccggaggcaggacaagggcagagcttaataccggagtcgccagttaaacggcgatagcggcaggaggggggtgtgggggcaggggtcacccctgccccagactcaccctcctgatgagggagggcactctggtgggaggaaacaccttccacatttgttccttcaaaatgggcagggcagctggatgaggaggaacagcaggtttgttcactggaagcagtcaaggggcggcctggggcgacagtataaggcgcggaggcggggggcggggggtggtgcctgggcggtgaaccacatcctcgtaggctgggggcttgaaggtgctgaggaggcgaaggtcaagcagtgaaccggtagggaaaggaccagccccatggcatgccccatgataagccaacaagttgatttcacgctgccgctgctgttgttgcagcctgagtttagctcgtcggtggcggaaggcccaacagcagctaaagaggatgaggacagtccagagcagccagaaccaccagagctcatagtagtaggtgcagcagccagtctccccgcagcagtgaacactctcacagaggtagggctggttgttcactcctgggcacagctctcgaagctgctgttgcggcgcccgaagtgccccccaggcctcctcgctgccgttcccgctgctggcccgagccatacctccacctacagccccctgaggaccacagcctcctctaccgccagccgccccgcccctgccacctctgctgccactgccatggtccctgcccggcccatcttcgctgaggccaccatcactccgcggccggagcttccatccccagagcccacattcttatctgagcatatacatccccatcacaagagaacgccagtttattcaagtaaaataaggactagaaatttacatcagggaatgtattctttcactgtagaatgctgaatggaaaaccaaatttcaatagttgcctactgaacaagatcatgagataacaacaagggagttgattataaatgactagaagttttaaatggcatcgactctgataaagtgataatctcagctccatgatatactcgtcaagcagttacttacatcaatctgccttataggatatcctttctcctggttaatgcttatgtgatagtgttttgtacctttcctttttcactgctttcattactgaccaaactactcacccccatatttctggtagatatatttcttttcattgcatgttagtatcttaaatttagtcctatcttttacttgatcctccgtgcttgacttcctaatctatgttctggtttatgttttagttttacagttgagctttctgaggacattcttattcccagtatctttttttgggtggttgggttctgggaggtggtatttgactgctgctgatgtgtaccaaccaagacagtagtcattaagtgactaacaataatgatttcagcagattattactcttggcaaagagcaagctttctctattataaatgattttatatttgttttgtttttctttatttgtaatttgagttctagcttaacattattacttcagataactgttaatacattttcataaatcatacattcttgaatggcaaataaataaataatcaagttccaagtagtttctaaagagagtaaacattaaaagtaaacataaaactacataaaaatcgatcacagtctattcataaagttggtatgaaaataaagatcctagatttggaaccctcatgatactcaatattttacatatatcagagtttgtaatttccataacttcatttggtagttagacatatagacagagaagataataatatattcattatatatatatttatgtattatattcattatatatatatttatatataatattcatattatatatatatgtctataacatatagacagagaagataataatatattcattttatagtttaggaaacagacttggaagggcaaataacttgtctaagatgactaagcagctgagtgagaaccacagcctatctgtggcattcagtttcagccatctttcccttgcttcataaggatagttactctggtatcagttgctggattgggattttgggcatttataaatgtttttattttggatattactgaatcacagacaatttcatcttagttaattaaaaattcatcttacgtgacacttgtctaaatcttaaaatattaaaattttaatgtataaggatgttaataatctttatattttaagagactatgaagtcaagtctagctaacttagatctgtaagtttttagctatggaaagcaattctattgtgtacaagtttcagcctgtgaagggaattcattgaaaatgtatagagatcagaagaactaacacctttcttgcatggatttttcttgattattggcagttaacaataaaatgttattagatcactggtgcttctgtgtggggttgagttttttatgatatcttctgttagacccataagggaggctgtgagttgttttctacatccttggaatatataagatcctcttttaaaattatattttatataagcacatgaaaatggaatgaaataatgaattgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatatacgtgtatgtatataaatatgtatacacatatataatatctggagcaaaaatgattatgttgtaagaacttttggaggttttcctcctcgtaaaattccgaagtggtagagttaacattctgcttttaatttatctacaaaaacatgtgaagaatccccaaataagattttctcatagaagattcatggattttgagtctcagaaaaaaaaggaagaaaaaaacttcatggtataaaacaactaaaaattaaatatagtctttagaaatgattttgtttagtataaataatactggtatgacaactgaatgcaattgaaattatgatataaaatttctattctgctttgtatttttcattaaagtttttataattgtcatctgaaaaaggatttaatattcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctaaaattggaaaatgaatattcagatactaagagtaaattttttttttttttttgagacggcatctaactctgtcacccaggctggagtgcagcggtgggatcttggctcactgtaacctctgcctcccgggttcaaattattcccctgcctcagcctcctgagtagctgggactacaggcccacaatgccatgcccggctaatttttgtattttttggtagagacggggtctcaccatgttggccaggctggtctcaaactcccaatctcaagggatctgctggcctcagtctcccaaagtgctggaattacaggcgtgagccactgcacctatatgacatacttgaaaaaatattcttgggccgggtgtggtggctcacgcctgtaatctcagcactgtggaaggtcgagggtggatcacctgaggtcagtagttcaagaccagcctggctaacatggtgaaaccccatctctactaaaaatacaaaaattagctgggtgtggtcgcatgcgcctgtaatcccagctacttggcaggctgaggcaggagaactgcttgaatccaggaggcgaaggctgcagtgagcagattgcaccactgcactccagcctgggagacagagcgagtctctgtctcaaaaaaaaaaaaaaaattctcactttctgttgttgttgtttgtttaatgattaatagacgatttatttaagcaagaatacatagtcatcattgccagacttaatatgacaggttaaatgttggacccaattttccttcccagataagtttttctttcctatccctgtcagttttgaaaacataataccagaagaagaggggcccaattccacacagagctcccaagagtgagtttttaggagtgggtctgaaattaggaaagacacttgctgatcttgcataggtccaaggaatcaaggcaggattttcgatgagccctcggcagttagggtaagcaggtttcagccaggctcttaatggtcaaccacttggcttgcgcctgctgggtttccgaagacatgtcctattcggctggtttgagggcatagtggccaggggtgaaggagtatactttgggaacgacatcttggcgacccagtgcacaactcacttttttttggaaacgaggttggctctgtcgtccagactggagtgcagtggcgcaatctcggcgcactgcaacctccgcctcccgagttcgggcgattgtcctgcctcagcctcccaagtagctgggactacgggcgcacaccaccacgcccggctaaattttgcatttttggtagagacggggttttgccatgttgcccaggctagttttgagctcctgggctcaagcgatctgcccgctttggccttccaaagtgctgggcttacaggcatgacactctgcctggccagatttttgttaccctgtttagatatgatggtaactgaatgatcatgcaatctctgaccatgtgacattcagggataccaaaaatgacttgagatgggccaaggcagaattggagaagcatactttggctgaatacttaggccaaagtataatttggaacatttcttttaaaaaatctactcccctatgcctcccagttgcagtaccttacaattacagttaatctagtagcagatacttgattgggatattaggtatttacagaccaaatgcccattgggatattactcggtaacaggcagtttcactctggttcattgtagattcatccagtaagcatttctagagaactgctatatgaaaatattgtggaaagtatcaactttttaaacttttgatgtcatgacacctagaagattattttctgatactcatattctaagggaattttattttctgagatttgtttctgtggaatttttagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggtaagctaattctgtttggtttattcatgcaatagtctgtctctgcttatgacataaagtataatatattttaggaatagtgtggttttcttcatgatgtcaaacatacaagcttatggatatatttaaaaattcttaattttctagattaatgttcagcactacttcttccatcttgcattggatgggggcagataattaataattatcagatattttcttatcaaaaacaaatttgttggaaaaaaaattttttttttttgagatggagtctcgttctatcacccaggctggaggtgcagtggcgcaatctcggctcactgcaagctccacctcccgggttcacgctgttgtcctgcctcagcctcccacgtagctaggactacaggcgcatgccaccatgcccagctaatttttttgtatttttagtagagacggggtttcactgtgttagccaggatgctctagatctcctgacctcatgatctgcctgccttggcctcccaaagtgcggggattacaggcatgagccaccgcaccaggcctcaataaaatattttataaatacctttaaggaataatacaaacacaaccagagcttaaataaataaatgtaaatcaatctgcttgctggttaagtaatgagttcagtgtttccgcacagaaagtgggagagatagatgaagaagaaaataaagcttattacatgttgggaaggattctaggcactaagttcctttttttgagacagagtctcattctgtcgcccaggccggactgcagtggctccatcttagctcactgcaacctttgcctcccaggttcaagagattctcctgcctcagcctcccaagtagttgggactacaggcacctgccaccatgcctggctaatttttgtatttttagtagagatacgggttcaccattttgaccaggttggtctcgaactcctgacctgaagcgatctgcccaccttggcctccgaagtgctgcgattacaggcgtgagccactgtgcttggccagttctaggcattaagttataattggttcatttggggactcgaaattctccattttattttattttattttattttttctgcttttgtcacaaaagcacagacattgcttaacaaagaggtctgagacaggatatgaatgttaagctcagggacatagggtcaacacttttgagtgcacagactgggaacctggcagagttttaacaatcccctcccctattttcaccatcccttagtcctgtagaagtagagcagatgattacgtattcactgctgtatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgagacaagaataaccagaatgatgataaggagacactggaagtcactttagattgatgaccaaagatttccttattctgaccaggaggtcagatctcaagggtccttctgagtccacttttgattagccaaattgtcttttctttcagtttgactataggttagtcaaccttccctccacattcatcagggactgttagcaatatgtcatatttttttcttggtgtaccattaagcaatctaaagctatgctgttacctgtaaccacttggattaattattttagattagttggttatacttctagggctttatggctttatcttttcagtcagcattattaaccaagttttgatagctttttcaacttttgtaacccccatccagggagatcagtgtcctctcagacacttccaggtaagcatgatctcctggaagacatgagaagtctcttaaattgtctaattattacattggagctacataataactccaatatacctggagttattatgtgtatatgcaagttaggttctaatgaggcaaatataagtaaatatgttgttgattcaggaggtaaaaattaggagagccacgtgtagttttaaaaacaaaagaggaattacttgtaacagaagtaagtaagaaaggaattctcagttatctcttgggtagagataccttgcatagagttcagcaaaaattgcaaaggttgtcataggactatggaggccattaggctaattaaaatttataatattgcccatatatttgtactaagtctcattcctgaaggattttatatttgggttgaggctttgagaaattctaagactggcttgggcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttggagactattgatactcatcagattttaccactgataatttttcaagaggaactgtttatgaaactataaagagaaaatggagatacaaaaagccatccaagatgtaaatgccgaaggccaagttttgagataaacagaaaatcacaaaaactcatgtcaggtggttcttccatggccccagtgtgagcagacagtattttccttgaggagaaatactagtttggtgggggtaaggtagggagttaaactttaaggattaatcaagagaactatacatatgctatttaggttgagggtaaagatcagagtaggcatgggcaacgcctagactcaatcaagttacctatcaagcaagctgacatattcagacaaagcaagactccatctcaaaaaaaaaaaaaaataaataaataaaaagaattccttcattattttgtcatgctttaaggcccaggacaggcctaggcaaaagttttgatggccttttgttacatcccagcctttgtataagggcactggcttttagtatttaacttcattcagtcattactgaaacagttgttatggaagtctgcattagtgagacctggcctgccacaggaggttgcagtgagctgagatcgtgccactgtactccagcctgggcggcagtgtgagactctctcaaaaaagaaaaatgatgcagaaagatttgtttgacacagagtgggcataaactttcaatttgtcaaaaacatagtatctgtgaagtacaataaaatgtagtgcaataaaatgaggtatgcttggatagcaaaacatcatgttgtacctagtaaaggtatacaatttttatttgtgaattatacctcagtaaagctggacaaatgaactgtatttgcaacatggtaggaatatatgacattggacattaatgcaaatggaattttcagtgccatggtgaaaatgttataccactgaacaaaaaaaaagtagtgtgaaatgaagtaaaatgtgaaaatccgtaataaatgcagaaatatgaactgcttatccaaaagagaaaagtcttttgagttcctcaagaagattctctctttggatgctgggcacggtggatgccgggcacctgtatccgagcactttgggaggctgaggaagatggatcactggaggccaggagttcaagaccagcctgtccaacatggtgaaaccccgtctctactaaaaatacaacaattagccgggtgtgatggcacgtacctgtaatcccagctactcgggaggctgaggcacaagaattgcttgaacctgggaggcagaggttgcaatgagccgagattgcgccactggagtccagcctggaccacagagtgaaactccgtctcaaaaaaaaaaaaaaagaaagaaagaaagaaaagaaggttctctctttgggcactccttttcaacatattcagcataaatgaattaatgataccatttttactaggtgagtgtgtttgggcaagttgcttcagtgctcattctcttggtttccttttttttttttttttttttttgagacagggtctttctctgtcacctaagctggagtgcagtggagtgaacatagctcactgcagcctccaacacctagcctcaagagatcctcctgcttcagtctcccaaatagctgggactactggcatgtaccaccatgcctggctagtttttaatttctctttttttgtaagcacagggtgttgctatgttgcccaggatggtcttgaactactgggctcaagtgatcctcccacctcagcctcccaaagttttggattacaggcatgagccatggtacctggctgtcttttgctttccttatctgtaaaaactgaggataataacagtacccttacaaagttggtggaagaatgatattagttaatacaaatgaagtgctaacaaaaagagctttggaacacagcaagtacttgttaggtatggctattgtcatcaacacacttttcaaggcaaacttgtggtttcacctatcacctgagatatatgacttctaagttcatcagatcttctcttttggtttttatttttaaattaattaaatattattattcttattatttgagacagagtctgctctgtcacccaggctggagtgcactggcacgatcccagctcactgcaacctccacctcccacgttcaagcaattctggtgcctcagccatccaaagaagctgggattacaggcgtgcaccaccatacccagttaatttttgcatttttagtagagatagggtttcaccatgttggccaggctggtcttgaactcctggcctcaagcaatccacccatctgggcctcccagtgtgctgggattacaggcgtgagccatcgtgcctggccctcttttcattttagagataggaatctcattctcttccagaggctggagtgcaaaggcatgaacataactcattgcagtctccaactcctgggctaaagggatgttcccccctctgcctttggagtagctgggcctcagaactgtgccacaactactggcttccatcaagatctctgtcctaccatttcatcttcctactaggctatccccacatggatagataaatggtacctcaagtgaaagaaatcaactacctaaaataggattttccactccaaactagattttctttacatgtcatttctgttaatgtgggccacacacactggtaagctcagaatcatctttttcttttcttttattcacatccaatatggttgaaataaaacaaaatgctgtttttccttttttagaaaggcaatacttgttcattatatcaaaatttagaaaatatggaaaaacaaaaaggataaaaaattatccacaaccaaaatagcccaaatttccagttaaaaatatcaacgcatttgatatttgtccacataattaagactgtaatgtttacacaaatgtgagcttttaaaatctaaaaggctctcactattaaaaatgttttgttaaattttgttttaaaagtaagattttaatatccaaattcccaaaatagacatttttgaagatttggaaaatacagacggctgaaaatctttacattattactgttaaattttggtatgttctgttattctgctagtgaaatatatatagatttggggggctattccttttccttttttttttttttgagacaagtgtctcactctggtgcccaggatggaatgcagtggcgctatcacagttcattgtaacctggaactcttgggatcctcccgcctcgacctcccaaagtgctggggctaccggcttgagccactgtgccaggcgaatggctgttcctatatacacagttgacccttgaataacatgggtttgaactgcctgggtccacttataagctgacagaaaatacagtattggaggggcctgcatatagagaggtctgacttttcctctaagtgttccacccgcaggactgactgcgggatttgagaatgcgctttgttttttttttttaggaagtcttactctcgcccaggcttgagtgcagtggcgcgatctcagctcactgcaaccctcgcctctcagtttcaagcgattctcgtgcctcagcctcccgagtagctgggattacaggggcccacctccacgcccgggtaattttttgtatttttagtagagatgggttttcgccatgttggccaggctggtctccaactcatgacctcaggtgatccgcccgcctcggcctcccaaagtgttgggattacaggcgtgagccacggcgcccggcgggcaagacaccctcagagcacagggtgctgccaagagcccggccgagtgcagctcgagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaggcctacggggagcggtacgtcgcctcggtgcagggctccgccccgtcgcctggaaaggtgagtggatctcgaagagaccgacggcctcgacctggccgggcggcggcctcgacctggccgggcggcggcctcgacctggccgggcggcggcctcgatggctcaggcgtcatggctcccgacgggcgctgctccctggcgcgctctgttgaggcgccggcctcgacctggccgggcggcggcggcggcctcgacctggccgggcggcggcggcggcctcgacctggccgggcggcggcggcggcctcgacgtggcccggcggcggcctcgatggctcaggcgtcatggctcccgacgggcgctgctccctggcgcgctctgttgaggcgccggcctcgacctggccgggcggcggcggcggcctcgacctggccgggcggcggtggcctcgacgtggcccggcggcggcctcgatggctcaggcgtcatggctcctgacgggcgctgctccctggcgcgctctgttgaggcgccggccggctggcgcagtcctgtgggcggcgtggcgcttgcaagcgcaggaagagtcctggggggaccgcggtgggcgggatacctttggcgccggatcttcctctttctcccggtttgttcccgacggtgctcgctcgtgggcccgccctggcccgggctttctggccccatagtacccgcgcggcctagttctcgggggcttgggcacccgggtgctgtatcggcgggtttcttcccatgtcctggacatttactttatatgctgcggcggaggtcgtacctccttggcctggaggaacccagtggggactgacgcagctccgggtgagctttggcggctgtgtcgagtgacaacgtaggcatctcagcacggacatttgcagtggcccgacggcgcaaatgacaggggaagtccccttgttttgagtatgaggtgtttgtcgctgtccctttataagggtccaactccactcatactcacctccctcgccccccccccaccccgcccagaacactttggtagctgcctttgcttaaaaaaaaaaaaattctaaagttcttacaaatcgttagtatggcttacaatttttaaccttttccacaaatgtttttagggtatttttcctctttacaggtaaataatgtgatctattttggattcaataagactttagtaattggatctaaagagtgacggaagaagctattaaaggtggatgtgcacagaatcttgagtcagtttgctttggcttgaataatcacagcactgtcgtttataagctgggtatttggggccagttacacttttcatccatagatggagttgtaacattaatagaatttgataggatgatccattttaaacatttagggtattgcttgacacatagcactaagtgttagctacaagtcactgtttttattgttgatgttaaaaggatattggcggggcgcagtggctcacgcctgtaatcccaccactttgggaggccgaggagggcggattgcctgaggtcaggagttggagaccaacctggctaacatgtcgagacctcgtctctactaaaaatagaaaaaaagttagccgggcgtggtggtgcacacctgtagtcccagctacccgggaggctgaggcaggagagtcgcttgaacccgggaggtggaggttccagtgagccgaggtcgcgctactgcactccagcctgggcgacagagggagactccaaaaaaaaacaaaaaaaaaccaaaaaacggaaactcaacggatgaccatgattataatagtagcataattgtgtctcttatcataactaagcatacgttatcttattttgcgcttccagcaaccctgtggatattgagacctgtagagatttaagatacttgttcagggtgaaataggtagtgcagcagaattttggcagtgggtctgatttagtttctcttgggaacagtggagtaagttacagtctattcctccagagaagaaggatagatatctacttgtacattgtaatttcaaactgctagcatagtataaatatgaatgtgatgatagagtctaaaacagaccttaattgagggttcctgtaactcctgaaattaaagactttaatttttgtgttatttttttttttttaggtggggtctcactctgtcacccagctggatgcagtggcgctatctcgactcactgcaacttccgcctccccagctcaagcgatcctcccacctcagtctcccgagtagttgggaccacaggtgtacccaccacacctgctgttttgttctgttttgtttttatttttggtagagactgggtttcaccatgttgcccaggctgttcttgaactcctgggctcaagtgatttccccgcctccacttcccaaagtgttgggattataggcgtgagccactgcactggccattattttatttttgagacaaggtctctttctgtctcccaggctggagtgctgtggcaggatcgtggctcactgcagcgttgacgtcctgggctcaatccatcctcccaccttagcctcctgggtagctgagactacaggcatgccagctacaggcatgcgccaccatgcccggcttttttctttaatgtagagacggggtcttaccatgttacccaggctggtctccaactcctgggctcaagtgatcctctcgccttggccacaagtgctgagattacaggtgtgagccactctgctcagcctgatttttttttttttaaacaagcttaaaaaaaaaaaaagcatgtttagagcctttctgagattcttagtggggatcttggcttccaaaagattaaaaaccactggtctagacagaagttagaatgttctttcaactacataacgtctccattaaataaagtggagtggtagcaacattttgaggattggttattatgaccacctctcttacacttagagtcttttttttttcccccaaatttaaagtcatttacattagaacctggggatttcagcggaatatggattaactagtgagtaactttggaacatgtgaagctattctgtaaagttaggtttgagtgaaatgacaaaacagggtgctttggatagaaggtaaggaatggagggagaagaggcagtggctgtgaagaatataaagaggttaatattctcccccagtttggcagagactggccatctgtgaactgcccatgctttctagaatgtctgagttttggagtgtgatgatgcgtctgtatatcatatctttctagtcttccattgtgctttcatttgttagtcttctcttgttttgccatttttgtactccctcacatgtgcttttgcccttcttaaaaatattcttcgtctgtaatccaagcactttgggaggcagagagaccagcctgaccaacatggtgaaaatccgtctctattaaaaatacaaaaatgagccgggcgtggtggcagcgcctgtagtcccacctactcggtaggctgagacaggagaattgcttgaaccctggaggcagaggttgtggtgagcagagattgcgccactgcactccagcctgtgtgacagagcgagactctgtctccaaaaaataaaaaaataaaaaaatatataattctttctctagtttttctttttccagatggcttctgtttagtttttctatgttctgtcaagttggtttcttattctgcagctgattcctacttctcaaactctacttgacagctcttatttttatttatttgttttttagaatagggtcttgctgtgttgtccaggctgccatcaaatttttgggcataaatgatcctcctacctctgttgcctgagtacttaggactacaggcaggcacctttgacagctgttagttgttttttctgccctttacatctatacttcatgcttctgagtaacacacacatatacttttgttattttgaattccctttctcccattttagacattttgttttcttttttttttttgagacagagtctcgctctatggcctaggctggagtgcagtgtcgcgatctcggctcactgcaaactctgcctccggggttcacgccattctcctgccccagcctgtagctgggactacgggcacccgccacaacacccggctaattttttagtatttttagtagagacggggtttcaccgtgttagccaggatagtctcgatctcctgacctcatgatccgcccgcctcagcctcccaaagtgccgggattacaggcgtgagccaccgcgcccggccccactttagacattctgtactggctattatgctcctccaaaactgtcctcagacactttgctttgcccctcattgtttcagtactgttattggagtttttgtttaaatgaatatttaacatttatataaatataaggtaaatattttgcatttgaattgcccttgttgtgcagttttgtttttcctggactgaataattgctttattttttggtttgcttgtatgttgtgttactacttggttacttaaactcagcaacttaaaccctcaaatgtggtcaaactggtcacataatccgatcaatttcagcttaaaacattgattgattgattgattgattgattgtctgtctacctggaatacccttactaaccgacttctccaacccagattggtttttcttcctctttgctacacagctgtgctcttgggacttccctttatcaccagtttgagaattcccttcatcttttttctgagttagaccctttgtttcttgtatctcatgtcatcttcatttactttctttgttttggtgtagcatagttcacttgctttgaggaaaagtggatgagaggtttttttgtttgtttttgttttgggacagagtcttgctctgttgcccaggctggagtgcagtggcatggtctcagctcaccacaacctccgcctcccgggttcaagtgattctcctgcctcagcctcccgagtagcgggattacgggtgtgcgccaccatgcccggctaattttttctatttttagtagagatggaatttcaccatactgttcaggctggtctggaaactaatggtatgtctttaaaacatctttacttaatttagttgatcatttggttatcgaattctgagtttgaaataatttttttcgcaattttgaaagcattgctccattttccagaagttctgttgttaggagtctgatgagagtcttgttcttggtaacaaaggttttctggaagtgtcctttcaattgggaaactcatttctttcagttctgtagcgtttcttgtattatttctttgaccatttcttaccctttttttaatgatgtttacctgaaagctggagtttctctaatttttctcttattctcctcttttgtttgttctgccttttgagagatttccttacccttatgttccaggggaagaagattggggaattcatgtttcagtatctagacttttcctcattgtcctgtataatcacggccttcacccttgttgggactccacagatttggagctgatcagatcggtttgttgagaacagcagcttttttggaggattttagggggagggagattcatttgactgtgcaagatgggcgacagagcgagactccgtttgaattaaaaaaaaagagagagaaatttagaactgcataatgaaaaagtaggccacaaatgttaagttttggacaattacaattacatctctatcttactgtgcaagatagcgatgatgtggcatctcttagggtcttactgttcctgttttcagccctgcatcagttcttgatatttggcagcttaagtgaattcaggtatttgcttatagtgacatctgctgtcatgtaaagaagtactgcttgaatcagatattgtcctgtttacataacgtgggctgtgctccttcctagctgtatatctttaaacaaggcatttgcctgcttgagcttcagttcccttgtaaagtgaggttagaggcaaaagatcatacagaagaataatttgtaaagttgtttaattatcttaagattgtctactttaataacatagttggaagcaaagaaggtaatggaattatttttctattatgttttggcattgtaccttgaatctatttcttcattttgaaaagggggaactggccgggctcggtggctgaggcctgtaatcccagcaccttcggaggcggaggaagtcagattacaaggtcgagagaacgacaccatctggccaacatggtgaaaccccatctctactaaaaatacaaaaattagctgggcatggtggcgtgcgcctgtagtcccagcttgtacccgggacgcagaggttgcagtgagctgagatcgagccaccgcactccagcctggcgacagagcaagactccatctcaaaaaaaaaaaggaagcggggaacaagccttgttcctttatgtgctgtcctgactgttgtgtattatttttgttaagattgctatagttcttttttttttgagatggagtcttgctctgtcgccagtgctgggattgcaggtgttagcctggcattgagcaacgttttgtaatttaagcatacaagtctctcacctccttgtttacatttattcccaggcatttttttcatttagatgcgattgtaaatggaattgctttcttaatttccttttctgattgttcgttgctggtacagtagtcccttcttatccacagtattgccttacgtggttttacttacctgcgtcacccgtggtccaaaaatattgaatggaagattatataaataaacatttcatgagttttaaattgcaaacagttctgaataacatgataaaaatctcacagcctcctgctccgtcctacccaggacacgaatcatccctttgtccaatatattcatgctgtatgtgctccccacccgctagttacatactagccatctcagttatcagatcagttgttggagtattgcagtgcttgtgttcaagtaacccttattttatttaaaatggcaccaaagagcaagaatagcgatgctggcagttcacatatgccagagagaagccatatagtgcttcctttaagtgaagaggtgagtttttgacttaggaaagaaaaaagatcgtatactggggttgctaagatctacggtaagaacaaatcttttgtccatgaaattgtgaagaaggaaaaagaaatttgtgctagttttgttgtgacaccccaaactgcaaaagttacagccacagtgtgtgataagtgctttgttgagatggacaagacattaaatttgtgggtggaggacacaaacaggaaacatgtttcgattgatggcaacctggtttgatactgttcatcgttttggacattcactggggtcttggaatttcaaaaataagatgtttgagtggctgtatactctttatcacatggatggaacatactctggttgtatcagcttttttttttttttttttttttttttttgagatggaatcattctgttgcccaggctggagtgcagtggtgcggtcttggcccactgctgcctcccgggttcaggcgattctttgcctcagcctcccaagcagcggggattacaggcgtgtgccaccatgcccagctaatttttgtatttttagtagaaaggaggtttctgcatgttggccaggctggtctcgaactcttggcttcaagtgatccacccgcctcagtctccgaaagtgctgggattacaggtgtgagccaccgcacccagcctggtgtgcatcagcattttggactttggagtttacgtaaccaaggagccaggctgtggaccttgtttattacttgaagaattcaatatttatttctgcctttttgactccttgactgtaaaatactgatctgatctgtagagagaacagtacatgtactattaaggcacagggaatcctcagtgccttaatagatcgtaagtacttacttattctttcccatagaggcttacacatggtaggagaagagatttctggaatacctttcctccccaaagaaagctggtttcttttgtttgttaagtgagagagtggtaccacagggtttccaagatttccaaggctgatgaaaattcttaacttctgttgtctgcttgtcttgctttcttgaatttattttttgtatgttatgtatttattatttagagacaggatctccctgtgtcacccaggctggagtgcagtgtcacagtcataactcacggcagtgtcaacctcctgggctcaagtgattctccttccttggcctcctgagtagctaggaacacaggcatgctccactatgcctggctatttttttccccctggagacaggatcttgttgtgttgcacaggctggtttcaaactcttggcctcaaagctagcctcccaccttggtctctgaaagtgctagaattaaatagaattaaaggtgtgaccaactgcacccagcttatttatgatgacgatgatgatgatgtttgggagatggagtctctgtcgcccaggctggagtgcgatggcacgatctcagctgactgcaacctctggctcactgcaacctccacctcctgggttcaactgattctcgtgccttagcctcccgagtagctgggattacaggcacccgccatcatgcctggctaatttttctatttttgtagagacggagtttcaccatgttataacgccaggctggtctcaaactcctgacctcaggtgatccgcccacttcggcctcccaaagtgctgggattacaggcatgagccgctgcacccagctctattttttgttttgtgataggaaattataaaacatggaattatgcatttgtcaggctttaaaaaaaacttttaagtgaatgaaaatggcatatttgaacataaacttagggcagatttttactacttttgaaaaaatgttggagaatatttctgtatgaaacgtaaaacaacttttaattttttttagaagttgagaggattctattttgcaaagctgtattatgaagctaaagaatatgatcttgctaaaaagtaagtacaaactgtaacatgtattctttttttaaaatcaatgccttttctcattttcttctttgaaataggtaaaaatatgttcttagtagttcttcctaagtgtattctggaataagggatttatcactcagactgatgctaaggaccagcctagattccattgagattgaaaccgtaattagtgttttctgcatgctgctgctttataccaagggcaagaaattgtttggcttaaaacactttttctaaaaattgtcttctgttggagtaaaagaggaccatgcctatatcttcatttgtttttggttagatatctgataccttaatcagatggaaaatagcaatgaataaaaaactgtaattgtaaggcaggagaatagcttgtataaaagatctttaattgacacaatatgtgatgctctaaggctctatcctagggataagaagcttggtgattctgatttcctgactgggagtggattaaagcaggaaattaagagggaggcagggtttttttttttttttttttttttttaggcagtatctgtctctcttgctcaggctggagtgcagcagctggctccatctttgctcactgtaacctctgccttctgggctcaagagatcttcccacctcagcgccccaagtagctggggatacagatgagcaccaccacacctggctaaggtttgcattttttggtagagacaggtgtcactatgttgcccaggctagtcttgaacttctgagcacagcagtctgcctgcctcggcctcccatactgttgggactacaggtgtgtgttactgctcccagctgggaggcaggcttttaaaggcatccaaaggaagatggaaatgctggtaagaaaggaaaatggtggtacataaattatgtaactagcagcactgtgactgttaactcttgtacctttttactgtgagactttaatcccttagtttgggtctggcctaatttctctgatggtaatactgtcaaggaacctagaggatatttacttattttagttgttacttgatttgagaaatggaaatttcctgtatttggtactgtaattagtaatttgtcttctgttcgattttagctggatatagtactgttagaaattactttcttgcttaaagggtaggtgtatttccctttgttgtttgggaaattgttgctgtttagtattttgcattatgataactttaaaaatgtttactataatcacttctaatttatttgcaaaactgttagtgctttattaaaatgtgatcaggaagaaaaagcaatttatatgttcatttcttatgcgtggataacactggagaaaaatttggtaaatgtgacatttaatggtaaaacgagtatgtggtcaactctatgtacgtgtttttaagtattacccatttctttctatgaatacttctgagttatctgcataaatagtggtagttttgagtaacaatataaacgagtttagtggttgctttggtttaagatgtattcttcggttagcatttaaaagtacagttctaagtttaatttacttttgtattacttttgaaaaacagatacgtatgtacttaccttagtgtgcaagagagggatcccagagctcacagatttctgggtcttctttatgaattggaagaaaacacagagaaagccgttgaatgttacagggtaagttataggattcaaatatagcctttgcatagccaaacacatgatgcccagagaaatttatataagtaagtcaaatatattttatgaatatcataaaacaggcattggtatcatagtacaattatgtgacacagcttggaacagatttagaattgtttaacacctataaattgtaagtctaacatggtcagaaatggtgttcttttgtgttcttttgcattcaaatgacacaaatataatttttatttgattcatttccagaaaattccaagacacttttattttaacacctttgaagtaacatgttttctctagaagtagaattttttaagggttggagtgataatttttaacctttatatataagtatataagtatatatactcctacatacatacatacaatttatttactaatctttaatttcttttctgatattagcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggtaaacatacaaaacataaagggagaaaacttaagacataaccatttctaatatttggagtttaaattacttttcaatagcaaaccttaagcccaggtgtttgtgtttcctttaacatttttcttttaaaaagtgtattaaaacctttctgagcatctgctgtcttattaggcattgttatactttataagtgacatctcatttacccttctggaataattaatattttagggattttacagtttagtagctgtaaactaagtagagctaagatttacattaagttctgtctggtatacaatttttgcttcattaagtgaaaattacctacaggatgacaatttagggatattttaaagaagagttttctaataactatggtctgaaagtagaagggattgtattttgagatagtaaagttttcaaggaaaagataaaaggtggtttctctagtatataagatgtaattactaaaaatggtaggaagttcttgctagtgtattgactggtcctgatattctttatagagcaaaatatagtttactaagtaactgttctggagaaaatctacacaaatatgtttggcaaacatttaaaatgtatattgtaatattttatatattaatgtatactttattgtgtatgtacaatataaaattataaatgtatatttgcctttagcctcctcctacccccattgtatatgtttctgatagaaatttaaaaaattttaattttgaaataattatagatttttttgcacaggaagttgcaaagattgcacagaaagatcctatatgctacttcatttttccccaatgcttatacaggttgagcatttaaaatctgaaatcctaaatgctccaaaatctgaaattttttgagcactgacatgatgctcaaagaaatgctcattggaaaattttggatttcagattttcagatttgggatgctctgcctgctaagtatcctgcaaatattccaaagtctgaaaaaattcaaaatctgaaatacttctggtctcaagcattttggataggggatactcaacctgtttaacccgaccaaagcacaatatcaaaatcaggaattttgacattggtacaatgtgtatgtatagttttctttcattttatcatgtgtagattcataccaccactactgtcaagatacagagctactctattaccacagagatcttcctcatgctgccccttttgtagtcatgctatttacttctcttcactatgcctgacctctggcaaccattaatctgttctccatctttatactttggtgatttcaaaatgttatgtaaatgtcatcatgaaatgtgtgacttttttttttcttttttcgttgtttttgagacggagtctcgctctgttgcccaggttggagttcactggcgcaatctcggctcactgccacctgtgcctcccaggttcaagcaattctcctgcctcagccttccgggtagctgggactacaggcacatgttaccgtgtcccgcttatttttgtatttttgcagaaacggggtttcaccatgttggcctggctggtctcgaactcctgacctcatgtgatctgcccaccccagcctcccaaagtgctaggattacaggcgtgagccaccgcgcccagccaagcatgtgaccttttgaggttggcttgttcagtcagcataataccatttgtgatccatattaagttttgtatatccatagttggttcctttacttctgagtagcatttcatggtccacaatttaaccattcactttttttatttttatttttttgagacagagtcttgctctgtcgcccatgctggagtgcagtggtgctatctcggctcactgcaacttctgcctcccgggttctcaggtgatccacccactttggcctcccaaagtgctgggattacaggtgtgagccactgtgcccagccttaaccattcacttttgaggggcattttggttatttctaggttttggctgttgttcaactgctatgaacaatcatgtccagatttttgaagctgaaaaagcattgaagatgcttccaaagataaatattactgataagtttttctccccagtaataagcagctggattttaaatattagtctaaaacatgaggtctaattgtgcagatttctttactctcttaggtgttatgcctcaaacataactcccatattgggcgtggcaatccagttaatctggtgtcagtagtgttaaagaacatatgtaatggcaggagattgttttcttgcagtgtaacaagtaagatactttgaagcactctttaaagattttctttaataacttgaaggcactgttaacacctttcctgtatcagattttttttttttttggaattgaaatccatgagatttataattgtcatgcaaagtaattccatttctcctaaaatttaaggcttgctaaggtaaacagtttctgacatttgtttaatgaatgagagtattactgttgagaaggctttttctctcaagtatgagatagaactttttaaaagcactcatagtggttttttaaaaaatgtttaacatagagtcaaagactagggcttttgcaatagggagagaccagggtatcatccatctcatccagaagaggagaaattgataaaggagagaggggaatgaaatacagagtagtaatggacggcttggtcttgagagctggggaaagacgagtttaagtaggtaaggtaaaatggaatttatatgtgatagcatcaggtttctcagtgaaggatgaatctaggttataagttgaaagtgagggtcaaaggaaggtatggggaagttgaggaaataggaggaggtgtgaagtgtcagggagtggagaaagtgagtctgttagtactaaaatggcattttgttttaggcagcaccagtttgatggttgagataatgcaaatgaaatcagttagcttggggttatgatttcccaaatctaagcacacagaaaccagttgggagggttctgaggaaaagagggaattagttgaagggatctgtaagcaaacagtaattatggatataagggattatagcattttttgcctgacagaagaaagtgtgtgtatatgtgtttacaggtgcttaaaacttgatgatgttattgtcttgaagggaacttgtcatgtggtggagaagtatatttctgaaagtaagggtacgtaggccctcagtgaggtggaagaataagaaggatggtatggtcgtttcggtggtatgaccaaaatgcagattttgaagacctgtgtcagtggcaagtggatggttgaggttggagtagaggataacatgactggagatgaggtgattaaggaactgagtagtcagcctgggcaacacggcaagaccccatctctacagaacgttaaaaaaaaattagccgggcatggtggtgcatgcctatggtcctagcttcttgagaggctgatggaagagcatcgcaaatgagaagcgagtggccacaaaccctacttcctctccttgtatgtaagttcagagagaaaaagccatcatggtagtgggggttatcctgagatgatactgtcttcatttaagatcaggaggtgatgacagtgctttgagatgatgatgaaggtaacagaacagtgggaggagaggggatgtgggattgagtcagatttaaggagatacagagcagtttgagcataaggaccttgttgctgaggattgactggggaggtctaggcttctggtggtgactcagatggacagggatgtgtggcaatagtcctggtagtctctgaagagagtatgagctactgcagtaatcacagatgcttttcttcacatacagttcttgaggcttagtttctgggttgtaagcaactctcagaagggacgaataaggtatataggatggtgtttttggtggcatcatcataaaactagacatagtggaatggtgctttttgggagcatgacttgtttaaaattgcacaagtgttactctaataatttttctttttcccctctaaataggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggtagataaaagctattgggtctttacatttctatgtaggcaattagcatacatctttttgtactaaagcagcagtgccccgcaggacttaaatttcttttatttaggtagaacagttataaaatgaaatttttaccaggatcagttaaatttataatgggaaagttggggagataactatgataaatgtatatatttttggtgttttcatttataaggttgatgtaaaaatcaatgtagtttcacaaacgtggttagagtgagaaaaggaatttgtaggcataaaatggttaatttcttaacacttgattaagttttgtaacttactattcattccacaaaataggaatatctggagtctttacagtgtttggagtctgataaaagtgactggcgagcaaccaatacagacttactgctggcctatgctaatcttatgcttcttacgctttccactagagatgtgcaggaaagtagagaattactggaaaggtgcgttgactttgaggagaatgctttagtataaattgtagtttttctttttgcagtaagttcattgctctaaatttctttactgcatcattatttctataatgtacctaggagttatagttaatacagtgaaccactaggaggcaatcttatttttcttcttttacggggaagttctaattggttttatatgactttcctttttagagaactcttatagttcaagcttgattaaaattagccttatggttaaatactcaggtttgtcatagtcaagcttaaaatgaatgttctaactgctatttcatattttattttttataatagtataatcttgagtgaaaattaaggttcatctgtcatcagatggctaggttcacatgtactagtataagcacttagcatcactggtatttcagaaaatactgttttagctaagaaacaaaataactcaactatgtgatttaccttttttcctaaattttgattttgaaaaccagtgtctccattttgaaaataaattccattgaacaaaaacatcacttggatttgtataaaaatgttagtttagagcaggggttggttagaacttgtgggccaaatatggcccctgcctaattttgttaatatttattggaatgcaacatgcctctgtttatgtattgtctgtggctgcttacatactacaaggttggaattgagtggttgcagcagagattgtatgcctgtaaagccagattagtaatctcctcctttttgtagaaaaagtttactgattgctagtttaggctgtccatttgtttggaagttaatttatttccccatctggtataaggaaagaagttcatttcactgagtgcagggagtaggtaattttcttgaaaaagtacatagtgtcctaaattggtagggtaagagcagtatctaaaagaactaacataactttaagattattttagaaaacatgtaggatgttttattttgtgttctttgtatactcaaattttttggtcacaagttccttttacatttttcttaaggacatcaaagatctttgtatgtgggttcctttttttctttctttctttcttttttgttttgtttttttttttttttttgagatggagtcttgctctgtcaccaggctggagtgcagtggcatgaccttgactcactgtaacctccgcctcccgggttcaggcgattctcctgcctcagcctcctgagtagctgggaccacaggcgcacaccaccacgcccagctaatttttgtatttttagtagagacggggttcaggatggtctcaatctctctttttttttttttgagactgagtcttgctctcgccaggttggcatgcagtggtgcagtctcggctcactgcaacctctgcctcctgggttcaagtgattctcttgtctctgcctcctgaataggtgggactacaggtgcccgacaccacacctggctaattttttttttttttgagacagagtctcgctctgtcacccagcctggagtagagtggcgcaatctcggctcactgcaagcttcacaatttcctctcaatgctctgaataagagcttatcctcctgcctcaggttgttccccaccaggaagccccaggagggccctgaggacagcccttggccctcagagggggaggctcaggaggggagatgaccatggggatggagtcactcaggggagaatccggaccatgagggggtgactgggggcctgaggggaggaccctgaggaagataaaaagctggtgccaccctaggcagtttcacagtgtggcttagggtggtgggtgacagatggtttgtcagatcagttaatcaggactcatgggccctttgttacccccccttgtgaacctcccaggttcacgccattcttctgcctcagcctcctgagtagctgggactacaggcgcccaccaccacgctcggctaatttttttgtatttttagtagagacggagtgtcaccctgttagccaggatggtctcgatctcctgacctcgtgatctgccctcctcggcctcccaaagtgttgggattacaggcgtgagccaccgcgctcagcccacacctggctaatttttgtatttttagtagaaacagggtttcatcatgttggccaggatggtctcgatctttttttttttttgagacggagtctcgctctgttgcccaggctggagtgcagtggtgccatctcggctcactgcaagctctgtctccagggttcatgccattctcctgcctcagcctcccgagtagctgggcctacaggtgcccgccaccacacccagctaattttttgtatttttagtagagatggggtttcactgtgttagccaggatggtcttgatatcctgaccttgtgatccgcctgcctcagcctcccagagtgctgggattacaggcatgagccaccgcgcccggctggtctcgatctcttgacctcttgatctgtctaccttggcctcccaaagtactggaaggtctcaatctcttgacgtcgtgatccgcctgccttggccttccaaagtgctgggattgcaggtctgagccactgcacctggccgtatgtgggttatttctgtcagtgtttattacattagaaattaaaacaaataaaaaatgtaatccattaaaaatgtaataagccctattgtgtgttaataataatagctttttttttttttttttttttttttatttgagacggagtttgctcttgttgcccaggctagagtgcaacagtgtgatctcggatcactgcaacctctgcttcccaggttcaagcgattctcctgcctcagcctcccaagtagctggaattacaggtgcccaccaccacgcctggctaattttttgtatttttagtagagatggggtttcaccatgttggctaggctggtcttgaactcctgacctcaggtgacccacccgcctcagcctcccaaagtgctggaattacatgtgtgagccaccgcgcagggccaataatagcattttttatgaaaaataattattttccaacagcaaaaaagtagtcagaaaagtgtcattgtttttgcatttttgtaaatctttttaatgtctcgcttaatagaacatagctagattctcatttacttcctctttcagtctgtaaaactattacatgtcatgaagcctctagaaaactcagctcagcgggtcgcggtggctcaggcctgtaatcccagcactttgggaggccgaggcgggtggatcacgaagtcaggagatcgagaccatcccagctaacaatggtgaaaccttgtctctactaaaaatacaaaaaattagccgggcatgttggtacgcgcctatattcccagctgctcgggaggctgaggcagaagaatcgcttgaacctgggagtcagaggttgcattaagccaagattgtgccactgcactccagccttgtgacagagtgagattctgtctccaaaaacaaaaacaaaaaaactcagctctacatacatgagaaaatgagtatgtaatatataaatttttttttggtattattgtaaaagtaattttaacttcatggatcccctgaaggggtttttgagcaccctcagagatctttagacctcatttgctctggttgcgttattgtaagccactttaaaatcatgcttcacgtttaagtgtttgctttttgcttttacttttcttccaaagtgaggatttggagaaacattaggatttagaagaactaatttagaatatagattacaaataataggccaggcatagtggctcatgcctgtaatcccagcacattggtaagctgaggcgggcggatcgtgaggtcaggagttcgagaccagcctggccaacatagtaaaaccctgtctctactaaaaatataaaaaaagtttagcggggcatggtggcaggtgcctgtaatcccagctactcaggaggctgagtcaggagaatcacttgaacctgggaggtggaggttgcagtgagcttagattgtgccattacactccagcccaggcgatagtgagagactctgtctcaaaaaaaaaaaaaaaaaaaaaaaaaagacaatttatttaacgctgtaatgatctatatagtaaaaagagcaattgctgtattgatactcaaatacctgtcagttatttacttataatttggaaatggtatgtctaatttgagaaattacaactgttaattaaataatgaaattatatgatcaggaagaaactacaaaatagtctcccaactttatcctggtttattttgaaatgtgcacctataatcactaatcttatatttatcctgtgattggagggctggaaataactgggaataagacatcatttgagaggttaagcatgaagtataggaagtatgcaggataaaaataagcattagatgattcataatttataacatggggaataagaattattagaagttgaatgtggaagatgaagcttgaaataaaatttttattttgttttgaattaaatgaaccatgattattcacagtgcagtaagtgtgtatcatctgtttgatattttcatattacagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggtaagtcttccacttgtaggagcaattgacatttcacggagtcttgatgtgttttaaatgaaggtgtgctctggtatgtaatgacaatatgtgaacaaactgtggaattaaaatgaaatagtcaatttgatacagtggaaaataactaagcatacacaatactggtgaggctggtgaaacagggatgttgagtgcactcttgtcgaaagcctgcattgccatgatttgtttgtagacaaatttgaagagtttgatctttttactctgccatttttgggaacatgataaagatgtaatctcgtattatgggtaaagcttgattcaaaaaggtgtgttacttggacaaaatcctaataagtagatgtagggcaatggctttatagcctatgatagaagaatatgattgcaatttaacatgttaattgaaacacatgtatataacatttatggctgtattgtgtatatgtaacagtatatctattaatctttgaaaacataaaaccttttcttattttttatttttttattttttttgagaccaagtctctctctgttgccaggctggagtgcagtggtgtgatctcggctcactgcagcctccacctcctgggttcaagtgattctcctgcctcagcctcccgagtagctgggactacaggcccgtgctaccaagcccagctaattttttgtatttttaatagagatggggtttcaccatgttggccaggatggtcgcaatctcttgacctcgtgatctacctgccttggtctcccaaagtgctgggattacaggcccgaggcactgtgcctggcgtgcctggcctttttttttttttgagacggagtctcgctctgtcgcccaggctggagtgcagtggcacgatctcggctcactgcaagctccacctcctgagttcacaccattttcctgcctcagcctcccgagtagctggaactacaagcgcccaccaccatgcctggctaatttttttgtatttttagtagagacggggtttcactgtgttagccaggatggtctcaatctcctgacctagtcatccacctgcctcggcctcccaaagtgctgggatttacaagcgtgagccaccattcccggacttttttttttaatgagcttgcataacttttgaaaggaaaagaaataagcagtcttccaaaaaaagcattaaaccaggcttagaaaaatgattaattttagagaaggattttttgcttggggagggaaaaaaaaggattcattacttttagagaaggcccctccttctaatataaatctttttttctttttgagacagagttttgctcttgttgcccaggctggagtgcaatggcgccatctggctcactgcaacctccgcctcccgggttcaagcgattgtcctgcttcagcctcccgagtagctgggattacaggcacacgctaccacgcccatctaattttgtattttcagtagagatgaggtttctccatgttggtcaggctggtcttgagctcctgaactcaggtgatctgcgtgtctcggcctctcaaagtgctgggattacaggcagtgagccagcatgccctgcctaatataaatctttttatttttatttgagacggagtctcgctctgtcaccaggctggagtgcagtggcgcaatctcagctcactgcaacctgtgtctcctgggttcaagtgattctcctgcttcagcctgtcacgtatctgggattacaggcacacaccaccatgcctggctaattttttgtattttttaatagagatggggtttcaccatgttagccaggatggtctcgatcttctgacctcgtgatccacccgactcggcctctcaaagtgctgggattacaggcatgagccattgagcctggcctgtaaatcttttaaaaacaccgttgatagacagttcacatgttaaatgctaatattggctcagtagaaacttctgtgttcataaggaatggattagtgaaaattaatggatttagtgaggttcactaggtaatacaaacattaaaaggttcttatagaaattctcaagtaactgatagttcttatttttatttattttatttttttttgagatggagtctcacactctgtcgcccaggctggagcacagtggcacgacctcggctcactgcaagctccgcctcctgggttcacgccattctcctgcctcagcctcccgagtagctgggactacaggcacccaccaccacgcctggctaatttttttgtattttcagtagagatggggtttcaccgtgttagccaggatggtctcgatctcctgacctcatgatccgcccaccttggcctcccaaagtgctggcattacaggtgtgagccaccgcgccctgccaatagttcttatttttaatggaaactttaaaatttatctgtctgtgtgtctattagagtcttgctgtgtcacccaggctggagtgcagttgcgtaatcgtagctcaccgtaacattgaactgggctcgagcttcccagagtgctgggattataggtgtcagctactgcgcacagcctaaaatttttcgatatgtagttttgggaggcagagtctcactcttgctctggctggagtgcagtggcatgatcatagctcactgcatcctcgaactcctgggctcaagtgatcctctcctgcttcagcctcagctcagtagctgggactacaggtgcctgccaccatgcctggctacattgttaaattttttgtaaagacaaggtcttgctatgtttcccaggctggttggtcttgaactcctggcttcaagtgatccttctgccttgccctcccaaagtgctgagattacaggtatgagccaccacacctgactgtgaacttttaatcataataagttagtttccctcttaatccattcactcaggtctcctttcctagatgacagctactgttaggagtttcttgggtgttcagaaatattttttgcatatgcaaatgtgcaatacattctttctctgcttttaaaaaatattgtgcctcaatgtgggtgtgctttacctattgccagatgccttgcttttctgaatgtttcttcattgttccacttcagcacagagatacctacctcagtctttattagctaccacatatttctgtagaatgaatatataatagaaacatcttagatgcttgtattttatttgatcagtttattttaaagcttaatgaacaaatgattataagcataaaatgtaggttatgtgctggcatttgggtatttaagaattggctaacttttatggcaagattttcagactcttaatcagaggaatactgtggttctagtaagtgcatctgcattgcagctaggtagttaacaaagtatcttgaaaccttttagttaagatgaggaaatagccaggcgtggtggctcacacctataatcttagcactttgggaggctgaggcgggcggatcgcttgaggtcaggagtttgagaccatcctgaccaacatggtcaaaccccatctctactaaaaatacaaaaattagccacgcatggtggcaggtgcctgtagtcccagctacttgagaggccgagacaggagaattgcttgaaaccaggaggcggagattgcagtgagccgagatcgtgccactgcagcactccagcctggcgacggagcgagactccatctcaaaaaaaaaagaggaaatagtgaattgagatgatttgattgagtggattcacaactaattaactggtcacagattcaactgttgaataattttgtaaaagaggccgggtttatgaattgaggtcagtttgaaaacaaaaagaatgatgtcaacattttgtttcttactttgtgtgctcttttcaacatatagatgacaaactttgacatgatgtttagaaaacttgtgagtaaaaggataggcgatatgaatatttctaaaattcaaaatcagaagcttttaggttcataaatcatatattttgaaaaatgagcatgtttggaaagaattatatatacatggtttaaaattctggcggctcttaagaatatgctatgaagactcctttctgttccctagttatttactttctccagccccaaagaaactaatgttattgctttcttgtgtgttcttcaggaaatgttttatgcatctccaagtaaacacacatatatcccctgtctttaaaagaaggaggaaaacatttgaacattgcatttactttatttccattaactgtatcttggagatgtttccatgtcagtatatataaagggcattctcattagtttggatgcttgcatattattccattgtatggatgtactgtagttttggagtttttaaaaccagggtcctaaaaccaggacattagcttgcttttacttttttttttaatgctacttcaagtaatttagcaatgattaacttgtgccatgaattcctgaaagaattgcagtatcaaagtatatctgtgcatttataatttttagagctgttgccaaatatctaaccctaaagaggttgtatcaaattacatttccaccaccaattaagaaagtggtgatagaattaaaagccgatgctctagtcacccatatagttacttttggcatgtttctagtaagtgggcattgcctgtgactggacgttttcagtgatgggcattcattacttttcaagatagcccagtgcatctttaggtggtttggctcttggtacttccttatatagaataaaaatattcttcaagccttctacctgttggtcttgtttcttcttttgatgatttcttttataaaataattttaatacctgaaggcagctgtcacgtcttcccttcgccattctattcatcatgctttttttttttccataggttattgcattaggatctctttaatttcctggttgtcccatttattctagtgctatcccctgttatccatactctgaaaatgtgttatctacaatgtggcatttccaagtgtcatttcacctgtactttttaaagtagggtgtcatatctactcaaataggacaacatctgctgttgtcctatttattcagggcagaaaagtaatataattaaattttccatttctctgaatgtaacacgaatgtgcttttagtagaaactaatttctcagagctgctctgtgtatgctttttttttttttttctttttttggagatagggtctcactctgtcacccaagctggagcacagtggcatgatcatggctcactgcagccttgacctcctggatttaagtgatcctcctgcctcagcctcctgagtagctgggaccacagttgtgtgccaccactcctggctaataaaaaaaactttttttagagatagggtctcaccgtgttgttcaggctggtcttgaactctgggctcaagtgatccccccacctcggcctcccaaagtgctgggattacaggtgtgagccaacatgtctggcccctctttttttttttttttgcgatggagtctcgctctttcacccaggctggagtgcaatggcgcagtctcggcgcgctacgacctctgcctcccaggttcaagctatccttgtgcctcagcctcccgtgtagccggaattaacaggtgtgtgccaccacgcctgcctctttgtttttttttttattatttttagtagagactgggtttcaccatgttggccaggctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagacaagaccatgttactattagaagtatgggtatcatcaaattaagatttttgattctaaaattattaggttccaagaccaaagattaaattaataaaaggtgaagctggacaaaatctgctggaaatgatggcctgtgaccgactgagccaatcaggtaatagtaatattaaactaatttaatttaaaaagaaaaaggaatttctgttaaggcatatcttatgataaaatcttcatctgtccaggagataatttgtcaaaattatttctttttgccgtatcagttaagagcaataggtatggaagagatgcgaagaaatagcacattctttaaaaaaaatgaatatttgatattgtttgttcctatgtggagaggatttcttaactctttcttcatctggctgctagagcctctagcctgaatatttagtcacttcctgaactaagtataattattgatttgccaaccatttaacaccagctgattctaaaaacactgctgtggggatataaagatgaagaagatacggatctgtcttaaagagctgagagcatagtgaggaagatagaagatatatacttaccttatattaggctcttggaatttgtggatttttttcccccgtttttggcttgggatgaatcctaaaggtctgttgcatattacctgtgattttgctaagatacaaactttaaggtagttagatggccattgaatcaagcagtgaactgaagaaacataatgcttcctataaggagcagttttgatataaaattggatgaattttgtaaagagcaagatgtaatattaaatcaaagttattataagctttggtgtatagttaggctgttggccaaagctcacattgctcttttattccatagcccactttttttgtgggagctaggctttcagtccttaaagtgactttctacttttttccttttctcttttccttctacccttgcagggctctcataagtgcctttgcatggtgtcacagttagatgaaaattgcctgtattttttttttatgtctttgatctgggcatcccgagggtgcctctgtaagtgtgctgagacacaactgtgtagtggtaaccaaacctaattgcccagcagaattaactcaaaggagggtttttaaaaaaagttgaattgaaatataattcatgtaccatacgcttcacccatttaaagtgtacagttcagtggcttttactatgttcatagagtattaccactgtcaccacagtcagttttagaagattttcatcactccatgaggaatttcttacctattagcagttactccccattttacccaaacctctcagccttggcaaccgctaatctgtctctgtaggtttgcctcttctttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatctgcccgccttggcctcccaaagtgctgggattacaggcgtgagccaccgcgcccggccggtttgcctcttctgaacatttcacataaatggaatcatgtagtatgtggtcttttgtgactggcttctttcatttagcaaggttttcaaggttcatctgtgttatagcatgtatcagtattttatccgaggactatgattttttgattgcttactgtaaacctatggaataaaaatctctgggaacaaggcctggaaataattctttttttttttttcctgagacagtcttactctgtcgcccaggctggagtgcagtggcgtgatctcggctcactgcaagctccgcctcccgggttcacgccattctcctccctcagcctccccagtagctgggactacaggcgcccgccaccagggccggctaattttttttttttttttttttgtatttttagtagagacggagtttcactgtgttagccaggatggtcttgatctcctgacctcattatccacccagcttggcctcccaaagtgctgggattacaggcatgagccaccgtgcccagccggaaataattcttaaaagctgtttaaaggaggattctgatcagccaggttcagaaatcagtgtatcagatcagagaataagagcttgtccctgttctcctatggccacttaaatccagaccttttcatctaaaatgcaaatatgtttggcatttttcatacacattcctgtcttttttcccccttctgctgtcttatgtagatactgagaatattaaacctgtactcttttcatttgctacataagcacccgttttgttgtccagctgtattttttgggttggagggttaggtctgcaataatcatgttatttcccctttgggtatacaaatgagacaacgtgagcaaatacaatctgtatttttaaagtgatggaaataacttaaatttttttttcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtaagttatatgtttcagaggaaatggtctccgtcttaattattataaattgcccataatcttattacccagaaataacgacttaatattttcctgtattccttttgtgtgtgggttgggctggggggagtttgaatgtggtgctgtaggggtggcatgtattttttgttgttgttgttgtttttgagaccaagttttgctcttgtcgcccatgctggagtgcagtggtgcgatctcggctcactgtaacctctgcctcccgggttcaagtaattctactgcctcagtctcccaagtagcgggattacaaatgcccaccaccacgcccggctaattttttgtatttttagtagagacggggtttcatcatgttggtcaggctggtctcaaactcctgacctcaggtgatccacctgccttggcctcccaaagtgctgggattacaggagtgagccaccgcgaccagccttgttgtattttgagacagggtctcgctgtgtcacctgggctggagtgtagtggcgtgatcgtaggtcactgctgccttgaacttctgggctcaagggattctcttgcctcagcctcctgagtagctggtaccataggcacatgccactcggcccagataattttttttttaattggtagagacagggtctccctttgttgcccaggctagtctccaactcctaggctcaagtgatcctcctgcctaagccccgcaaagtgttgggattaggcctggcacagtggctcatatctgtaatcccagcactttgggaggccgaggcgggcagatcacctgagatcaggagttcgagaccatcctggccaacatggtgaaaccccatctctactaaaaatacaaaaattatccgggggtggtggcatgtgcctgtagtccctactcaggaggctgaggcaggagaatcgctccaacccgggaggtggaggttgcagtgagccaagatcacactgctgcactacagcctgggcgacagagcgagacttcgtctcaaaaacaaaagtgttggaattataggcatgagccactgcatctgaccatatttttcatctaaatggttgtttatgtatgatttatcttgcttccttcatgaattctctcccatagtctctgtattaaaactataaatatcacttttattggcaatataatcttttttatgaagtagtcataatttgcttgcaactttctgttattgggcatccaagttttctcaacttttccactgttaataatcatactctgataaaaacttcaacaaaaagtgtcttcattgcaagttatttccatagagatacctaaaaacagaattactgagacaaaggacatgaacatctttaagtcttgcaaattgccaaaatgacagaaagattatacctcttcatgcttccagaagcgcataaccttttcttttcttttcttttcttttttttgagacagagtctcgctccgtcacccaggctggagcgcagtggtgcaatctcggctcactgcaacttccgcctgccaggttcaagcaattgtcttgcctcagcctcccaagtagctgggactataggcatgtgacaccatgctcggctaattttttgtatttttagtagagacggagtttcaccatgctggccaggctggtctcgaactcctgactgcacataaccttttcaatattgactttcttgtagaaaaacagatttctttactgtaccgatggattaatatagtggtgttccattgctttaatgacttaaaggaaaacccattgttttggggtttcttattaggttaggtgttctttatttggcttttgtcagttgattttggtttattgagttctagtcagtgtcattttttaagatggacttaaacattcttcatcactactatttttattaaaatttctagaaataatcaagtgagaatgcatttaataagaacatgagattttgcctaacatagaattccctccagctttgatatagaaaagcagttatataattaagatatatataatgtgaattgtttatgttggcaaaactaatggcacaaagaaaaatttcaaacccttaagccaatttttttattttatttcaggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtaagcaaagattttaacaaattaaatattctgaattttgtttaatttttttttctaacttaacttttccttaaataaaacaggtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagcgctgaactgtgtatttagaaaacaattttagtaaattgaagtattttttagacctggaaactcagcagaattgagacttgtagttcagcatgaaataaacactctaagagcccaggaaaaacatggccttcaacctgctctgcttgtacattgggcaaaatgccttcagaaaatggtgagttttaaagtataagcatttttaaagaacattaccttaattttttaaaatcatgcactttttattgaaagtttttttgttcagaaaacagcagcttggtcatattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctaaatatttaaggtttgttttgtgtcaccattaggtgaagatggtcagccttttgaacaaactgacactacagaagaggcaggtttcagctatctaaaaatggcaactgttaaaaagtagttgggattgctacattagggtggtatcattagaagtgtttaaaagttgagtgtagaggccgggtgcggtggctcacatctgtaatcccagcacgttaggaggccgaggcgggcagatcacaagatcaggagatcgagatcattcctggctaacacggtgaaaccccgtctctactaaaaatacaaaaaaaaactctactaaaactacaaaattagccagacatggtggcaggtgcctgtaatcccagctacttgggaagctgaggcaggagaattgcttgaacctgcacggcagaggttgcagtgagttcactggtattaaggtggtttagttattacagtatttggaagttgaacaaatgactattgaggtaccatttggttttgacttgaaattttagccagttcttacaacctgtaaatgaactttagatctaatcatgcgtgttccttaaagttgtgtgcttttaactttcttttttagggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggtaacagagttcctttatgaatttattggagatgggaatttccagtttataaacaaagacgtggagctataaactgcttaaattaattgccttgttatttaacggtaatcttgttttctaaattcactagctctcacagataagatatgacagagaagagtaatgagatgtttgtctcttaagatcatataaaatctttggaaaatcatttgggttttatattctgagtataaacaatttgactaaaaactattctgtgtgtttaggcatcagaaattgttgagtatgaagaagatgcacacataacttttgctatattggatgcagtacatggaaatatagaagatgctgtgactgcttttgaatctataaaaagtgttgtttcttattggaatcttgcactggtaagtagatgcagtacttgagctaaaagttttatttatttatttattatttcttttaaaagacggggtttctctgttggccaggctagagtgcagtggcacaatcttggctcactgcaacctctgcttcccaggctcaagcgattcttgtgcctcagctcccgagtagctgggattacaggcatgagccaccatgcgtggccaagctgaaagttttttgttttaaaaagctaatgatttcataaaagcactatttgtatagatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaagtaagtagcaggttgttgtatgtacgttcttactgataacccactggtcagtgtttttgcgttggtcttatattttggtaatttcaaaaatactcagtaatatgttgttattaatgcacagaagggatgtgtgtgtctaaatgcttatatttgcttgctttgtcttaggtttggtgtgtctttttaaacttgggaatctaggtgttatcttagcagtgtaatcaaaacaaatattataacctcaggactaattcttaatgaactttgctgaaattgaaagttgttgctgacaacttaagagcatttcttctcatcctcatcagccattatgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagattgtacaacacttttctgtgttcatgaagaaaaaaatagaataaagacaaaaaaataaaaataataatacaaaacagcagaaaaacaaagaaaaaagataattaaaaaacactttcacgtgtattattatttaaagtgtaaagtgcttattaaaatgacaaaaatgtaaataagataaaatatatcattttagagtttttacttttggaattttttgcaaatgaaagcccttaattaatgtcttttatttttagttgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaaggtaaacaggaaagaatggaatcatttcattgtgaaattgtttctaagtgttttaaatgctcttttgttatttttatttttttttttagtattctcccaaaacaccacctcgatgggcagaagatcagaattctttacggaaaatgatttgccaagaagtaaaggccattacggtaagtcacttaatttctctagctgtactttttattccaagattccttccctggccactctctcactttttttctgaagctggtcagaatgtccccttgccatccaaatagtatggcaaggggacattttggtctttttttttttttttttttaaggcagggtcttgttgtgcaggctgcagtacagtggtatgatcacagcttactgtggcttcgacctcctagctcaagagagcctcttggcttagcctgccacgaagccaggactacagagagtcacacgccactaggcccagctaattgtattttttgtagagatgggatttttccatgttgcccagggtggccttgaactcctggctcaaacaatcctcctgcttcagcctcccaaagtgctgggattgcaggtgtgagccactgtgcccagcctacataccttggtcttgaccctttaccatattttgttttgttttgttttgagatggagtctcactctgttgcccagtctggagtgcaatggtgcgatcttggctcactgcaacctccacctcccaggttcaagcgactctcctgcctcagcctcctgagtagctgggattacaggcacccgccaccaggaccagctaatttttgtatttttagtagacacagagtttcaccatgttggccaggctggttttgaacttctgacctcaggcgatctgcccaccttggcctcccaaagtgctgggattacaggtgtaaaccaccacacccagccctttactatatttttgaaagtactttatgtgtctctctcctcatcttccacaaaatttgagaccttcaaaggtagaaactgttttatttaaaatataagagttcctgacacagagaaggttcccgagtgattgaactgctacagtgtactaatcatactctggtctatgagttcattctcagattagctgtggattacatgtgtttcaaatgtatagctaggaattgaaaagtggtctgagcttcaaaaagtcttgctatattttaatacttccatatgaatttgacttaattatgtaaggaaatagttatgtatatatatcttattttaacaatagggttcaaaggagcttgacttttttggaattggaaataaaagtaggttctttcatgtttatcaggcaagaactaaattatactgctaaagttacatcaaggatatgctgatgtgtggcgattattacagtgtgatcagcagtatttgcaaattgagagaatactatttggtggggaagacatttttgaatttgcacaaaaatcttgaatgttaattctgtgtagtcatggcctatgacaattacatacaattttgacttaacatacaggtttcaggctcccaacattgtattctgtggaagtatagtggagcactagtccatgagcttgaaaagcttggtactagtactgactctgccattaattaatgatcttgggccagtcacttccttcgtgactggcttcttatctttaaaatgagagaattattgaagccagttctcattacactgaatgttaaaaattacagttacagcagtgattgcaaattcaaagctctggtgcggataccaacagtgaccataaagttttctaggtgattccactagtttcttatttcttggatgtgtatgtgtagcatctggactaggcactgtagatggatgagtgggggaaattttatttagcttgaaaattgagatagttttggacctcatggttaggtctttctgggaaatttttatttgaaacacttgtagaaaaagaaagcagacatgctagatctgtccctgacctcacttgttagaactggtcggattcctgggctgatacagagaagtttgaaacttttcaaaatttacctgttttctgataccactacaatttctttggaaaaagaatttcctgttaagtgtctgttttgtaaggggacattttgtaggttctagggttgggtatggtgctgtcatttagttttcttcagcagagatcaggtagccacatagctacactagatggcattgtatctatctgccatcttgtcaaggcagcagagttgtgttaagagaacatttttggagtcagatgtggttcaaattccagctgttattccctgcatccctttctctcattttaagataggagctaatattgtttacctaacagtgtagatagtataaaaattaagagtttaagtgcattggacgtattattatatacataataaattatctgcagctactgcttttttccctttcctggtggagcatttgaacgtcacctggagaattagttgtattttgtttcagcatggggttaagtgaaaagctaatttggggaggtgatttggaatgtcaggtagtccagattgcagtatagaaagaacacactgaaaggatggtcagtgtaatgttagaggactgtgaaagttggggaaagaagtttagtttgtaggtacttgtttttttgagcagggaattgtcttggctggaggtgaatgtcagaaaggttaatgtaggcaagtgtagaatggaaatgaaggtgtgatcatttaggaggttatttgtttaggtgagagagttaatgaattaggttttgtattaacgaatgaaaatgggagcagataaatttttaacaaattaagaatcatattttaaaatcagcaccaggtacctagaactcattggcaaatagaaactttcaaaagatataatcaggtccgggcgtggtgggtcacacctataatcccagcactttgggaggctgaggtgttggatcacttgaggtcaggagttcaagactagcctggcaaacatggtgaaaccccatctctactattatacaaaaaattagccgggtgtgctggctgacgcctgtaatcccagctactcgggaggctgaggtgggagaattgcttgagcccaggaggtggaggttgcggtgagccaagattgtgccattgcactccagcctggatgacagatcgagacaccatctcaaaaaagaaaaaaagaaaaaatcagttatttaaatttaaaagagtaagtttccccagcactgtttctggcatgatataattaaatgattaaaattatttgatttttttttcttccaatagaaactaaatagcagtaagtcagcatcccgtcatcgttggcccacagagaattatggaccagactcggtgcctgatggatatcaggggtcacagacatttcatggggctccactaacaggtgagctggcaagtgcataatcgcatattttagtaaaactactttacttccctcttttaagtagataacgtgtgaaatcaccttgtttatatatgtttgttaatatacatgtcaacgtctgtttatatgtgacttcaaaagctgtatttggtgttacggagatttttataatcccaagcagaaaaaacgagccgtatgtgatcacgtgtatataaaggcttaaagaacacttaatccacacctcagatgagctgagatgagattattccttaaattgaaaaatgttattgaatagagttatgcactaagaaatgcttaattaagaacctacacctctggggaattattttgatgataatgatgagaggcaggacgttatataggaaatcttacttaatttgaaatattatggttatataaagaaagaaaaggagtttggacctgaatcatacagggtttttaagttctgctctatcacttactataatagctgtgtaagttaacctgtctgaaatgtggagataatacttgccttacataattactatgagcatttgtgtatgtgcaggtgggcgtgggtgtgtatcagacatttattagagtatacagtaaacagttaatgaactaaggttactaatagtgtttactgtgggttggctatgtgcaaaagtgctttgtgaatgtaatttgatttaattacagtaacttagaatggccggtaccattattaatcccttttttataaataaggaaatggataaagaaaggttaggtaacttactcattattatacagctagttattgatagagccgagattcacactccagtggtgtaactccaaagcacttgccagtataatacattgctcccaggcagccagaaataaaaaaattgttccttttacgtacgacagacttctgaaatggtagtagtagtgcccttttttttttctctttttagcccaggaaagatttagaataaaatctagtttagatgagcacatttgtgtgatggttcctatagttaaggcaaccccactagccttttgtgatagtatcttctcaacacaagcaaaataacagaaaatctttgtgaagtcaagcttattaaatgtcgtaagtcatagataagtatatgaaatgtctaacgttcaaaccttgttttcttaaaaccttacacatcatataggtccttgtaagaggataaacaaaccggctagcctttcctggggcttttttagtgacgtgtgcagtcagttatttggtgccttgtgggtcatgatttccatttcttctgtgtacaggcataaaaggtcttctgttcttatacaagcatgtaaatccaacattctcattgtctcattttattcttgcaatgaccctgtgaaatgtgtagaagcagcatatcctcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaagatggtccttgtttttttaaaataagatgattaaaattaaagattaatgagctcataggagatactcagaagtactgaacagggtgaagaaaactaaaaactaaccaccttattaacatttcttatatttgagagcatttccttctggttctttctctatacatatagtattttttatgagattgttaccatgttactatgttgtgtgtagatgagctagcctgttttttaaatgttactttagttctgagcatttttaaacttaaatgttttttgaatattaatgagttcatggtgtcccatcacatggaagtactgtaaattctgttcctttatttatgttgtttctggtttatgccattacaaattctaggacactgtcctagttttgtagggtattcaaaatattcagtttatgctcttaccactagtatctgatagtgccattttcgcacttttgctaatgctgacttactagtttataaaatcctttgccaatttgtaggaacaaaagttatatcaatttttaagtttttttaatactagtcatgctcaacaattcatgcaaatggcagttggtagttttgccatcttcaacgtgggtaccttccagttgtttggtttcttggtaaaactcacacaaaacagatggagaagagtttttgtatatcaacatgaatgttaatgtgatttttttaaagccaacgaacacatttgtgttccttgtgagatcctgtgcatgaatttgtcaggtaatttttttgacttgaacattctcataatagcttcaatttgcacaatgcaaccttgtcattttgcagattttcaaggctcacttcaaaaacatgttccttgaggcctattaacatttctttcctaaattgtctattcatatggtgctttaaaaaattagattacttttagtatatttattagagcctcacagtttagagtcagtagtcaattaaagtccctacttaaacttcagactaagattttttttttatttaatattttattttttctttttgctttcatgcagacagacattttgcaagactttaagattcttgggccatttctgtcaggttgttctgtgttctgtgcctgcttcctccccatagtaatttcaaaatagttatcctcacctctgtaaggtttccaaaatcaaacttgggcttctggctagccttttctaggtcttgatttttcagtgctttccagaggcaattgtttggaacctcttcgcacagtttctgtttcttcttccatgtacaggcataaaaggtcttttggttgttttctggtaaaactatcataaaacagttcaagcaaatgactattggtagttttgtcattaacatgggtgccttctagtcgttttgtttcctggtaaaacagaccaaacagagggagcagacagtttgtacatctgtatgagtgttgatgtgctttttattttaagccagggaacacattttatgttatttatgacatcctttccatgaatttgtcaggtgatttttgagctgaacattctcagtaatagctttagtttacaaaatacaacctagtctttctgcagattttctaggcccacttcaaatgcattgaccatcagatggcatcttggttccttacgtcctttctgtgactgaatgtccataattccacatcatactgatctttcttagaaaaggcaacagttactttctcctttattccttttttaatgcttgtgaggtagttcttgttgatcacagcgatgctattctcttattcttcatgtcatatttagcaatttttttctagtttgtcatttgataatcttgattggtatattttgatgtacagaaatttaaaatttatgtagttaaatctttctttaatttctattgcttttgtatttatagctcttgcctagatagtcttaactgtagtatagactttaacagtgttttctttcttttcttttttttttttttagttgcaactactggcccttcagtatattatagtcagtcaccagcatataattcccagtatcttctcagaccagcagctaatgttactcccacaaaggtaacaaaggaataatttatacatttataattattttctttttaaattgtttagggttccttcaaataaattcaagagagcagttcactattaaaacttttatgtcccttaaaatgtagatattttaaatttatctccaaatacagaaattatccttcttagtcaccttatttttgtgttaataagtgtgaatatttagaatattttaaaaatgggagtggtggtggtggatccttcatcgttctgttttaacagaaatagaactgtaatgcccttgctgacccactatgtggtaagtactttcaggcctgatacagctatatatataacaattgattgaagactcaatattacagtggtagttgaatgtgacagctttgaggacagagtgttggggtgcatttagacccttgttcttctgcttattttgaccacaggcaagtttcttaacctctcaatgcatcagttgcctcatatgtgaaatgagggtaataataataccttaattcatagggtttttgaggatattaaaatgagataataatgtaaagtgcttagaacagtgcccagctgacacattaataaatgctcaataaatgttatcatcatcatcatcatcattattgttaacatcatttgataaattgtttaggaatgaagaaggtatttatttcatgactattttgggcatgtggatcaagaaaattcaccttcatttatgtttcagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaagggtaggtactttgttgttaaagttaagcacaatttttctttcttttaatgtttagcttgatgcagactctttgtgggatactaatgttgggatataaacgatgctttgtgaacacccccaaaatatttgagcaattttttttctcccttaataagttcacggtgaggtttcaaagagcaagagaacttagttaaagacatttcagtaactggaagatacttctatcatgctagggcagagcaaaagaacttggtacagtgtatggactcatgcttgaatcatgcgcattaacgtgagtctttttttaaagtgttcattttcatttgttctgtttcttttgtcactcagaaaacatgatattgaggctgggcacggtggctcactcctagaatgccagcactttgggaggttgaggtgggcagatcacttgagctcaggagttcgagaccagcctggccaacgtggtgaaaccctgtttctactgaaaatacaaaaatgagccgggcgtggtggtgcgtgcctataattagcagctactcaggaggttgaggcaggtggatcgcttgagcacaggagatggaggtagcagtgagctgaagtcatgccactgcactccagcctgactgagtgagactttgtctccaaaaaaaaaaaaaaaaaacaaaaaaacaaaaaaaaccatgatattgagatgttctcattttatgtgttgtatgtcagtcttgctcatgtattaaatgagcaaagaatgaaactacagggataaatgaatatgtaagacagtcagattggtggtataaattgagggattctggctttttatgttttaaaagcatattcattttgtttcctaaaatgttaaaaaatgaaatattctttattttctaggatttaattttagcctttttaaatctaatcccatggccttttggactagcaccccttcctcacagcctgagagcaaaggtatagaactagcattctcagtatgagataacagcagtttttagcagctggtagcccttaggaaagtattaataactgtggctgtatgaaatgaagtacttaccactacaacatgaatgttaaagaatgccagtttaagcaaagtaccttttgactggtggcatgacacccttgttggtttgttttttaaaatgtactgggatgctgatttgtaatgtacttcattgctctgctatttcaggtctgctcagtgaagacctatgttttatctaatgtttatctttagccactaacgtctgccagtattcacatgtagtggcaacggcatgtatacagtatggaagagtgtccctgtagggctgttcttttgtgcatggtttagaaaaatgttgtatttgaaaatggaccccatttttaacagccagcattctacagcttgcatattatatatgttgcacagatcatttttagaagtgtggctactagagtggaacaagaagtgggatctgttgaaggccttcaagaacaggttagggaagtgaaacctcacccttagtgaccagtaacacatcttagccatgccaaacaagtacaatgataaaataacaatctctgatttttttttgagtataccagttttattaccagctaaggtagctcttaatcttttattttaaagatacggtctttgagaaatgtgaaaagtgttaacttaaaagtggatgtatacttgcgtacagtttctgtgagctctaggttaggaatccctgacctaagaacgaatgtgcctatacactactgtagaacatagagccttattctgttttgaatctgataatgtcattgtcccaagggaccttagaaatgaagactttagacatgagtaaactgaggccaagagaggctatctgatttacccaagaggtctttactgagtaatagcagaagtggaacaagaatctgtatcttacggtgtactgttatttctcctagctaggaaatgatactaggttttcgtttataatgaaggagagggacaaatttaacattgtaaaaggaagggcactggttctgcagagcagtgtcatccaatagaaataaaatataacctgtgtatgtaatttaaaattgtcatttggtgcaatggcttgtgcctataatcccagttacttgggaggctgaggcagagggatcacttgagcccacaagttccaggcttcagtgaactatgatcacatcactgcactccagctctgggtgacaaagcaagaccgcatctcaaataaatacataaataaataaattttctagtagccatattaaaaagaataaaaagaaacagttaaaaagggaaacagatgaaagtaactttatcgatagatttgatttaactcattatgtccaaaatatcattttaacttctaattaatataaaaattaatgatattttacattattgtttttcaccaagtcttcaaaatccagtgtgtgtgtttacacttactgttagcatgtcttgatttggactagccaccttgtgaggttttaatagaatgtggctaggctaccatattggacaccatagctctcagaatgtttccctgtcaccagttggtatacatggcatgcttcataactggcttactttattaaactcctttagccagaagttgttctttacattaatagatcagaacaggttgcatatagaagttttttctgtttctaattttttgccctttgcattgatggtggctggggatgggttgttttcagccatatgaatggtcttagattttatagtgttagctacccatagagtaacagtttttatttaattttatctagtatcatgcttgaacacaggcaaactagatgcaactctagtcaccttccattcttggcaattgttaactttccttacaggaactaatcacagttggctttggattagtttcatatgtatactaatacttgcttatgttttaagatttttttcaattgctgcaaatgcatggatattttggtaaactattgtatgctaagtatagttaggcaacactttaaaatttttaacctttttaaattctagaaatttgtagtaattcttttcaatgactattaagtaaacacaagatttttttgttttctttcgttttaaatagattctgtgttcacttagggtttttggtagaaaactaaatcaggatgctaattctaattcatgattatcgtacatctctgcatcaaagtatatgtgttttttatcagtatgctgttttaacctatagataggttccatggtttttattttcaggtagagtattaacgtcaatacttaataccttatctttgtcaatttttttgactggtgttacagcaaaagagaagaaaaaacctgaagattctccctcagatagtctcggtctcctgacctcgtgatccacccgcctcggcctcccaaagtgctgggattacaggcatgagccactgcgcctggctgacacatgtcttaattctggtattcaccagatttgtttcgtgttctccgttgttagtcatcaaatttgtctactttttaaatagaaacattagctagagcaaggaacttagaaacactcaagcagcactgaatgtgtagaattgcataaccaatatagcttctttgctttcatatttacaattagttggagttttagttcagccgtacccagtatcttccattctgcttccaggaagaaatggaaaaatgtcagccatgatgatgcagtattttagtagcaagttgatggtgttttggtttcccatgggaaatattgtcactggagcattagcagctatcggtcacttattagggtaaaaaagcaacttcagaagaatttaacatatgccaaagaatcaacaaaggaagtaatcagccagggcaaaggtcgcacaagagattgtaatctagcaatcagcagtggaataagcagtcagcttaccagaaacccaggaaaatgctttagaaagggcagtcaggactaaggcaatttaatgaaatgcaaaataaatgaaatctgaagtttaaaaatctagattacaattctggtttctaactcagttatgagaccttgggcaaagtcattaaatttctctgaacttcagatttttgggagtcaataaaccaatacatgtcaaagggcccgataaactttacagtttagaccaggcgtggtgtctcacccctgcaatctcagcactttgggaggccaaggcgggtggatcacatgaggccaggagtttgagaccagtctgaacaacatggtgaaatcccatctctattaaaagtacaaaaattatctgggcgggatggcatgcacctggaagtcccagctacttgtggggctgaggtgggaggatggcttgagcctgggaggcagaggttgctgtgagccaagatcgtgccactgcactccaacctgtgtgacagagtgagaccctgtttcagaaaaaatatagtttatcagcaaacaggaaagtcttgctaggcaacgtaattgattagttctgtgccctggattctgggctcttaactgtatgagcactgtaggtgtgagcagcaacaattaagaagctgcagaggtaaaggtataagggcagtgattgaggatgtctaccaagcagatttcggcaagtgtgtttcaagaagtatgccgcaatctgaaatacctaatcctgaaaaattgctagaatctagtcttttaattttggccagtatttagcagtagtttggccctctactctaaattaataaaaaataagtagtactatattatgagctgtgttatctaacagtttatcttagctagtagcaattaatttatagctgctattaaaatgactaacgtagttaaaagtttgatgactaagtttttttttgtttgtttgtttgtttttttgagctggagtctcgctctgtcgccaggctggagtgcagtggcatgatcttggctcactgcaacctccgcctcctggcttccagcaattctctgcctcagcctccccagcagctgggattacaggcacctgccaccgtgcctggctaatttttgtatttttagtagagatagggtttcaccatcttggccaggctggtcttgaacttgctgacctcgtgatccacccaccttagcctcccaaactgctaggattacagatttgagccaccacgcctggccttgatgactaaattttaggaaatgttttagcaattcttcatacacctttcacttatagttacttaattcctctactcttatcatttgatattttcattttattgtgtatctctgtaaggccgaatcaatagattttgaacaatctcacacttaacctttaaaaaaaatctaataggcccagtttcctctcagcaatctttgaagaaccttcgagaaaggagaaacacagacctcccgcttctagacatgcacactgtaacccgggaagagggagaaggcatggagacaactgattacggagtctgtgtcttccgccagcacatacacacagtctttagagcagctgcttaattctcccgaaactaaacttggtctgttactctgtctaaatatgttcttcttctttaatttcactgtcttatttaattactattacactaaggtacatatgcttttttgggctgctccaataaaatttctttcaatattccactacctgtttgtattagggttctctagagggacagagctaattggatggttggatggatggatgagatggatggatggatgcttattaagtattaccttacacgatcactaggccatctgcagactgaggagcaacgagagccagtccaagttccaaaactgaagaactaggagtctgatgttcaagggcaggaagcatccagcacaggagaaagatgtaggttgggaggctaggccagtctcgccttttcaggtttttctgcctgctttatattcgctggcagctgattagatggcacctaccaggttaagggtgggtctgccttccccagcccactgactcaaatgttaatctcctttggcaacaccctcacagacaacactcaggattaatactttgcatcctttaatccaatcaagttgacacccagtattaaccatcacactgtccaaatggaaaaattattaaacaaatcttttttaaaataaaatgctagctcttgccctaggcttgaaccataaataagtggtgggaagtttatagtcacaaataggtggtgggtattagaaagcaggataaactatcctctcacccttccaagaaactgacagtttcagtttattcctcttgatgaagtaatgctaaatttttgtagtgatgttttggtatattttattacctgtaattaatattactgttcaaaatttagggggaatctgtcatcttcctgaaacttcagaatcacctggagtaagggtcatttgtattcatggtcactgaccacatggggtagaaactgcaagtcatggttccttcaggcaaagttaatagtggtgacacggaggcatcatgatagagcagcagactccagaagccaatttgactttgtgatttctgaaaaaattacctgtcaactgtgagcctgtttcattgtctgtaaagtttgaataatgatacctaccccgcctgatagaagattcttatgagggaacatgatacgtgaccagtaaatgttaatgctttccttatacgtgaaatgacataaaatcttggaatattaatagatgggaagaagatgtgtaataaaactgtctataaacacaattctgacaaatttcagaactgggactcatagggcttgtattcagttagattacatgctttacaacagagatactgttttatttgtgtcacctacaacatataatctgttgattgaggtatgttgaatagatgaatggcaaagaaagcagacctataaaatatcacatagtaagatatttatatttagatttttcttatttagaatcttcatctgtaatgtatgattttgaaaattaattcttggaacaacatgttgcagagcctccattatggcatgctgaatttaccaaagaagaattggttcagaagctcagttccaccacaaaaagtgcagatcagttaaacggcctgcttcgggaaacagaggcaaccagtgcagtccttatggagcaaattaaggtgagatcagaaacctggccactgtgaaaaccgccagtttggttttctggaccctccatacacatgcacccaagtttaaaaattcacattgcagatgcatctataacgtcttgatctttatattagattattagattcctgatggtgagaaataaatattgccttttttttttttttttttttttttttttgagacagtcttgctctgtcacccaggctggagtgcagtggcacgatctcggctcactgcaagctccacctcccaggttcacgccattctcctgcctcagcctcccgagtagctgggactacaggtgcccgccaacatgcctggctaatttctttgtatttttagtagagacagggtttaccatgttagccaggatggtctcgatctcctgacctcgtgatccacctgccttggcctcccaaagtgtgggtattacaggcaagagccaccgcatccagccaaaatacttcttttacacctattacataaagattatttcttaattcctacttttcctaagaaaccgtaatagatttagaaactagagagatgttcacaaatcattgttcacatatgcttaaataaaaaatgggtgtgagtctttgaattctaaagataaccagtgaatttaaattattcaactgatatttatagtactgaactactaaacagttttcaggtggagatggcaaagtggcatgggaagtttttcctgtttaaagtagacaccagaaacatctaggaatgttgcagaacagttgaggattactcaaatgaggtatttccaccctggctcactgataaatcacccctcagaatatagtcatactgcttattgaggagttcttatgacccaggccctgggctctacatacattatttaatctcatcactggttgagagaaaaattgaagctggtaaatggtggaacaaaattcaaactcatagctgtctgaaaagtacatgcttttcccctgtactttgctgttcctagtagatctgtcctgccactgtgcaaggccactagctatccttgtcagattattttaaagccgaattcagttattttcagtaaattgtatatatcatgacattccaccattaaatacttcagtatgcatctctataaaatagcattttcccactaataaaaacattatcatagctaacaaatcactaactagcccagtaaacctaaatgacttatttaaatgttatattttcttttttttttttttttgagatagtcttgctctgtcaccaggtttggagtgcagtggtgcaatctcagctcactgcaatctccgcctcccaggttcaagcgattcccctgcctcagcctcccgagtagctgggactgcaggcacgcaccaccatgcccggctaattttttttattttactagagacacggtttcaccatgttggccaggacggtctgaatctcctgacctcatgatctgcctgcctcagcctcccaaagtgttgggattacaggcatgagccaccacgcctggccaaatgttatattttcataaatttatactctcttcatgatttctttgtcttctttattgtcacttttttaaatggtcctaggtttgaggacaaagttcgctaactttcttgcctaacctaaaatgaaaatatactaaaagctatggcttggtttcaacctggaaatcttcctcaaagacttgaacatgatactaccttttttatatcgttctttgcctcatttctctgatagtgttttacattgtcttatattcctgaattttcactgtgtctgaactttttaagtgccgttcactgtggacgtcttaactgcctgggacttcaggaacagcgtaggggcagggggttagtggaggctaccgatgttcccctcagcccattttcagagccccatgccatactggcttagtttctatcaaaagtagaaggcagagggaacatcttggtaccaacccatggctccagttagttgctcctcatggagacgttccatcagttccccagctttcaactccatttccatgataccctgtgcttctgagacaagaactccagtatttacacaggatgcatcctctcctcttgtcagtgatacttggtaagctgctggactgactcatttccacctcttcatctgtttctcgtgagaatgtcttgacgttatctcatctactttttctcctcttgtattagcttgttgcttttctacttcacccctcttccttccaaccccaaatagcttaggacaatggagtcatatagcccaacacttggttcatatgcagcaatccactttctaggcaaatgcagctttgaaactatctcatagttggagttccggttttcatgtcaaatggattttatacggtgatgtcataaactcctttgaaatgcttcacatgcagctgctgtagttaactgaattccttcctttattgccatatggagggaagggggaaatttggggggaagagaagaaaaatacatgagttcagtctgccatatttaatcagaagctcctaaagcccatttttaactcatttctctaacaccagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtgggtaaaaggagagtctcagaacttctgacttctaacttaaactaaacagcctggtggttgagaagttgtctgtatgtgtaacttttcaattttgctcatttgaattgggtctgtcatatgagtaggccgtgactagatttgaaaagctgactttttaacatcttgaggcaactgtagtacatttatataattttaacattcagcaaaatacaataagtgcttagcttgatcttctagctctttgaaaattggatttttatcctggtgttgagttctggtgttcagctgaacgtggttttgttttaaattctactttttaaaaaacatttattagcttgttccttttctacttcacccctcttccttcctccaaccccaaatagcctaagacaatggagtcatatagcccaacacttggtctatatacagcagtccactttctaggcaaatgcagttttaaaactgtgccataggccaggcactggtggttcatgcctataatcccaccactttgggaggccgaggcaggcggatcacaagatcaagatactgagactatcctggccaacatggtgaaatctcgtctctactaaaaatacaaaaattagctggacgtggtggcatgtgcctgtagtcccagctactcaggaggctgaggcaggagagtcgcttgaactcacgaggtggaggttgcagtgatctgtcacgccactgtactccagcctgacggcagagcgagactcccatctcaaaaaaaaaaaaaaaaaaaaaaaaaaaaaaaaaaaaaaaaaaaaaaaaaaaaactatgatgtagttagagttggtttccatgtcagatggatttaatactgtgatgtcattaacttctttgaaatgcttcatatacaactgctatagttaactgaattcaagctgcatcttaagaattatggtttcatttttgttttagttttaaattacttttatttttgacatttacaagcacaaggaagacgctataatctctcttgagttgtcacccatctctaacggttttcaactcatggacaatcttttggcgtaaataggggagagttagagacttaaatcccacacatcatttctttccccagtgaataattcaatgtttattggatttctctgtcacctatacctagtttatgttcattttgcctgtgttattgtgaatgtctttttatagtatcctaaatagggctcatatattgcatttggttgatgttccttaagctttattttgttgttgtgtttttgtttgtttgagacgtagtgttgctctgtcaccctggctggagtgcagtggtccgatcatggctcactgcaacctccgcctcccggattcaagcgattctcctgcgtcagcctcccaagtagctgggactacagatgcacgccagctaatttttctatttttagtagagacgaggtttcaccatgttggccaggatggtctcaatctcctgaccttgtcatctgcccgccttggcctcccaaagtgctgggattacaggtgtgagccaccacgcccggccattttgttttttttatctataacaattacatatataaatatatttttaatgtgccacttattaattgaagaaagtggtcatttatgctatagcagtcctatatttggtttttaatcattacagggtaacactgagcttgttctaattgcctataaataggaagatccaggtgcaattgggtgggatggtggacaaaaatacaccatagatggtattgtgtgctttctaagacatcaggaggcccagaatgtccagacatcttacttttgactgattgaccttatctagttggtgctctttaacatgttccccatcccctgtaaatcctaataactaaactgataagagtcatcctcaaaattgagcaggcatctgaatcatctggtatacttactaaaattccaattgctggtccccaatttctgacccaagattctgcatttttagcaattcgttgctgatacttctggtctggggcccataccttgagaatccctggtctagaggcctgataagattcaggcttaattttttttacagacatacttcataagtagtattgatagtttctttgaatctggtttttaataatctttctaatgatgaaggaggaatgttctcaatactgacagtaatctcagttcttcaaactataggataggtttctatagccacaatagtatttttgtcacaagggcccaaataagaatacatcatgtatatttttagtagttattcaaattacaggttcactgtctttaatttattctaacaaaagtaaacctaattttatagttataaaaaagaagaaatctacttctagtcacctaagagtaaaactgcccctataaaaaacaagacagaaatctcaaaattataactaattttatagttataaaattaaccaggactttaagaatgtttgcattttaaaattaaagttttcaatacaacaatgatattatctcaaaatactcagcatgtctaacaggtctcttttaaaagctcagcatgtttaatgtagacgttgctaacgtccaggtggctcctataagttaagggtccattgatttagaagttctaaaagagactaacctaagggataccaagaacagatatttttaaagaatttcatagaggagatacacattagaaacccagaactctaagatgtgcatttggtaagtcctgtaaacagacaggaaaacacatttaaattagtttgccctttaaagattatttcctacttgtctcttatcaatgtgagtacataaaagagaccttattacaattaaaaactgatggtttagcagcagatttagataccttacattttctctttaagagagagaatgtaaggcctggcacggtggctcacacctgtaatccagcactttgggaggctgaggagggtagatcacctgaggtcaggagttcgagaccagcctggccaacatggtgaaaccccgtctctactcagaatacaaaaattagctgggcgtggtggtgcatgcctgtaatcccagctacttgggaggctgaggtaggagaactgcttgaacccaggaggcagaggttgcagtgagccaagatggtgccattgcactccagcccgagcaacaagagcaaaactcttatctcaaaaaaaaaaaaaaaaaaaaaaaaatgtaaactacaagatagttcaaaagaaattacacagaattcagcatgggagaaacaaaaaacaagagtgggaaaagacatcaaacatgtttttactaatcgaagttctaaaaggagagacaagaatacagcacagataatatatgaagagaatggctggaaatctttcagaactgttgaaggatatctatccacagattcaaaaacccaataaaatctcaagcaatattaaaaaaaaaagaagaaatctacttctagtcacataagagtaaaactgcccctaaaaaagacagagagaaatctcaaaagcagccagagaaagaagacacattgcctcacaatagacttctcaacagcattggtgtaatactatctcatgtactaaaagaaataactgccaaccttttatattttccaagatctcttctggaaaacaaaaactttaagaatctgccttcactgaaaattcttaatgatgtacttcaagcaaaaagaaaatttcctaggtaaaagttctaagatgccagaaagaaagacatgcaaaggaaacttaccaccatattacagatatggactgtcagtctgactggtcacactaggggcatttggttaccaaggccttgaaaataataaccaacactgcatacatgagggatgccagaagaaaggtctgagagccactcttcctggcactgaaggaaacagggcccatcagagcaaacaagtaccttttacctctctccttggaagcaaatgtttataatctctggttttgtgtaaagtttataacagtatttttcattcaggttgctacctattagtggatggtgaaattaatttggtggatcacattcagaatatttttttaaaatcaaaagaatacaagctggggtcagtgactcacagctgtaagcccaaaagtttgggaagaccaggcaggaggattgcttgagaacaggagttcagaatcagcgtgggcaacatggcgagaccctatgtctacaaaaattttaaaatataccagatctggtggcatgtgcccatagtcctagctactcgggaggctaaggcagcaggattctttgttataaggagtttgaggctgcagtcaaacttctggtcgaaatcctggtcatgccactgcatttcagcctgggcaacagagtaaaaccccatctttaaaaaaaaaattaagaaataaaaataatatgtgaaacattagaatatgttgaatctagtaaggataagcaattatttcttgaaactctacatatatacatgagtgttggtaaatacctgactgtatcatcagctctagatataaaatgtttatgatgttggctgtgagttaatgaggaatagttttcctttctgtgggtttgggtgtatttgggaaacattagctaagggggtaaagtaggttacccaactctgaaaagcagcatcaaaatctttataataaacacatactaggggcccaacttaaatttcaagcagatgtcatgagctgctcagagtagcatgttacaactctgcgttataaggtaaaatgacacattgcctcacaatagcctgccagatctgagaacacagcaaaatttttattttgtcaaaaatctcatattcagcttacaccattcatttcaggtgaacatacaacagtgcatttcagtttagggaaatgtttacagtcatctggttctctttattcctgggaacaaggttacctcacttggaacacataaccagtgccaagttgtccatccctaagcaatattgcttccttctactttctagaagttcttcagattgtggaagagaaacttttcagagttctttgccctcattccctcctccagaaattcatgcctttgtataatctcttccccctgagagccagtaggctaacctaatgagttatttttaaccagtagaatacagcaaaaatgatagattacaagagattgtggcttctatcttgctagcggactctctctgtcttctctgcttgcacactttgttgaagcaagctaccatcccagaggcaaggaacacaggccatcagtttagcagccttgaggaactaaattcttccaactaccacataagtttggaagtagattcttctccagtccagccttcagatgagaccccagccatgccaacatcttgattgcagccctgtgagagaccttgaaatagaaccatttctgatctcctgacccacagaaactgtgaaataaatatgtgttaaggtactaagtttgtagtaatttgttacacagcagattgtaaataacacgtagataaaaccagacagaacagaaaaataaaatggctttaaacctagaaagtttccccatgtaaaattttgaaaatgctactctgcctaaggtcaaaccgtcatacatatatacgtatgaaaacacagaaaggtgtctggaagggtaataccaaattaaatctttatccaagaggaatgaaaaccagtattcacacaaaaacctatgcacaaaccttgtgaatatattaaaaaccagtgacttatgcactttaaaaaggtgaattatgtggtatatgaattatatctccaaaacatttaattaaaaacctgtacacaattattcatagaaactttctttaaaattgctaaaaacgaggaagatctcagttatccttcaactggcaaatgaataaacaaactggtacagccatgcaattgaatactgctcagcaataaaaaagaatgcactgccagtacagcaacatggataattctcaaatgcattatgccagttgacagaggtcagactcaaaatactatgtacagtgtgattctacttatatgacactgaaaaaagcagtactataaggacagaaaacaggttagtggttgccaaggagtgggagaagcagccagggagaactttgaggaggtaaaaatgtgccaggccttggtcggtggtggtacataactgtgcatttgtcaagactcagtgctatacgctgaaaagggcaggttttactataagttgtacctcaataaacatgatttttaaatgattaaaactttggtttttgtttgttttggttcagttttaaggtttaccataaatctattggttttagattctaagttgtatataagcttctgttttaaaagaacttttttaaaaatcctcttatcatcaacaatatttagttgtgctggaaattttattttggaattgtttaatagagaaagacaataaataatgttcaagaacagacattgattcataacatcaaagtatattgtgagaagatggtatttcagaatagaggaagaatttcttatgtgctggtaagattgtagataatcatttctgcataattttcatagctggattgctttaataaagccacttaaaggttaagttctagattgcttcatgttgcttatcaatgttttaaagctaaaatagaaaattagctgttaagttggctcaaccggaaattcagtatatcctttaaaaagagaaatttagtaagcagtgtgtctaaagaatgacatatggttgggtacagtggctcgtgactgtaatcccaacactgtgaggctgaagtgggaggatcacttaagcccaggaatttgagaccagcctggaaaacagcccagcccagcccatgcctggctaatttttttttttttttttggattttagtagagacaaggtttcaccatgttgcccagctggtcttgaactcctgagtgcaggcaatccacccacctcaccctcccaaagtgctaggattacaggtatttggttttttgtttggttttcaagcaacctttctcaattttgctatgctcactctttcttcacatgttggtactggctagatacagattttgctttcctattggagactcttttgagagctggctattccctcttgctccttttcttttttctcttccctactttcaagtttcttgctctttttcttaccccataagttaccagaaattcatacccccttgagagggctttttctttgaacttcagtctttagtttcatcaacttttctaaggaaattgatctgttaatgaaagttggcttgcttgacttcagaatatctgtattattcaatgatgtgtttttctggttgctttgtttgagcatagtgtaaatatcacccattgcatagctatggcagtgacataaatctagcagcgtaagatcgagaaaagctagaagtcccaccacagattgtatttcagtgaaagggattcattttaactgcttataaaactaaagaaaacttataaacatggaaaacaattattaaacccaccatatgctcatactgatattaaatggtgtgccagattctagaaagagttaccttttggtaagagcactgcttgttaactatggttggttgctttagatgtctagtgtgtacacaaaagcatgaattttattccttataaccaaagtagaaacctactctgagcaatttgacaaaaggtttacattatttattttagtgtagtttaagattacagtaagatgcaattcccaaagagtgaaatataaggctgggcatggtggatcacgcctgtaatcctaacactttgggaggctgaggcaggtgcatcacctgagatcaggagttcgagaccagcctggccaacatgacgaaaccccatctctactaaaaatacaacaattagccagatgtggtggtgcccacctgtaatcccagctactagggaggctgaggcaggagaatcccttgaacctgggggggtggaggctggagtgagctgagatcatgccattgcactccagcctgggcacactctcaaaaaaaaaaaaagtgcaatataacttttcacaaaatatggaactgtggtagtctagaacaatgtctcaatatacctcctacacgaagtataatagtaaatatctgtatttggtggcataatatgctcttagtataaaccaaaaacacatgctgagcattggacattgtccaatgtttaattcatatgattcattctgagtttctgactgagatcattctttcagactgtgtatttctcctgggatccataaaatatgcagccctaacatgatttcatttttgtttcctttcctggaaaaggagaaatcattcagatcagctttcatattgccttatagacgatgacttcaaaatagttttaaagggactcctttgttctagaactgctctaacacagtagccactagccacatgtggctattgaaagattgaaatgtggttattccaaatcaggatgtacagtaaatataaaatacacaccagatttcaaaggcttacatgaaaaaagtaatgtgaaatatctcactagtagtttttatagtgattacatgttgaaattttaacattgtgaacatattagtttaaataaaatgtattgtgaaaattaatttcatgtttctatttacttttgataaaagtactactagaggctgggtgtggtggctcactcctgtaatcccagcactttgggaggctgaggtgggaggatcacgaggtcaggagaccgagaccatcctggctaacacggtgaaaccccgtctctactaaaaacacaaaaaattagccaggcgtgttggcaggcgcctgtagtcccagctactagggaggctgaggcaggagaatggcgcgaacccgggaggcggagcttgcagtgagctgagatcgtgccactgcactccagcctgggcttcagagcgagactccgtctcagaaaaaaaaacactactagcacatttttaaattacttgtagtgatctcatttgtaacacattacatttcaatcgtatactgcttttctaaagagtcactgctaagccctgaaattaactccaaatacctccctgggatacagtgccaaggaaggggcttccttgaacttcaacctctaaaagtaagcaagaattgagaaatatcttctgctttgaaaaatattcactccccaacgctaatacatcaattacatattatttgggggctaactaagctcctattttaaaatgtaaactgaagaaatcaggccagagtcattcccatcttagtgccaatcatataatcagataattagattgctctttccctaaagcctgtttagtttttttgtttgctggttttgttgttgttgggttttttaatttgtttttgttgttgttgttgttgttgttgttttgagatggatactcactgtgtcacccaggctagagtgcagcggcatgatctctgctcagtgcaacctccaactcctgggttcaagcgattctcctgcctcagcctcctgagtagctgggactgtaggtgcatgccaccacgcccgtctaatttttttgttttttggtttttttgtttgttttgagacagtctcgctgtttcccaggctggagtgcagtggcacgatctcggctcactgcaacctccacttccgaggttcaagcgattctcctgcctcagcctcccaagtagctgggactacaggtgcatggcattatgcctggctaattttttgtatttttagcagagatggggtttcgccatgttggcaaaactggtctcaaacttctggcctcaggtgatccagccgtctcagatcaaagtgctgggattacaggcatgagccaccactcacagctcgctaaggccttttgccaagacaaattagctcttagagaaccacaggattccttttgtaatgtattacaaactaaagtcttacctactcttgaagagtagaaaacatggaaaagttctatgttagcccttagaataattaaaaattcataagctctgaaataaagacaggtaataaaatcattgcgtatgacaaaacaaaagtttaaattggcgtttgtaaactctgcatgaaagccaggtttctcactactagaaaaaaagttataaataaaccaaggagaattccagaatgaatcctgtggtgccaaatatatgttaactacaaggaataacagtgaccttacactggaaacaccttaaccatgggccaaggttaaagatataacagcattctcacaccccttgcatagctacccccaatgttaacataactgttaacaaattatcaaaactaagaaattcgtcttggtatagtatcactaactaaactccagacctcagtcaggttttcccagtctttccttcagtgtccttcctctgtttcaggattcaatccatgatccttgacacttggtactttgtcagatgtcccgctgtatgggtttgtttgatgttttcccatgattagggatagacactgcaagactcagagctactttacaaagaagcctctagggagctccccagagaagacaggggagacaacacaaggacactagaggaaattttagcctctgacatccatgactatatagcaaagagtaaacaaagcctaactcctagccagagaaacacaaaatctcatactaaagccttatttaactcagttcgtttcacccagtacatcatatacagcctcaaacaaaaaattacaaagcatactaaaagacaagaaaccccacagtttgaagagacagagcaagcatcagaaccagactcagatatgaaagaaatatcggaagtatccaaccaggaatttaaaataactaagattaacatgctaggggctctaatgtaaaaatggcataacatgcaagaacagatgggtaatgtaagcaaagagataaaaacactaagaagaaataaagatgaaatactagaaataaaaaacaccataacagaaatgaagaatgcctttgatgggttcatcaaaagaatggatatggccaatgaaagaatcagtgagctcaaagagatgtcaatagatacttcaaaagctgacacacaatgagagaaaagaatgaaaaagaaaaaacagaacaagagtcaagaactgtgagacaattacaaaaggtggaacatggagactttttggaaataccagaaagagaagaaaaagagaaagaaagccaggcatggtggcttacgcctataatgccagcaatttgggaggccgaggcgggcagatcgcaaggtcaggagatcgagaccatcctggctaacacggtgaaaccctgtctctactaaaaatacaaaaaattagcggggcgtggtggcaggcgcctgtagtcccagctactcgggagactgaggcaggagaatggcatgaacctgggaggaggagcttgcagtgagctgagatcgtgccactgcactccagcctgggcaacagagcaagactctgtctcaaaaaaaaaaaaaaaaaagagaaagaaacagaagaaacatttgaagcaacagtgactgaaaattcccccaaattcatgatagataaagctatggtctgaatgtttgtgtctcctcaaaagttatattgaaacttaatcctcaatgtgatagtactgaggtggggcttttgggagtcaatcaggttacgagggctctaccctcaggacagagattagtgcacttatgaaagaagccccagggaattagctagcccctgacaccatgtgaggacaaagccagaatgtgtcatctatgaggaagcagggcctcaccagacactgctagtgccttggtcttggacatcacagcccctagaacggtgagaaataaatttctgttgtttataaactctccagtttatgatatttttgtcacagcagcccaaatgaactaaggtagacataaaggaacagatccaggaagctcaaaatacatcatttcaataatgatctttaaaactttgtttgaaattatactgatcattccgctgactgctgaatgacctggcaccgtctcagggttttagtctggagtttttgtttatgctcatggcctcacggagaacaatattcacctgaagtgacggcgcttctctttttatgttgttgagaagcatgattggctctttttttgcaaaattattcacaaacttaaactttgattcagaattattgaagtaacatggtgaggcagagtaatatgtgacttaaattttatggagtactaaggaaaacgggcagacttaatataaaagtggtgcattggtggtgcttaagggcaaataccgataacatggtgtacaaataaaggatcccgatgattcaaacaggtggaagtgatgggagaactgagttgtcacacagtaccatatccacactgtcacacaaatctcacctttatttattcccttttgcactaacgtagccagaaatgtgaaacgatgacagttttttcagtaggtattttttttttttagtttttatcattgacctttgaggtgcactattaaattgctcagtccattaaaataacggattgctgatttaaaaactggttccttgcttagcttcagcaaaacagcaaagtctaccacattaaatgtatattgtttatttgatttttattgactttgttgtcttattttaactacttaattgcaaatctgtcttggggttaacactgtgtaagagttttaagcataagaagtctgtacttagagtttagatgtagttttatatttgtacatgttgatgtaacattttaataataataattcaggtctgctgggcatggtggctcatgcctgtaatcccagcactttgggaggctgaggcgggcggctcacctgaggtcgagagttcaagaccagcctgaccaacatggagaaaccctgtctctactaaaaatgtaaaattagccaggcatggtggcacatgcatgtaattccagctacttgggaggctgaggtaggagaatcgcttgaacccggaggcggaggttgtggtgagctgagatcgcaccattgcactctagcctgggcaatgagagcaaaattctgtctcagaaaaaaaaaaaaaatcaggttaattctgggatctgagcaaagttttgctcctttccgagaggtgaacacgttacgcaattattaataatatccctgtgggaaggggctttacaacaaattattttacaggtgaagggcagaaatgaaaacattttctagagccactcctgcccttcacactcaggaatgtcgcagtagtcatctctctgttctggatcagtagtatagcaccagggcccctgcgcatcgttgtctggattcctccagtccctctgaggggtgtgtagcaggtgagaatctggggaggatggaagagaagcacttagactatattctaaaaatcagcttgctattagcaaggcagaaggagatgctctcgattcccatctgagattgtcatccaaatgcatttcagctgggtgctgcagcatttgtgtggtcagattttcaatttctctattgataggctgcttctggcacagtagctaatattaccattgctactgtgacagccaagtcttagacagagagccaaaatatttttattgcacagtcaggagaaatataaaggcctcaaaagcctgccatggtcttaattcattccaaacacctgcttttgtcagttgcccttttctctgtaaaaattttcgtagttaacaccattttgtccatgtgaactatgtgccaggaattccactaacatctttccacacattctctcttttagtcctaataaaaaaaaccatttgaggaaggtgttattatccctgttttacagatgagaagactgagtggcaacgtaaaacaaaacaaaacaaaacttgcctaagcataaatagctatgaagaagcagatcaagaagtcaaagttgatctgtctgattccaaagtcctggttttctctgaaatgcagcttgaattattggggatggaggagggatttaaacttattttcagttctagagatgagttgctgtatagagacaaccatttagatgacaatcacaagacttacagtctagaaaggcaggttttatttctggttcttctgtgaacctatttgggtaacccccaccccccaagacctcagttccctcatgaagatgagcctagactacctcataaaaatggcccagagtgtctccatggcccccgatagtctctgacttcgccatttggttgaatcagttttcattaactcacggggaatatttgatctgctcatctcatagggatatagcaaaggcaatttgttgagtgttgggggaatggataaaggtgagtaacactaagttcctatttgataagtgtcattactgagaacttaaggccacctaacaccaaactgggaaaagcacaaaaaaatgcactaaaataaataataggcaagttgtgacatttgaatttcacgtatcttcattttcatttttatattttatttactattttgctccacaatttgagtcaaacatgtgatgagagttctaacttgatatgtttacttcagtcccaaacatagtcatctttggtcttttctcagatttggcctaaaactcgtagtttcattgatttttttttttaactaggcattcttctatgttctaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaatgcttttaacccaatactacgtattatgattgccagtacatcttcattgggacatagtattacagtagacataagacactcatcaaagtgtaaactcaaggtactttgtgaaagggaggtctaggggtcaaggaagatttgcaaaggaggtgatgattgagctgacacctaggcgataagaaggagctggcacagcaggacaaaggtgaagagggtcccaggcaggagggcgtgtgcttggggtggtgaaggaacagaagtaaggccagaaactttgtagaaaagtttagcaagccaagcaaacagcagccgggggttacgtaaataatgccgggccctggcacatttgggaagtctttgggtcttattttaagggcactaggaagggctttaaacagggaagttatatttcttcgagatcaggtgtacagctacaagtagccccaaccagtggtgatagggtcttggactcggtgaaggcagtgtggctggtggcaagtggcagaagtaaacgtgatctaacactgactgttcctggcaaaaccctggcaggtaagttagcagcaggtcaatatcccacagcaactgtatgtacccaccggagtttatataaccttttgctcccttctgtcactttgaaaacaagcaaactaagccttcaaacttcacacttcaaactcaacctacagtcattcccatgttccttctggttaacaatttacaaatgacatatttaaatgttagcattttgtagagagaatcaggagaatcagggttttttgtttttgtttttaaatctggtacaattaggtcatcctatttagtttaccgtttgcttgctacttgtaagaactaataactttaccagataaagtttagatttcatctgtactttaatctcaagaattcgagataaatagtggtaaggaagaaagtacaatgcgtacagctaatgaaacccaggaagatgagtcaatgcatagaaataattccaacccaaataaatactatttaaaatgctacttggagttttgccgtgatactagacacaatatggcaaatcatcctcaagaatacaagaactaaggtgtttccagtcctctttaacacctgtgatgcaggatatttggagagctaaattgttattattaacagtcttaatacctggccaccaacacagtagaggaaacagtttttaaagtgtcatacatctcttcaaatattcatacgcttaatgaaacattcgcacatctaaaaaggcatgcaatttctattgaaatcctgtgtgcctcttattctaagcagtgggactattgacccacattttaaaataaactatagaaaaggaactgtaacttttacacatttttaaaagacaacatatcagaaatctgagaaaaatatagaccatgtcccccaaaatgtgaaaaatttaagagtaaaaaataagatttgtgtcccaatctaaatgtttctgaggattaaaacacctcagtatttctgttttacaaggcttcgtccagatgttagggcccaaggaccatggtcaccctgcagaataagaagccaagaccaaaaggaatgcttagacttcccatctccttgttaaatataaaataatattttaaaaatcttattttcagggtcatagaggtagaagtgattttgtaaatctaatcctttcattttttgaacaaaaaaaaattaaatctaggaggtgaagtaatatactcaagctgacatggttagttagtaatcaaatcctgtcctaactcagaattcaattttacaacaccatagcaccttcctcctctggtctcataaattaaagatagaatagagaaagaggaagagtgggaggatggggaggacagtaggaggaggaggaagaaaatgtactcactttacttttcaaataaaactgcatctctcatcctaatgattatggaggacttcctgttttcagccattatcacacattgttgctctttactgtgatattggaatgccctgcagaacgaagcaggaaatccaataagtatttttctttatttaaagaaaacaaatgtttattaataaatgagaaatgctaaagatcattgactatcttgagggaccagagagctcagaattgctgcctctttcagttatttgggcatggcattgatgaagtactgaacaaaatacaccaacgtggcagtaaatcttatctgcccttaccttccctccctcataattttctctttctttctgtttcaactgttttacttcttcttcactcatcttcttaatttttgtttttgggtcagaaagaagcaactctggttgctttgaacccattccccaagatagtccatctccatgacctcccaactctgatcagttcccctgaacctctgtcccacattccaccccaccctggcccctgacccctcccatctccatcccgtggtcctgctatgggtgctcagtctggcatccatagctactttcccaggctcatcacctacacaaagtctctgctttagtcaacttgatctcttaatggtccccctcagaaagtgcagggccgcatcttcccctgccttcctggtgcttttcaagagctctctcaactccaaacccagctcggttcccacctcctccctgagccttctctagctgcctcaaccttaggcactgttctttcttctggatctgggtagaacatgcattgattatgcctgtagctcacttaggctgtcttttttttttttaacattatatccagtcaccttaaatactgaagggcaggcactggatcttgtagctataagtcattgctcagatctatctaggacactttcattcatatgatcctcaacaaacatttactgatgatgatgttaaaaactggagctcagaacaataactgctaatgtttatgtccggtgtaaaaacaaataacttccttttagggtatttttctaatgaagactccagtaaaccttaacaagaagctgttagtatggcttcacatgctatgagcaaatatagttccaaactctggctccataaatttctctttcctcttaaatcgttaataaatttgtgagtaaattacttgccatctgaattacagatttctgggtaggtgcaacgacgatgaaaatacctgcaggtgaattctttgtcctcttcacattttgctgcacattcttctctgcttcctgcccccagctgcttcttagtgacactgaacagtgaaggcccctgggtattcacatagtcatccaggggctctccttgacctagaggtgggagatccaagtggaataaatggtcagtaaatcaatgccaatgtctaattgtcatgacttccttttaatctatttggttagcattaaccaaataaaacttgctgtttactggaagtagaatgggtagctatgaatcaaaatgtttagttaagaacacacagttgggcatgtggacataaataaagatggcaactaaagacactggggactaccagagaagggagagagggagcgaggcaagggctgaaaaactacctatttagtaggtatttagctcactacctgggtgatgggaatcatttgtaccccaaagctcagtgtcacgcaatttagtgatgtaacaaacctgcacatgtacccctgactctaaaagttgaaattataaaacaaagaaaaacagtttcattaacagattgcaagatagtaaaagattaactggattgataaacaggttagaactatggaaccactactatgttaccatattagtggatataaatccttaaacaagaacaaattttatgtttgctatcaattgtgccatgtcatgagagaagagtaaggcaccatcagtggcagttgtgttaccaagattgatgttgatttgttcatccctgggtagaaatggaacttggaggccattgtttgatttcctacaatatgcgctttggttctgacactgtcacttgaactggtgggaagcatcctctgaatggtccctccttgaggcacataaattttggtgcatagatgatggtggaaataaacaagaactgaactaaattatgttgccaccttggacaaaaattgggcaaaacactggagggtaagaagctccccaacaaagaaggccatttttgtactgggctgatgacagtcacacaacactactaactggggagaaatcagtttttccaaggtgttgacaggtatctggatttcggaggaaattgtaaaaaagcagaacctgggacaaatactggtcttggtttttctttgagatcaaatctgagacaacgaatctgtccgaaagctgctttctgcctggtcgtggcagagggtggccaagggggcctcagctgtgctcccaccacaaggctacagggtgttcccttgtcctgaggctcttccggacatctggctgagctttggtaggtctattccaagcctggagatgccagctccatccttcgcacagaatgctagtgattttcacaggggtaagaggccaaaagaggctaataaaatgaagatagccaagctccatggaattagacaacaggacaaccttgaccactttgaggggcgtggtgggggctgcaggcagagggagtgggttatagagtgacgaggagagcagtggaggcggcagcgggagacaagcctggctctgaagacagcgagccctccagggaagatgcggtcaggggaggttctgaaagatgacacactgcagagcacactggtttgtatgctgatgacaaatatccagtaggaaggcaaatgaacagattctcattctcagaaaggcccgtcctgacctcctgagggtacacagagcacagggaggaggatgcacgctcatcaattcatgcaaagtcctcggccaaagtccccctgctccccacctctgggacttcgtccttcctcaatttaagacattccgggctggaaaaatggattattgagcaggagttggctgatgcattctaaacctaatccactaaaaagcacttgagagatgtatcaaaagatcacaaagaaatagatgctttaggcccatatccatgtctttaccccgcactttctgccaacttgaactctcatttccaagaagagttgtgttttggttaattctatagctcgcagtgtgacttcaaaacacacaataaatccacaaagtgtgtcctacggtgagttcagttaaactttctgaagagtttttttgaagtatagcagagcaggctacaattgatattcaaaaaaagaaaacttccatttatttcccccttcaattaagttctctgtgtcatgttattatacttcatagcacatcgctgctgagatcccctccccagctcctgtccctaggaaatatcccaaaacagaatcaaactgttttctttttaatttgaaataattttcccccattttttttttctcttattcacctctaggactcatatggcaataggatttgatagggcttatttgctggcaaggaaacatcaaatcttttagtggaaaaatacatttatattataggcaaaatgcagatgtatattgctactgatgcaaatgtattttattaatggtgtgagaatttcttcctcactgtggtgtgtgaatgtgtatgcatatttgcatgtgtaaaagacttaatttgtgaaatggaagatgtttctccacttcccactaagcatggctgtaaaagaaactttttcctctccccgggcattgcagcacactggaaagatgatacatccacagaaagcctggctttccaaaagagcttatgagagaatgttccccccaggttggttaaaacattggtaatcctgtggcggagaagtttgttctagcctttgggtgtagcccactgaataagttcacagtgatctatgtcatagtttccatgcattgaaatataatattcacacccccaacatacaccaatttcttacaaaaatttctttaattttctcctgctctgtattttgtttgatagctccttgaatggcttccactaaattcaaatgtatttgactctaaagtgcaacttgtaaaattttatctggtaatttatagattgaatttcaagtatacattatttacaggaagaactactagcaaatcgtatgattccgttcgtatgaaatgttcaaaatggcaaagatataaatacagaaagtagattagtggttgccagaagctgcagatcgggggtaacagctaaggagagtggagtgcgtttttgggggtatgaatagttttaaaatttattctgatggtggctgcacaactctcaatatattgaaatccattggattgtatgcctaaatgggtgaattctatacattaattatatctcaataaagcttttttttaaaaaaagaaaaagaaaaagaactactaggacatgtttagaatattatttcaaaggcttaaacaaagctgaaaagtgagaagagccctagattccttctgggaaacctggcttaaatccagttttctttatttcccagatttgagaatttggtcactgagcaaataacatgattttcctaagtctagatttctttgtttataaaatgagggtgaatatgctaccctacctataccgcgagctaaataagctagtatttgtaaaggacacacactcacactcacattcacacacaggtatgtatgtatgtgtaaaaatgtagcgacctaacccaagcactaagtgagtatttgttgaatcactgtctgcacacagcatctggcaaatggatgcgtgtgatttttccggggattagaggcaaacgtatactgatggaaagccttcctcaggccataacaaagggagaaatgctgaatccctgacgctgccaccaccatgaactggtgagagaacagaatatattcaaagagaaatttcattgttttaacttgcaagtgaggggagcatgacaccgtaagagagattatataaattagtcaaactgagaaccaggcgaagagcttagccgtcctttgcatagttagctacattggctctttttcaattagactggccattatgtgggtgcactcatttagatttgaaaaaccacccattattttctctgcgcattcattccagcacgctgacaatcttcacaggaaaactaaacttatttcttgaagaattcctcaatcttatacaagattttcaactgggagtttcatgaatcaaaaattaaatgaattgcacataaagccatggcatatgtatttgtactgcattgtgggagaaaaaataattattataatttaaaaaaactatgtcttacctgatttcagaaataaaagaagtagaagaaccacttccttatgttccattttgggactggccagcagtgcccagaaagtgtgtcccaatcccaggatgttgttgacttacatgagagtaaacgcatccacagaccagatagtcaaattaagttaatgattctctcagacacccacgccactggctcagcagggttcaaacacgaccttgaataaagggtccttacaaaatgattgagggtggaatctgcaatagatgctgggaagtggtgaaagcaatctcccccctcagctgctccatgctgccttcatgtctccttactccttccctcacctttgtactttatctctcacaattagtcttatttcctcccctcttcttttattccctttcttttggagaaaatgaaatcagaaaagtatctcacatttgctggaaccttccatgacgagaccctctgccaagcgctgcacgtccatagcctccctcaagcttcccaacaggcagtgctgttctcattcctgctgtacgagggatggggctgaggccttccccaaggttgtgtcgctacccaggggtgcagctgatagacaaaaccctttcaggtcctggatgacaaacttaagttaggtgtaaatgttaatatctccacatcctacaccaaatgacatagaaattacgacataagtgaaagtatcttattatcttcaaaatttctttattcccagtgaactcacatgttttctgtaattataaattataagacatcaatctttcccccaaatgaacgtatggcatattattatattctcattctcatgaaataaagcaagactggtagcactaagtggaaagcgtctatctcaattttaaatgttgaatctgtacttttccctggcttaagtctagagcaaccaggtagtatatatgttgtaaaacttctattttagtgttcaaagatatttagcaataaatcaattgacctctctattttagatgtgaaataaggaccagaaagcattgttcctctttccaggcagtgaaattcctgcctattcattaactggcaaaagagtagaggtgggagcccaatggtcttgggtggaacgtcctgtggaattccctgggattgaggaatcatgcagaaccctcaagaagaaaccacactgggcaacaagagggtggccccatgtgaggaacagggggaccgaatcgcatttcctgatttcctattctagcctcactctcttctctcctcaaattcttaccactccctttatcctctctgactcacctcgtggcccagttcattaaaggggacagaaggtggaggcaaattgagaaaccagcagtgggcagacgttttatttttaatgtgaaatgtctcttagggggcttatgttgatgtgcttgagaaagtactttgggggaaaaaaaaactaactctactaatatataatgcttccagcatgtatttatttccacttaaaatattattgtagcagttcctcttggataaggcatcttgggaatgatgttatcagaaattctacatccacataattttcttttcctgtttttttggttttgacttgggtagtgttggtatagcttttgcccacctttcccctggtaggtgttagatgcattaaattctacaaatgcgattttataaattagttgccctcctaatggcctcctggctgtacattcttccctaccttcataatccatcagcatcgtgaaagcacagagggacattgagcagagttctgtgctggcgccaccgcactctgtagcctgtaagagagcagcaaagaggaatgagttgctcaggtatagacaggggtggatgcatagagacttccactgtggcacggcccttcatgtccagggtaggcatgaagcaatggactattccagattgtgcataggaaaccacactgcactcttagacggatttttgctctaaagacaactaattcaaaataaggtgctttctacctgaaataatggcatgaactgagaaaagagatatagagagagatctctgtgtactacgatcaggttgcacatattctgagatttatgtattcttatttagttcaattccttatttactgaccacttactgtgtacaatattgtattagattcttttaggattacagttgacccttgaacaacttgggggcttggcacactgaccgtacacagtagaaaatccaggtataattctgattcccccaaacttaactactgatagcctgctgttgaccagcaacagttaataacatgtattttgtatgctatatgtattatatactgtattcttacaataaagtaagctagagaaaaggaaacgtttctaaggagaaaatacatctatggtactgttatgtatttatccatacagtaagtttacaccgcctgtttacaagatgaatcatctgtctgaaatggaagcaaccccagctacagacctcagtctctgttacatatcaagcaaatcaagtttttcttgtaatgtcaaatgtcatgacttttctctgcttcttgggagcacttccagcatcactagtgccacttcatgtggatcccatggtgttattcaaggtttacagtacagcacgaaacaggacgaaaaatacatgtgaacagggagagggcactttttactgggatgcgcaattcactggggatgacctgctcatgatggaatgttgagtatcacagaacgttttaagtggatacttgcaacacctgagctcattgcaacagcaacaggaggaggctatgaacttattaccgtactgtggtatgcactacggttaaatttatgcagttacaatttaatactgcatcttgatgtttgtatacacttctctcaactgagaatagcaccatatacgatctgtgagtgtgtacataagttttactaaattttaacttttgcaatagttttgttatattttatggtagtaaataataaaatagactaggtatctacatacattttatgcattcatgacatacttaactttttctatttttgttgatatttctagctgcatggtttgtctttgagttttttcaaattgttgcaaaactccaaaacattttctaacacatttattgaaaaaaatctgtgtgtaacagttcagacgtgtgttgttcaatgatcaactatatgtctaaagagtacaaatcagtctgtaaccttccccagcctctccatgctaaaggaactacaggaaactttcgcactcaagatgtgtggagattctgctgctgcacttgtagcaggcataagaacgttcaaataggccgggcgcggtggctaatgcccgtaatcccagcattttgggaggccaagacgggtggatcacgaggtcaggagttcgagaccagcctggccagcatggtgaaaccccatctctactaaaaatacaaaaaattagccgggcatggtggcatgctcctgtagtcccagatactggggaggctgaggcaggagaattgcttgaacccagcaggcagaggttgcagtgagccgagatcgtgccattgcactccagcctgggtgagagagcaagactctgtctcaaaaaaaaaaaaaaaaaaaaagaacattcaaataagattggagacaaattgaatttccttagctctgcccagcataaggcctgcaatcaagatccactcaggtcctcttatgaaggaatagacgtctcttccagcattaaaatggtaaattccttgcaagtatttacaaagaaagttataaacaccaggaaacatcaacctcaccaggaggtgaggtagagttcacccttccatctcacctgaagtggaaaatgcagccaagtcacaacttcctaggtgatgcacgtccatgcaagctggactgcattgctggcctgacatttgcacctggcagctcctcgccaccccctctttccaccttccttgagcccaggctctgctgcccgggaactgccattctaggacagctcatttcatcaagatgaacttctctgaatagccctaagaggacagtatcatttccaactggaaatagcaagaacttaattaatctactaaggattcatataaagcatccctctgtcgtggtaagggtcctcggcaagtttatctgtgccctcgatgccaatgtgcaggttgtttttactgctgttttagtgtattagagcatatcagcgaggagacttctactaattaacctggaggtggctcttctttctttagttgctcttttccacatgttagcctttgttcatcagtccccaggaccatgcaatgaggtgcttatcagccctcatgtcccgtaaagagatagcaggctatctctcaagttagcacagtggttaaaacgtaatccactagggggcattttcctttcctttctttctttctttctttttttttttttggaaacagaggctggctctgtcacccaggctggagtgcggtggtacaaacacagctcactgtagccttaacctcctggattcaagcgattctcccacctcagactccagagtagctgggaccacaggtgcacgccaccatgcacagctatttttttttttttttttgtattttctgtagggacagggttttgccatgttacccaggctggtcttgaactcctgggctcatgagatcctcctatctcagtctccagaagtgctgggattacaaatatgaggcactttgcctggcactaggagacactttctcagtgagacctaactcatttggggctcagtgaggtgatattttcttaattgagttgtgcttgaaaaaatctagatatctattcatctttgaaaaaattaattttcattggctgtctcctcatcattaataagcatggctgtgttacatgcttaagacaaatattagcagagaagaagaaagtcagacccggataacttagcagcctgcactgaggtggcaccaggactccccagaggagagacgagggtccttctgctctgaggtccagactcaccatggataaaacagagttgcaccaaatcatccttcccatctctcacattgattgttctctaagctcattcagagaaaaaaaaaatcttatctcacagtatgtcagggagataagtcatgtagaaaaaccttaaaatattttcaggaaagcaaatgagtgcacaaaaaacctggtgaaatctgagcaaggtctgcagactagtttctgatattgtgccaatggcaactttccagttgtaatcatgaactatagttatgtaagatactgcctgagggaggcggggccataggcacaaggatctctcagtactatatttgtaacttgttgtgtttatacttatttcaaaacaaaaattatatgtatatatttatatatgtatacatgttatgtttgcaacacatgtgcctatatttggatacatgtgtctattttaggaggacctaggatgatgtaactgctttcatactagttaagagaattcccaaatttcagggaaagtctaaagttatagagttcctaactcagggtgcagaactcggactttggctgattctcgtgagctcctgggatgagtgggtgggacagagaggcttctccaccaccacactccttccctggctggagaccagatggttaaggactgatgggtgccagagagcagcagccctccatgtgggtccagaacccagaggctggagtagttcatgcctgctcctgcctcccaggtattcaagggaaacccaccatctccacacaccagcaaaacaccagcaaaacagaggccccaagtaatgacttctcctttctcatcttatcttgccacctgaccagctcctgggctcctcaatccaaagttggggaagagagaagggaatgtcagtggaaaccacttttgctataaactctcatccttcagatgttctttcagtgggtacagtgtttagtgctgtgctaggtgctggggaatcaagagtaaataagaggccatctttgccctcagggagtttttggtctcatgggtttggggcaatgcaggtctgtaaactggaattgtaaaagtgaagtggcccaggtcccatttgttgtagtggtgcacagagagacagtcttgagaggtgaggagacatttcccagaggaagtaacatccaagttgagacttagaagacagctggaaggatgagaaaggagaataattctgtggagtcctaattaggcaaaaggaatcaggctggtgacactgaggaaaaaagaaagagaaagcagataagctgtaagtttgcctttcttcatggtccaggaccatagccctcctgcacaaatagctcacaatcttcctgtgcccagctaccatcaggccctcagctgatggaaaaatgcaggttatcccactgcaaccttggtgttatcagtactgcacaaagctctcttcagcacgcagcaaaagcaacatcctataaaacccccagcaagcctttgtctcttggcattcagttcctctcttgctggcctgcctgttgctgccttgcaacatattttcatactttcttcaataaatctgcctttatctacaactgtcttggtaaattcttcttactgcccatggtatactggcctcagatagttgcttcacctgctacacattctttaagcagaagaaatatatgtgcagggtcccagaggcaggaggagcagacagatgagaggaatttggctaacatggggaaatggtccaattgcgcaggcttctcactctgtttcaagaagtttagacttcagccaaagaaaggcagggactactgttactgaaggcttttaaaatccaagggtggcttgatccctctgattgcagcacagtgaggaggtcataggaggtgagagatgagagggggtgaaagaaggcagtggagaaagagaaaaaagaatggattagggggatgttgagaaagtagaattgacatgattttgtgactcattgaatgtggggaatgaaatcaagtatgctgcctgaatttctggcttggacatctggtggacagtggatcattcattaagaaggaatgcataggagggaataagatgaaattggctggggacaatgttatgtttaggaacttgagaaaacccaagtggaaatttccagaagggagttgaatattctggtttagaacaggagttggcaaactatagcccatgaagcaggcttatttttataaatcaagttttattggaacatggccacacccattcttttactattttctgtggctatatttgcaccaccttagcagagttgagcagatgtgacagagacagtacaatgaccagcaagccgataaaatatttgttatcatcgctttacagaaaaagtttgccaattcctggtgtagagcctaggaaagaggtctgagctggagatgtggaatcagcagttgtcagcagataggtgggactgaagcaatgggggtggacaagcttgctcagagagaaaaaaataagccctaggataaagccctcaacaacacaaggacccagaagaagagaattctgtagagatgactgagaacagttagccagaggggaaaattgacagtgtgagtccagagaagccagcaaaagtgaaaattgtaaaaaggtgggagtggtcatgggtaccaaagacttgtgagaaatcaagtgagatgtatcctgtgtatgccagaaggtaagagcaaatgaggccaacataaccttaataataccaatctcaatggcccagactccagcaaagtctactctagctaccgctaccactaaacatatgtaaaactcagtaaaatagcaattttaattaaacaaattcctgacctatctctgtaatactcctttcccaacatttttgcctgcatattctttgattgcctcttcaataatgttgtaatatcatagtctatgagagaagagaataataaactattttggctctagtattttattattgatagatttaaatttttcttctggcttcatagctcaggatcgataatggaagataagttttcaggattcttggcacacttaggaaaatctttatcaaactatttttatgtatgaactgtaagatttggaataattcccagatgggatgagctacactcttttctagctttgtacatttctatttttcttattcaacttttattttaagttcagggataaaagtgcagggttgttacataggtaaacatgtgtcatgggggtttgttgtgcagattatttcatcacccaggtattaagcctagtactcattagttatttttcctgatgctgtctctcttcccatcctccaaccctgatgggccccagtgtgtgttgttcccctcgatgtgtccatgtgttctcatcatttagctcccacttataagtgagaacatgcgatatttggttttctgttcttgtgttagtttgctgagaataatggcctccagctccatccatgttcctgcaaatgcacatgtcatgtgacacaatcgtgatgtaatctatggtcttgcatatttacattacaccaccaggtaaatcagcacgagggaggtgaagactattctgaatctgttttacacagggacagctagcaataaaatacacagaaatgactccataccacataaataaatcccatggaacccaaactcaatgactcaattcttcttttgctggatcctcaaaatgcccacatccactccaccaccacccaacatgagggcagaaagagatcagaattttagccaattacagctaaaatgtctgcttttgtcaaaagcaaatgaccaaatggatacattgccagggcccctccagagcctcagaaagggcctgctgaagttgccttttgctatgggatgaatcaaaccaaaacacagtggcttaaaataagatgaattattttatttctgaattctgaaggtctgctgggcttggccaggtgattctcattcttgtggtctcttatgaggtcagtggtggctagggctgaaaccatctcaaagccttcctcactcacatctcatgggtgatcccagctgttgctggaacctcatctgggactatcggccaaaacactcagaacttctccatgtgtctgggcttcctagaagacactgttcaagtagagggcaagacaatcaagaatctcaagctctatttcaaaacatttcttcccactccactactgctctatatatttttcacaatactttataccttctaacgtaatagttattatagaggtacacgtatgtcttactataacataaactccatgagggaagatatttttagttttgctcaatgaaatatccccagtgccaaggaagcactgccctacacattcatccaaatagtaaaataataaatatctatttttaaacactttgttaattctgcacacatttactttttctaaagggagaaatgtggaacactgaaaagctccttgaatcttagaatttgtttttaattaatagacttaatacatggcataacatgttgtactcaacttactcttcatgcaacgtgtaagcataaatgccaaagatcttactttcaagcatcagcattaatatagcaagttaggaaggtagacggtttggtaattacaaaagctcttgaagtaggcaaaaaccattgttttacatggtagccaagatcacactaatgataagtatttctggcttaaccagtcctcacagcaatatgctaaattaatgaaaacaaacatgggcattgtttgggtgttactgacatcaactacaaaacagaaatgaacagaaattgaaaactatattgtcaaatacaattaaaatagccaaatacatttctaggtaaaatctttataacttcaaatactgccagttttctttcaaaaacttacagtacttgaaagaacgaaaatcagcttaatccagcacaggggaaagaaacacatgagataactgaattttacaaccaaggtcagagaggatatcacactatcaccgtgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaatttttataaaattcctctgataagtatgcttaaaattaacatatttaccaatgtcaggatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccgtgctggaaaagacaataacagacgagtgaaaagaaattttatggaggaagatccataacacatacccataacaaatataaaaatgaactaacttcaaagcaggttatttcgggttttgttttttttatttccaacttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaacctgaactgtaaatatctgaatactttcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcaaagagggattaagcccaaggttatacagctattatagtaagttgcagggctatatataaaacacggccatctggttcaacaatccatgaagctgattaagcaatagacaataatgtagttaaatgacttgactcactagttaggaccagaattcaagttgcaattccctgtgtgattcctttcttttttttttgagacggagtctcgccttcttgcccaggctggagtgcagtggcacgatctcgactctctgcaagctccgcctcctgggttcacaccattctcctgcctcagcctcccgagtagctggaactacaagcgcccaccaccatgcctggctaattttttttgtatttttagtagagacggggtttcaccgtgttagacaggatggtctggatctcctgacctcgtgatccgcccatctcggcctcccaaagtgctgggattacaggcatgagccaccacacccagctgattattttccattataccaccagcctctttagctcacgtgccaatgtgaattcaaggccctaatagatggtcaaccacgaggtggattttcagaacacacatgagaaaaaattccttccactacaacttttttttttaagatggagtctcactcttgttgcccaggctggagtgcaatggtgtgatcttgattcatcacaacctctgcctcctgggttcaagcgattgtcctgcctcagcctcccgagtagctgggattacaggcatgcgccaccacacctggctaattctgtatttttagtagagatggggtttctccatgttggtcaggttggtctcgaacccctgatctcaggtgatccgatcaccttgccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcctgatcatatacattttcactattctctgttttcagtcatagtgggctgtcacttattcattctatgtcttgaacactttaaaaaaaaaactttattccctttagtttgttcatgaacactgtaagctggaggaaaagaaatcttaaagtctcactcttgaccacagtttctctcaatttgcaaatctggtaccttgaaaaatatccaaaaagacaagagagctgggcagaagattaagtcgtagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactttctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatgatgtccacaactgtaggtttacctaccaaaaaaaaagggcccaaaatagttctttttaaattgccaatttaagtctttataagcaatgatattcaaatactgtgaaactttgagtcttatcaaaaaaattaccaagtagtagaaaaaaattttaaaggaaaaaaggtaagagtattcaaaaaaaagttttattattttttttaaaacatctcggccaggtgtgctggctcatgcctgtaatcccagcactttgggaggctgaggcaggtggatcacttgaggtcaggagttggagaccagatggccaacatggtgaaaccctgtctctactaaaaatacaaaaattagccagggtggcaggtgcctgtaatcccagctactcgggaggctgaggcaggagaatcgcttgaacctgggaggcggaggttgcagtgagccaaaatcaggtcactgcactccagcctgggcgacagagtgagacaccatctcagcaacaacaacaacaaaatatcttacattttgttttcattactttcaaatccacacatcacatgtggtgaaacatgttcgaatgatgataatgaataaggaggtcacttacttacgttgttaagctgttaaatactatgtttagacatttatttcgagtgtatataataatgagccctactatggtagaatttctgtgtactgatcctagaagtctgactggatacaaaattcacacttttaaaagcaccctataactctaacactaccttgttgaaaacgacaaaatgtactatgtattaaaacccttccctctgaaaaaatgttcacattcctgaaattttatccctataggaaaaaaatgcaatttaaaaaaaaagaaaaaaggctgggcgtggtggcccttgcctgtaatcccagcactttgggaggccaaggcaggtggatcacttgaggtcaacgagttcgagaccagcctgtctgacatggagaaatcccatctctactaaaactacaaaaattagccaggcatgctgacagacacctgtaatcccagctacttggtaggctgaggcaggagaattgcttgaacctgggaggcagaggctgcagtgaaccgagatcgcgccactccgctccagcctgggtgacagagcgagactctgtctctaaataaataaataaataataaaaattaaagaaaaaatcacacacaaaggtaatcagtgtaatgtttatacataacaacaaaggattattagaaacaatctaaaaggttctaaaagttaaaaaaaggcattttacagaccatcaactcaatgaatattatacaaaatgtgttttaaaacccatttataacaatgatctataaaaacaatttttaggctgggcacggtggctcacgcctgcaatcccagcactttgggaggctgagacaggcggatcacaaggtcaggagatccagactatcctggctaacaccatgaaaccctgtctctactaaaaatacacaataattagccaggcgtagtggcgggcgcctgtagtcccagctactcggaaggctgaggcaggagaatggcgtgaacccgggaggcggagcttgcaatgagccaagattgcaccactatactccaggctgggcaacagagcaagactctctcaaaaaaaaaaaaaattttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaatgatactaaagaataatacatctttaacaatatattcacaaatccatatagaaaagatcttgaataggacatataagtatgtaactaaattgttgagcatattaataatgccaatagcatttccatttggcagaaaaagatgacaacacattaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactgctagacactgctggtaaagccggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcacaaaagctaccattgtctttccttaatttttataattttactatttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgcgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaatgaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatccgcacaaaaacatgtatacaaatgttcatagcagtattattcgtaatagctaaaaagtacaaataacccaaatgttcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttgtatgactccgttcatatgaaaggtccagaaaaggcaaacccatagacacggaaagtagattagtggttggcaggaagtgaagtgaaggtgggggggtgaggtagaggaatggggagtcaccactagtgggtacaaggttcctttatggggtgaaaagatgttctaaaattaacagtggtgatggatgcacaactctgtgaatgtactaaaaaccactgtaccacacactttaaacagtgaattgtatggtatgtgaattttatatatttatataaataaagattccttaaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaaaaaaacgaagaacagtggtaccacctagggctggagaagtgaacaggatcacaccagctcctagaatgtatattaagagcaatggtcgatccccctttgccctctggtgttgggaattttggccttgttctaaaccagtttcccttcacagaagttcagccatcgtgtgggatcagaataaggtcctggggcaactaaaggtatctggccaagggtacatccgaaggaccctacaccggcccccagtccccaacagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggacccccccggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggtaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtagcaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgacctggataggtatattgaagcctttcagaaccttaatcaaatgtctgagctttcatggaagggtatcatgttacttctcaactagactcttagagcttcagagaagcaggcggctttacaggtcactgagacatttggagatgaaatgtttatcttattatggcacctaccaaaagggggaagaaattagggagccctttctgacagccaagcaggcagcatccaccaataatcctcaatgggactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacacatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcgatcccagggagcttctcattctatgaccgactgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgaggggcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccaggacagactctttgcctccctctggtggagactgatattaatccaggtgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgtgacagtccttgtaatatcctaatattggaagtacagaaagaaacccaacagggaatggagactggtccaggatctccacctccttaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcccccacctgtttgggcaggcaatctcaaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctactttacatatacctgcccttccccagttggtcctctacactatcgtgcctatttctaaatggtgctttttcaagcatacccacagaccaatcagcatgcacttcccccatttcaagcccataaaaacctctagactcagcctcgtggctggcaacccaccttcgggtcccctctcgctgttgagagctttcttgtcactcattaaattctactctgccttactcagggaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaagtgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagggaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcatggataaaataattaacataaatattttaattactgcataaagttatccatttcactgcagctttaaaaataccatttttaaagagttctaagatgttatgtaaaataaattttaagtagatgcaaagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttagtatatgaaatctttcatataaacagttggaaagactactaaaatgaacatctatataccatgccttccatcaagaatcaataattgttaaaattttgccataggtgctttacctctgagacaatttaaatattaaaagccactctgctcactatgtccctcagtgagattagggctcagaataagcatggtatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactactacaacatacattatacatacattttgtataggtttcacaaaaccatatatactataatagagtttcagtgataatttcaactatgtaattgtcacctttagaacacattcaaatcagcattagggggacatgcactataaaattcattgtaatcaagattataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagtgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttgaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatgtgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaaccaagccgactctctctaggcattcaaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatacaccctccttaactggacacacataactgcttttctagctaactggaaagaaaaattttgctgtcttaaagattctctgggaacacaaccgcaacattaatttgggatcaggaaaattcaaagccaagagtctgttgcaacccatagaatttttttagaggaaatcttacacataattcacttcaactttgcacaagtaacaaaattataatgagaacaatattatatcccctgaatataagatgccactcataagatgtatcattatttcatgagaaactaagaaagaaaaagcactgccaattaaactatgacgcctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagaaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaaatactcatataagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaagtgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacattgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcatgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaaacccggtctctactaaaaatacaaaaattagctagccagacacagtggcgcacgcctgtagtcccagctactggggaggctgaggctggagaatcacttgaacgcgggaggcaaaggttgcagtgagccgagatcgtgccactgtactccagcctgggtgacagagtgagattctgtctcaaacaaacaaacaaacaaaacaaacaaacaaacaaaagtactacattgcctacttggaaatatttggaaatgacggggagagtttaaatttaggacaacagtcaaggggctggatacaaacagagaaatattctgaataaactataaaaaaaaatctaactcatcctgatcattttaaaaaagaaattattgcaagtagaatatgaatactagtcactgctaataatgctaatttaaatattgtctgttcattaatagaaggagaaggaaaaaagcctgaaaggatatacaccaagggttgggggaagtcacacaatgaaatactttcttactttactacttttaatagacaggatcatggttggatttcattattaagtttttttttttttttgagacagggtcttactctgtcactcaggctggagtacagtggtgtgatcatggctccctgcaacctccacctcttggactcaagcgatctttcaaccttagcctcccgagtagctgggactacatatgtgcactggccacccagctaattttttttattttttgtagagacagagtcttgccctgttggccaggctggtcttgaactcatgacctcaaggagatccacccacctcagcctcccaaatagctaggactacaggcacataccaccacacctggctaaattttttaaaaaattgtttaagtagagatgaggtctcactatgttgcctaggctggtctcaaactcctgggctcaagcagtcctccgccttggccaccccaaagtgctgagattacaggcatgcgccaccacacccagccagttttcactattttttaaaaaatgtgtttccaataaaaatttcttagaaggaaaagtactgaactgcagcgaaacaagtaagagggtaaattccttgattgtcatcatgttctaagcccagcatgtgctttaatatggggcttcccagtccaaataattaaatctaactgcaacacagatgtgaattgcatggaatcatatcatattctctcaaaaacagtattatactcttttaacaaaagaataactccaagttgaaatgttaaagttttgcaacatttaatgtgaaaccaacaaggtcagcctgaaaaaaaagtagatacgaccaaataatcacttttagttcctaaaaattcatttttagttcctacaaaatatctaatttaaaaaaaaaactgtattctaatgggtgagttagctataaaacatagtctcaaacagtgacaaaataaatttagatgggattaattataaaatgtagcctcaaataactgaacaaactgtatttagacataattacttaaaatcacgttcaaatacagattaatgttttaatgctaatggtgctgaactgctctctctcacaggaaaatcattttataagcaaaaagatttgttttctgtttaaaacaggatgtaaatactaattcaacgaagagctgtgatagaggcgcagattaaaggagagagatgctgggatgaccctgctggagatcagatgcccatggaaactgactccggcatgggtacacattaggcaactctgaggttaggaataagttttgatataggctctgaagaagtagtaataagacctaaggtgactcgtagttacaatgtactgattattatgtattgattcaaaagctactaagaggcaaggccaaattcccactgtcttctcagggacatgaacataaaagagtcaccaggagtggaattattattcctgaatcctccttgatgagattctactgttcattttttaaagttacctagaattctagaataagttttaaaagtttcattttcaagttttgaggatgatttaaaaagataattggagagtaatgaaataatttaactttctacttgcaggattcctagaactcatttaaaaaaaaaaacagacttgatgactgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatacttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgttcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagtgatcaggaaaatgcaaattaaagctactgagaaatataaatgtcaaagccaatcaatactaaatgttggcaactatgtagagcaataataattctttttattcttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttaagtagagacagggtttcaccgtattagccaggatggtctccatctcctgaccttgtgatccacaagagcagaagaagattctgatcatcatgacaggacaaaaaacataaactaggaaacagggacatacatggcatatatggtcaccctaccagctgcagaaagcataattggtgaattatttgcccaactgctccagatcctggtcagtagcccacacactagaattatagttgctgagcccatccccccttattccaagaatctctgattggctgccttggaagctttagctcttctcactgtcataccacctttggttctactgtccaaatgctgaccttctgttataactgcaggcagcctggtggtcaagcagatgtccccaagaacttcctggggttctctctgaactttgagccatttagaatcaccaggatgccttggtcactgtcaacatcaaaatgtgaatcttcttagacaccaccggtagttaccgtacctctagaggaactgagggttcttcacccacaaatgaagaccatctctaaagtgccccatcacattctagaaggatacagctgctggaagaaaataaagtgtcccaccaccactcccacagttcttaagctcatacacaccaacaaccactccaggaaccaactgaagacttcaaatatcatagtaccagagagggttgatgccaaacccacttctaaaactgtgttcactctcttggagttaccaaacaggcttcacaacctcaaagccatttcacaatctccccaaagtctcaatctccccacagtctccccagtcacaatctccccaaagtctgccttcccagactttgctggtgactgccatcactgacataacaacgtggctggaaccctgctgctgccaaaaccaccctccgactctctggccaagtcaaacccctcacaccactatgggagtagtgagaactctctgaaaggccactaacacttctgtaagccacaactaccaaaacaagtcctctgagcccatgccactcacagtcttgtcataccacacctaccagtgaacagtattgccttataagcatatagttctgactcaagcagcgtcaagcctagccttttcacaggataatttctaacagttgggtctacccatgagttacacgaaccactctccagattcaatgagcttctattacctctgttacaactatcactcttgtgagtacagactaagttaactcataagactgtttagaagatgcctttgctacaaagggcactcctcgaaagttcttcctaccctcccagacatttacgatgtgtgaagagaaatgccccaaccagtcacaatctccccaatgtttgaagtagtcagaggtatcacacagtaaccttgaactacttctcttaggtgccaataggactatgaactccatgaataaaatcagctggtactaaaaatggtaactgcttataagtcaaccaccaggtcaaagatggcttactcaaaaaatgtcacaagaaaaaaaacatcaaatcaaagtgaccagcctcactgcctagcaaccaacccactcactcattcacacagaaggcaaaattgaaaggtagctgggacgcccataggaagaaaacagttaggatgatgcaggggagactgatacaaggctgttattctaatcatcccataacagagacagagtcacagctagggaattattcaggaattaggaaaagttatttctggtaaacaaactcccacatactgggttaaaatttctttggaactttatttatcatgaccctaggagctctagtcatatatgcaaatggataaacaacaaagctataaaagcagagggttttaattttgcttttattttttaaataatagcaacaaggaactttagtaagaataacatagtaaaactagacctgtaaaagtcatcaaaagcaaacatgacaggaatagcataaagtaatttgtgaaagctagtattatcaaagcactgacagaagaaaaagaatgatgctaaaaaatacaaaacacttctttcaataccataccttatcaatggcttttccaacccgagaaacactgctgtggatgtctttgtggtcggaggccaatttttgaacagtatcctttattcttttacagcactgtgtcaaaacaagtcaaagtgtccctgataattcagcatcttggcctataaaaaaacaaaggaaggattggttactcacttaagcaaacccaaagatggcaagtttctaatgggccttttggaccatgaaagatggaagaaaagtgaagaaaaaccagtatctgctttgaagctgatggtcacattcatagatgtgatttttcaaatggatactcagaaagatataatttttttattttttggaaataagaaaattttactgtgaaaggaatcatttttatcattacaacaaccagcacaggctgtgaataatactgtcaaggcagtattatttttgagaaaatatgtctaagtgaataaactcacttattaaacccagttacactgttcaagtcattctcaaaacgttctggttgttactaaatttcctcaagagagatgatttagtgcaaatgcttcatattccatataaagaggtagaagaaaacaaacttccctgggtaccacgatgtgcagaaaggagttaacacagcaggtcatagactactacccttagaaagtcctgcttacaaagtcacctcttggctggcatatagaaacctgggagtttgggagtgttcccatcactccctaactcagtgttccccaacctttttggcactagggaccagtttcgtggaagacatttcttccacggacgagggctggggggaatggtttcaggatgaaactgttccacctcagatcaggcgttagttagattctcctaaggagcacgtgagccagatccctcgaatgtgcagttcacaacagggttcatgcccctatgagaatctaatgctgccgctgatctgacagtgggtggagctcaggcggcaatgctcgttcaccgctgcttgcctcctgctgtgcacggcctggttcctaacaggccacagaggggtactggtccatacccgggggtttggagacccctgccctagctgaaaagaatggctcattgtgcctaaactgttgtacagtgtgatttatggtgaacatctgctttccttctgggaatctagaatgttgatacatgctaggcagtgagtacctggctttctcctggcttggagaaagcttccaatagtcctctcccagtgaagtcacatggaatatgcttaattcctgcagccatggtttgtgagaagtgttaagtgttgcctaccagggaagctcattagaagctcagtgcccagggtttttattgggggctggtcaccagggcacccactgcctaactctggactgcctaactttggactttggacttctgccccatgagtcttttccctttggtgattttgctttacacccttttgctgtaataaattctagctaagagtatgattatatgctgaattgtgtgactccttttaatgaatcactggaacctaaaggtggttttgaagacccctgacacacatgagatcaaccaaaagttactacagtttacatcctttccctgagctacctccctccaaattttgttcctatagcaggaaaaaaaggaggagaagggagaaaaacagacagataaaacaaacccagttatggtatttgtcatttctctctctatctacgtattcccacctgtaagcaacaggcctggtttctgaaatcctaaccaacattatatagaagagcttcttgaattttaatttacatcagaatcacttaaagttaaaacaaagtagctggaccccatccccagagtttctcattcaataggtccgggatggaacctgagaatttaaacaaggagcccaagagtaaaacagccctaggatgcctgctcatttaaccaatatttattgagcactcactatatatgacaggtacagcagtgaaacaaaataaccaaaaatcccttcccaacaacttaacttctggcaagagacgtaacacacaaaataagcaaattatatactacgacaaaagatgatacatgctacctgggaaagaaaagcagggtaagagagatggggagtgtgtgtgggtggagcagccgcaacttcaaaacagtgctggcatggtaggcttcactgagtagatgacactggaggcaagacttgaaaaaagtgaaggaattaccatgtggctggctactttggggtaagcatgccaggctgcggggagaaaagccctactgcaaaaatacacctagactattcaaacaacaaagaggtcagcatgtcaaaagtggatttctggccaaggaaaatagaagaagaggtccaagagataatggtcctggtttggtaggatctctttggcattgtaaagacttatgcttttactttgactgaaagggaccactgcaaggttttgagcagagaaggcatgtaaactaattaaaaaaaaaacccacaaaaaacatttttttttttgagacagggtctcgctctgttgcccacactggagtgcagtggcacaatctgggctcactgcaacctctgcttcccgtgcttaagcaatcctcctacctcagcctcccaagtagcttggatgacaggcgcccaccaccacaccggataatttttgtattttttgcagagacagggcttcattatgttgcccaggctggtctcaaacttctgtgctgaagcaatcctcctgcctcggcctcccaaagtactcggattacaggcgtgagccaccatgcctggccgataaaacatttcaatatggtcagtctaactggcaacgggagtaccagaactgagcaggaaaataagaggctgtggcagcaatccagatgagaaatgacactggctcagtccaggatttcatgactggacatgagtgaagaaaaggactcacagatgtctccaagatttctagcctgggtcaactagaaagatggagttgtcttcagttaaaacaaaaacaatctcagcacttcaggaggccaaggcaggaggatcacttgagcacaggagtttgaaaccaaccttgggcaacagagtcagaccctgtctctacaaaacatacaaaaattagctgggcatggtggcacacgactgtggtcccagctacttgggaagctgaggtgcgaggatcacttcagcctgggacgtctcggctgcagggagctacagcactgcactccagcctgagtgacagagcgagacctcaactccccatcctgccaaaaaagaataaaggctaagcaggtatgaggggagaggagagagagaaagttcagtttggggcttgttaagtttgagacattgagtaggcaccgcagtgcataagtggaggagttggtgagatatacaaacctggagttcaacagcagtgttagtgctggagatacaaatttgtgagtcactgacattatatatatatatatatatatatatgatacttaatgcatgggactatatgaaatcaccaggggagtcagtacagacacagagaagtgataaaagaactgagtcttgagaactccaagtttatgaggctgggaagaaatagaactggaaaaggaggctaacaaagactactgaagcactaactgtgatggaggaggaaactcaagaaaagtataatgttggggaaaccaagagaagaaaatgtgtcaaggaaggaggagtaaccagctgtgttgatgtgctactaggtcaagtaagatggggactgagaattggccactggatttacaatgtggaagtaatcagtgacgatgacaagaatagtgtctctaaaattctatgaaaagaaatcctaaaaggttacagggaactgtgaagagggactatattaagtctggttcaatgacaactactgagataaatgaaaagataagaaaaaagctttccttatctctaaatacagttgcacaaagtttctatcaagtgtttccaacttccaataacacaattaggcttccaacttctaataacataatttaggctaaggcaagacttggtacttcaagaaaatttcaaaatctgtttaaaaggtgttccacagatttcttggaccaaaagcatctaattgcttcagcagctctgttctggccatttctgatctttctgtacctaaagcacacctaacctcaacagcctcatcttctctatgaacccatctgaccacagacttactccctcttctgaattcctggtaacttctgatctctcccctactcccccagcacttaattataacccattttaacaatttcatgtatatataccgtcatcagtctctactaaacataagcccccaagggaagaccaagtccttattataaattgtatactccagttttatattaatagtgcctgcaaatgtgcaagacatataagtatctgaattgatggtaaataaagtgaggaaaaaatagtttttgtttttgcttttgttagagccatattcaacaaatggtgctgagacaacaagatatccacatgcaaaagaatcacataatatataaaaactaattcaaatgagccaaatgcagtggctcaagcctgtaatacaagcactttgggagcccgaggtgggtggattgcttgagcccaggagtttgagactaacttgggcaacatggcagaactccatccctacaaagaatacaaaaattagcagggtgtggtggtgcacgcccacagtccaagcttctagggaggctgaggtgggaggactgcttgagcccagaaggtagaggctgcagtgaaccgtaagcatgtcactacactccagcctgggcaacagagtgagaccctgtctcaaaaaaataaaatcaaaaataaaaattaactcaaatggaataaagacctaaatgtaagagctgaaactatcaaattcttaaaagaaaacagatgcatttctgaccttgaattaggcaatggtttttcagctatgacaccacaagcacaagcaaccaaagaaaaaataattaaaatggacttcatcaaaattaaaaacttgtgttgcaaacactatcaataaagtgaaaagacaattcatagaaggggagcaaatatttgcaaatcacattctgataagggtttagtatccagaataatataaagaactcttaaagctcaacaataacaagacaaacaatgcaatttaaaaatgggcaaagcacaaggcacagttcacgcctgtaatcccagcactctgggaggccaaggcaggtgaaccacttgagcccaggagtttgagactagcctggacaacaaggcgagactctgtctctacaaaaaaaatacaaaaatgtggctgggcacagtggctcatgccagtagtcatagcaactagggaggccgaggcaagtggatcccttgagcccaggaggctgaggctgcagtgagctatgattgcgccactgcattccagcctggatgaaaaacaagaccctaactcaaaaaaaaaaggtcaaggatttgaatagacatttttcaaaagaagatatacaaatagccaacaggcacacaaaaagatgctcaatattattggtcattatgagatgaaaatcaaaactacaatgagatactacttcatgcccacaagattggctatcaggaaaacacaataataactgttggaaaggatgtggagaaattcaaagccttatccattgctagtggaatataaaatggtgcagacaccatagaaaacaatttggcagttcctcagaacgttaaacagttactatatgacccagaaattccactcctagttatatcctagttatatacccaaaagaacaacatgtccacacaaaaacctgaatcagaatgttcacagtagcattattcataagacaaaaactggtaagaaaccaaacctccaaagaatgaatggataaacaacggattatccagtcattaaaggaaatgaggtactgatacatactatgacatagatgaaccttgaaaatattacattaagtattcaataagccagacacaaaaggccacatattgtgtcatttcatttgcatggaaggtacagaatagacaaatctatagagacagacatagattaatggtatttggagtgggaggagacagggtgggaatggagagtgactgttaatgagtactggatttctttcagaaataaagaaaatgtttttaaaaagaagtcatacctcctatccatccagacacatttatttctacaaccagcagacaacaaggtaggaaaaacacaaaaaataaaaagggtgccaggtacgatggctcacgcctgtaattccagcactaaggaaggccgaggcaggcggatcacttgaggtcaggagtctgagaccagcctggccaatatggtgaaatcccatctctcctaaaaatacaaaaattagctgggcgtggtggtgagcacctgcaatcccagctactaaggaggctgaggcaagagaatagcttgaaccctggaggcagaggctgcagtaagccgagattgcgccactgcactgcagcctcggtgacagagcgagactcggtctcgaaaacaataataataaaaataaaaaaggatgaagccaagctggaggaaagaggtcacctagaatttaccactgaacttccacgcaccaaccttgaaatccaatgatattttcaaatcgtagtaacttacatatctggagtttggtgctatttgttacctccttttcttcctttaccatctacaaattcctctaatttttggttttcaattttatgaatgacagatacaagcagtttatggccaattaattaatactgagagttctcagaatgctccaaggaaaaataatttctgtaaggtatttggaaactcaagaaaagcagaatggaataatctgaaagagaaccctgggaaagccctgttaagagagaaagagttcactaatgcattttcaaatggactcagtggaaagcagccaaaggtttaaaacaggtttgaaaattgctataatgaccagactgacagtcaaccaaacttctataagtcctactgggagagttctaacgttcttttgatttctctgtatgaaaacacaacctgcttctaggagaacctttatgtgaaagaaactggattcagttcctagaagaaaagctggggaattactgtgacagccatctccaccataactacatccaggttggccactgcggtggtcacttgtcacccagaagaaagtcctgcactaactgtgtcttccaatgtagtaaacccagggaacccaggcccaatgcatgagcctgaaagaaacaactctgacgcaatgctcactcatcactggagggtcacaagtactttttaaagtcagttttatgattaaacaagtgtaagaattagcatgttcaatataagcaaagaacgaacatatgtagaccatctacgtgtgttgctttattaagttaaaattttcaataaaatagaacagcaccttttatcatataaacagattttaagcacgacactcaaaattttcaagttctgcccttgagcctcactgctttgccattttaggatgtatgcccactagtttcacagaaacaataaataagaaaaatgtttgtttccatagcatcctatacttccctatcagagtttcacactttgttgtaaatagttatttgtccattactcccacaaaattaactttagtaggaaatatgaccaatccccaacgtttagtatagtaactggcaaatactacacgttcagtaactagttaccaaaagaataaatatgaaaataattaattatgtattacataatctcaatttcaaacccagcattgaagactgtctggtactaccaacaccctctgaaattgccagcagtttcactcagcagttcactgacccctcactctctcacagaatgtttagcatctgctacacagtaacactgcagcctaagttctgcaaataccaagtaagttaggaaataatactgttcctgtctgtcaataacattattgcctaagtagaaaatcccaaagaatctacacacaaacacaatccaagaatagatgagagttcaacaaggtcacagtacccaagatcaacacaaacatacaaacacacatatgcacacatattttcaaataagacacattcacaaaagagtcccctggcatcagttataagttccttctctcttccaaataatgacctctcccaccaaccccaggaattaatgggcttgtgctctgactcaagtcacttttgagacagtttcttttttacaaaactatttccacatttgtcaaagatgcaatgaaacatctctaatatataatgtgaccctataaaagtatattctaagtcagatataggaaggtataacaaacgtacacattaaaagggtgactggtttgcacaaagctaaaaactataaaatccctactaataccttggttacaccttcaatacacttttagcattttgtacatacatttgttttactttcttccctactgatcacaagcctcaaaaaaaagcacgtctcgtgtccagctccgtgacaagatttacccactattttggctcaccttaatacaatctagacaaatatatcattaatattgacaagtacgtttctcatccctactcagtatctgcacttttaattttctgtctgccacttatttttatgatatggggggagggggttcaactctgcacaaacacactgttaaagatagcattgctaaaactaaacagctggttggtaggcagcacaccatgttgcagcctgaaatgtctgccatcaggagataataaaaagttctaatttggtctataaaaggcagtttaaaggtgtcaattacaccatgaaatacatgctgcccacgagtcaaacacatgagagatgagacccaccatacttgagagcactctataaaaaaatagggaggcacaatataaaaaagtattgttatggtgatgattttcaagaaggttgaaagtatcaccacctaagactggaatatttccacagaaataagattccgcagaaatcactaagacctggcttgacattttaatgaatatcctataggcagtaaaaatttaaaatatccaagtttataaatattacatgtatcgcatttgagctcttctgagttatgaaaagttaactccactttcataagatggacagagatcttaaatttagaattaagtggaaagcaaaatggaacacaagttttgatgcagataaatacaaagaaatccatttaggaaacaaacctaactgtacctaaatgaaaactcagacctcatagagatatactccagaattcattctagattagctatttaaataaaaacactaaaatcagaaagctaaaagagtattaggcatcactaagaaggctggtggggggggaaatctatgatataccactcttataaaagccttgatgccttaaaatacaaaatgaaaccaagaaaaaacagaaaaaaatgtaaaagggagaactatgacatttagagtcaattaacatttattgagtgctgaaggcctgtgtcagcaatgttcaagatacttttcccatgttaccaatttctacacagatttaagaaatttagaatgggaataaagtagataaaggataaaaagatctaagactgactctagaaaagtcactgacaaggtgaccatggatatccttgcgaagtactagaatagaaaaacttgaaacttgaaaaggtaaggttggaattttttaaaaataagggactatttcattttgtctgtagtaaaataaactgcggcccattgaaatttgggattcttgtgagctacttcagcacctaggacacagcggctgcttagaggaaagagaaaaggcacaaatagaacacattcatttttttctggaggaggtaaacactgaaaacaaaatttttccagtatattagtagctggtaaatctgcaaagtaaaagaaagtatggtatttggtgttcaactcctgacctttcagagaacagtagactgacagacacgtgttctgatccagagagattattaaagactgtgcatcaaattagaggcacagtgtgctgcaaaccaaacatgaggggaaaaaaacgaaataaagttaatatttagagtgaaattacatggtacagactaatagtgctcctggagcaaagaacagtatcaatgactatcatagagaagacaggaaaggcttcaaagtatatgaggcaagaattgcagagagaagaaaaaagatacaggcacaagattttaaacatatgtctgtgacagtcacattttagagaacctattcactcccttcaaattccaaatataaagacttaatctctaggcatctcatttatctctgaaatgaatggtggaaccacattaggtttcctgtagcattggaatctggatttcatatttaaaaatcaaactcaggccaggtgcagtggctcacgcctataatcccagcactctgggaggccgaggtgggtggatcatttgagttcaggagttcaagaccagcctggccaacatggtgaaaccccatctctactaaaactacaaaaattagccaggcggtagtggcgcatgcctgtaatcccagctattcaggaggctgaggcagaagaaacacttgaacccaggaggcagagattgtggtaagccgagacactgcaatccagtctgggcaacagaatgagaccccccctcccccaccccccaaaaaaacaaaaacaaaaacaaaaaaaaatcaaactcagatttccaccttcccctctcctaaacttcctattttctacctggttccataatgatctacccatcattcatgtttaaaaccttggattaacctttggtttttcctgcccttttctcctactctgccagactccatctgtgcaccaactcctggtcattccttccctcagaaatccctttcatgtgtccctttaaatttctaccaccagtacccaaagacaggtccctatttcatcaaatctaggttgacacttagccttagctaaccttcttgcctctagtcaaacctcactcccaactccaaaccaacctaaatactgctgacaactggtctctgatcgtgtccctgtcccctccctattcaaaatgtccccaccccaccccaaagtaattcaatatcttcccagtctactactttccctggtatccatggctttacaaaacctgattccaatttaattttaatgctcttatcgcctttcccctgcaatctggtccttcacctctcactcctctacacctttgttcttgccatcctcccctccaggcactccatatagctctttctgctatccatattcaatttctgctactaaaacttcccataggtaaaaagagtctctccttgtctcaaatcctacccctttttgtccacaccactcatgtagcatctagcctagatacataaccgtgcattacagggcactgcttttgtttgtgtgtttgttaaaaaatgccagtctcatctccctaactggacacaaagttcttagaggatgaaaatgcttgttctttgtaactcctagaagattttgcttagttctacctataaatggtgattaataactactgatgaggtgatctaaagttcagttgaaataatgcccatctactcccatgcagttctttctaagggctctctctcttcactggtgtctgtactaaccagaagcactgttacacactgtgtgccatggtcttgttttttccccctttcaaatatgagtctggtctctccaactaacttctaagttccttaaagactcttataccttttaagcattctttacaatgttaagcagaccactggacacagagtggtatttaacataaaccagtaataaagacacctaaatattacccaaaatgtctcaattaaacagtgcttgggcccggcgtggtggctcacgcctataatcccagcactttgggaggccaaggcaggcagattacgaggtcaagagatcgagaccatcctggccaacatggtaaaatctcgtctctactacaaaaaaaaaaaaaaaaaaagtcaggcctggtggcatgcgcctgtaatcgcagctactcggggggctgaggcaggggaatcgcttgaacttgggaggcagaggttgcagtgagccaagatcatgccactgcactccagcctgggtgacagagcgagactcagcctcaaaaaaaaaaaagcttaacaccacttaaggcacagactttataaataacacgtctaccctgttttacaaatttcaaagccagttcacgtctattatttatttcactctcataactctgtgatgtcagtttactgaaggaaaaactggctaagcaagattgtaggatcaggccgggcgtggtggctcatgcctgtaatcccagcactttgggaggctgagacgggtggattacttgagcccaggagttcaagatccccctagccaacatagtgaaactccgtcactactaaaaatacaaaaattagccatgcattgtgcacacctgtaatcccagttacttgggagcacaagaatcgcttgaaccctggaggcagaggttgcagtgagctgagatcacacaccactgcactccagcctaggtgacagagtgagactctgtctccaaaaaaaaaaaagattgtagaaccagtaaattggcagtgcaaggattcaaacccagacctcctgggcccagggtcaaaattttaggtactattccacaaatacagattcaacttctcaattagcctccaagttcctggaggaccagggccatgaataatttcttttaaaagattctctcctcaactcctcccaaatgtcttcatgtatcaataagatgaattaaacctatatgaattctgcagatacaacaaactcatcataaataacacacagcctgacactacattgtgcccccataacagacgaaatcaccatccaggcctccatcttaagtggagaaagacttggtaatataagcctatggcctctccaagcgacattcccaaacaaccattttgagctcagccacacaatcaccacacccatataaggtgaaagcatactgtatttctcaaaatcctcgagtcctgccagacagtctagtctttgttctctgaagggttgagttaacatctaatctaaagagaatggccagaagtgtctgctactctcagagctttcaaggaaacgtccagttagagagcatcatctcctggaagtaccacgggtctccaagtacacatagctcagagccagggccctccataattttctccctaaactgcatttttggatcatttttaaagactttggaagccttacagatgaagaagcagggccctaaataaaaataagttagttttaatattccaagtgaacagtttgctaaaacaccattttcatcatcctaaagactaagagactaagacatgaaaacaacagaaacttctctattagctctagtatgacagtatcacagaagtgttggcaagtttctccttaccaatgttattatccagagttagaaactactttagaaataaaataactttaggaaaattactttactatgtcaagcattaaagtaatttcaaaaaagttctagaggaacatgaaccaagttgtattctctagtctatagattaagtcatactaacaactcactacttgaattatatgagcattatagttaggaggccaggcaaaagctgagaaggcgaggctagtcaggaaaacatctcagagaatgttactgatataacatgtagctgttgcactgtaatagacatatattactctgtctgggtttaagtgttcctttctagaactgtctctttacctgatgaacagtgtattataaggccatatacctcctgagggggtgagcacagctcaaggtggccagaagacctcactccctggtcccagttactgattcagggaaaggatccataacggaataataaaggtactccctggagtatctccaacaaaatggccatgttcctgtcttttgagctccattggtcatctctaccccatgtgaagaaaactaccctgaaaatgaagccaacagttgacagaagagaacaagatcagtcctgatgacatgcctggtgcccctggagccagcctagccctaacctcagcctatttatacatcaacaaattccattttaatgaaaactattatgtcacctgccagtctaaatgaatatggtgccaaataaaaaagaattaattatctccagagtacgtctggaaaaagaatggctaacaaagttaaatctacttctaaacccaactggaaacaccaatatactgactttttattcttaccacctaaaatggcctaaataacttgagaaccagtccgttcttctcttagaatgtttgaacaatgtccacccaaacttttatttatgacctactgatatactattttccagactagatgttaaaaacagatatcaaattgtattcaaaacaaagtcactattctctcaagagtgtcttgttagtatttagcaaaagtctgggtaacaaatgggcaacctggctatgaggcctactccatgcacaccaaagaataaggctaaaaaggtaaacaagctacaagtctaccaagccccgatataatacatttactttcattcaaaacaatatattcaacactggtcggctctgaaaaagcacagatcattcatatatacaaataagcatacttttcaacacatgtgtttaatatacacaacccaaattctagattggaagattatacctaacatgcgaccctcaacctctggtttctgtgtactgatgcaatatcataccacagcaatgagttaaaaacgtgacctccacaagtttctttttttgtttttcatgttttacttgcctacttaccttctcatttgttaccttcacatttttaaaaagacagcagttctccaactggtaaccaaagtttcaacagtttctttgattcaccgaagagataagggtaggagttatggtttacatgagttttactactagaagtcacaacatacacacacaccaaaggagttttaggtgctaatacagtatatgttgatcactcccacagatgaagacatctttaccaacttgcaaagtgagataacactaagccttaatcatagtaaatggaaatacatatccgatgcgttaaagaaaaaaggaaaagtgacaaatcgtcatttcactggattcttttaaaattttttctggaggtcgggcgcagtggctcacgcctgtaatccctgcagtttgggaggccgaggcgtgtggactgcttgaggtcaggtgttcaagaccagcctgacccacatgttgaaaccccgtctctactaaaaatacaaaaattagccaggcgtggtggcaggtggtgcctgtaatcccagctactcaggaggctgaggcaggagaattgcctgaagccaggaggcggaggttgcagtgagctaagatcgcaccactgcactccagcctgggtgacagagggaggctgtctcaaaaaacaacaaaaaaattttttttctggagactggcatttatgtctgtgaagtgggcaaccaggtggtccaggaacaagagtagaaagatttttcaatgggtgtcttttttatcatttgagtttataccatttgaatgtactattcactgggttatctttttcattgtttgaatggataccatttgaatgtatgacttactaaaaattaataaataaattttaaatttagaaaattccttgaaagtcactttcagaaaccacattagaactccgttagtctaaaaataatcagaaaagaatactgcatgtcctttactcttacaaaaactgcaattttcccaagtatacttttaaatgtgtcctgaaaccattaccaactgtttctgcctaattttctttcacaaagtatgagtgcagaataccagcaaaacatgataaatagttcttttctgtttttcccttccaccacagaggtgctaatgggaaacaatataaatttgccaataggaaaaaaatgctaaaaggcatatactcacaaatcaaatcactaaaagttaaccatacagtagttaaccctgttaagccagggttatccaaagcaccgctcccataccactgatgcgaatggtaattttagctagtatgtaaactaatattttaattgttatgaatttattttaacatgtagtttattatacctaatacctacataccacatgtaggactacacaaatatcactgcctaagataaatctacttaagtaaaatcgtgaatccatctgaaaaataagagtgcacatgtgtatgagtgaagttttagaagcaccagtgcactatacaaattagatcgaggcacactgggaatgaccaccagcctacattaaccacaatgaacttagaccaaacttcgtgctcacagggaaactctcactgaaaggctggcacaactaaatgacagaagctgtgatctctattcctcttaccttggacacctcactgcaggctctggatcactccccaccctcctatctaccaccctaaggtttctaattccaaaggcatgaagagaagtctagagtcagtctccagggagaggaatgtcttggcctcggcagagctcttcagtattctccctggttcttattgcctcttcatatttctattacacctatgttgtccctgaaccaccaatattccctaactgtctatggcaccaagtcgaagcctgcacttccctctcagagccttatattccattattgttctctgctgcaggcctgataccagtccaaccccatttaaaagaaaaaaaaaaagatattcctgttgtcaggctgatggatttggccagaggtggattaaatggcagagcacaaaccaattcaccaggtatgagagaccagcccatactatcctcatttccccaagtgtatctgcattaacaaacttgcattttaaaaaagattaacgagagaaattttatgtaaaagaatttcaagctacttaaaggtgatttagaccacctgagaaattttagggctcactgcaggactatctcccagccagcaatcaggcagtatttacaatctggaataagggtgctgagactagaaaagggttgtcaatgggcttactaactaaactcttatttatgtatgatcagtttccatcacaaactatcctaacagctcatttagtatatagctgtctgctcacaacttcagagatgaaaaaaaaattttaacataaaacattcatcctcagaaactgaaccaatccctttaggttggctaaaggatgcttctgcaacagtcattcaccagtatgatgcaatgatgtgttctatatagtcctcaaaaattctgttttattcataccagattcttgcaagtattaccacaagtaatctcagagaatgaggtccaaagtcctgacagaggggtcccaattagagcctctcaggttatcagaatcatttgcccagacaggtatattcagaagcccaaaaatcttccctttaaacttgaaaatagagttccaaactcagttttcagtaaaatacctttgagaagggcatatttaagtttcaatgtaatatctaccacatcacctgccgagaactttaatttagaaatcatctgttttcaaaaataccatagcccagatgccaaagcatgatgtttacctttacacaaaaaaacaccaaaagaagaaagattttatttgggaaactagacctggcacttgtggtatttattttctttcatgttttataactacctttagtcacttaatcctattattgaagaattaaaggaaatcaaagagataccaatataagactagcaatttggtagacaagagggaaaaaattaggaggctgaaaaaggaacacacaaactcaccaactcagactgtttttaacagcatagcatactgtgtggccaatacccctcaaaccataaattctgagaaaagttccctagtacccagtggagagtcaaaaacaaattcctgcctcagcaatttctcaccatcattttatccatctgagcctggccctaaattttctaaaacaaagctcacaatcacatcccccttcaacttacatcctctctcatggaagaaaggtactttctgttccatcattttcctctcaaactctgcctatgacctggtccctaaaaacgaaatgttccttccacctctccaagtctaggcccttcattctcttcctccactggttccttggcagggccgggagcacagagggaatacctcccaccgctgtactggatttcccacaccgcggttcacatcgaatttttcttcttaacccccagtaatctggcttgtcttagcaattctatgaaactgcaagcacagagggttactgactcccaatagccaaataaaagctgaccaatctctccttttctaagtcctcgcccttttcgatttctgctggctctatctagccttggctctccactcgccaaggaaaattcaagactgtggttagactctagtctttcttctgtgcaatctaagtgatcccctccactgtcctcctagaaatgacatcagaaaacaatcttagacctatgcatctccagccaccagtaaataggaaagccctcgattctatcttcattaagcccttcaaccttacttcacatgtccaaaaccaaattcaaagtcttcccaggattcctgtcccattccaccttcacttccctgtatctaccaactatatcatcatcgccacgtcagtcaaatttcccttcacaggcagccaccaaggtctgctcgtttttccatactagtattgcaactcctatgagaattaatacggtttttccatattaaaatctcatccactatgactgcaggtttgcttccttcctggagttcaaaaatgactgcagtgtccagaatgagaagctgctgtaagactcctttcccatggaccagcacccatcctcaactgaaacgcagtctgggaaagtgtgaaaaaatgaaggagaaggagagagacactcagctaacgccactgccctcatctcacctgccacaaataatctgcatcttcccccagctaccaaaccgtccttcacataaatttctgttcagcccacaagctgaaaagcctcctcagcctcttattaaagacccactaaataagtcctttacttcttgatcaaaaggaatcatcgctgtgacttctaaactgtaagaaaaccaaacctttaaaagtacctgtcctcagggcttggggcagtaaaaaaaaaaaacaatctaggtgaaacgtcttctataggaaaatttattttttttgaacgaacttaaccaggcaaagcaagtaactagcaacatgtgcaccatttacttgggcaaatgtcgcccgttcctcctcggtgtcatcaaaaggtacactgggagaacagaagggttgaattgagctggtttccaaggaaccatgtcagagccgctgcggagttaagagctgcgtccacacagcagccaaatcatgaagttgcaggagcggctgttgttaacccacagctaagaataacgctcgactttccaaaataaaacgaagaaacgaagtcccctggccaatgattcggggcggcacagaggggaaacggagcttcctgcactgccctcatcactcagaacctggggtcccaggcgattcagtcaccgcccgcagaacagcgccgcgggcaccacgtgaaactcccggggccggctgggggcgggggacgaggggcgcccactcgggggtcggcagtttgcaggtgcgatgggcggccccctcacccacgtttatccggactggagcccgccgctcccggccgggtttccgggtggttcgcgctccttctgaattggcagcgaggtcgcggcaggttcgaggtaaatcggacgaagaggggaaaaagtctcaggggtctgggggcctccgcgcctcaggggaggcaagggccgggccagaggcgcgagggtgggtgagggattcccgccgcggggccgggaccggggctcgggcagtgggccctgccccgcgcgcccacgcgggccgccctaccgtggctctgcaggatctcgtgcttgagaccgccggtgtagtcgatgagctcctccaggccgcgctcgcacagctgcccgtagcccgagaacttgtgcagcaccttctccagctcgcgctccaccgtcacgcactgatccatgccggaggcggcggcgctcggctcctcggcgcccaggtgtccgcagccgttcggcccgggccccgccgaggccgcgtcctgctcctcgttccccaagcgggcggcgcgggaggctgaggcggccgaggcggcgggcgcactagccgcggcgccgggggagccccgcgcagccggagcccgcctgccccatggcgccctagccccctggcgagtcgccgctgctcccgttcgctcgctgcactcggccccgcgtccccaggccccgctcgcgacgttcgggtgcctgcgacggcgcggccgattgtttttgttttcacgggaaccgaccgatgacctggttctcccgggcggcaccaagtgccgccgactggggggagggggatggccacccgggcgaggaaaggaggcggagcgggccgtaccaagtacaccctcggggtggggggtgcgacccggcgagaacgggcggaggaacgcgacgggcgcccacacgcgccgccactctaatggtgtgcgccgtaccacacggaaggcgtgcgagggagagggcgagggtggagcgaggccccaattggcctgaggagctaaatagggaactttggagacagccccagcgctcggagagcgcaacaactacgcgctccataaacaaggaggcggaaaccggccctcaccactccgcccagaagcggggaatcccaaccaatgggcgcggggagtggtaagaagccaatccctggccgaggcgtaagccttcagccaatccgggctgaggggccaaaccaacgggctcgctgttggagggggtgacttggagagcgtaccgagaaacgagtagtttatggaaagccttgggggaaaactagacaaaaatacaaagggctgttttccataggacgtagccctgatcccaatttatttcgtctcctcatcgatcttaagggaaaggggtaccgtcattccgaacttttgggcgacggatccatctcccgggatgaaaaaccaagccaggccgcccgggggctggttctgcgtcggcggggggtccctaatgggaattaaaggcgggggtgattgggcccgggtgaggggagccgcttgctgctcgcgaaaggcccgcgccggctgtcagcgctgccccgggcttgcgacacccaggaggtcatgtccccatcccccgcggaccgtggccctttggccccttggcctggaacctctcctgacggtggcctcgccccagagccatgtgccgggcagcttagccgggtggaaagaacacgcgctggagagccgggcagcctggcccttgctccctaggaagccttatgctatcggatcggatcggctttaccccctcgggtaaatccttcccatcgcttgctatggcgtctgcagccttggcctagacctccttgatcagcatcggctgcactacctttgcatttcttcaggagcccagctagttcgtgcctcagggcctctgcacttgccctttccttggcccagaaaactcttcctcctacctttttcatcctgaagttcttctcagctcacttgtccccttacagagtcctcccctggctgaccacactaatgtacttcctccccaccgttaataccataacacattttattatttccacaccacttaaactctgaaatgatctgatgttttatttttctgtctgcaccacttacataaaaccatgacggcaggccccctgcttgtctaaattttttgcctagaacagcccctggcatgaggtggtaggcaattctttttcttaaattaacgtgataacgtttttgagccttaacttccgtataactgagaaataattggaattaatacttaactaaattgttagataaaggagaatatatgtaaatacccataataggctcatgataaccacatgataaaggtggtagtagtcattattagggcagccccaactggtattatttcagatctcccttctccccaccccatttttcttccctcttggcagatgtctctgattcttcactgagattaaaaaaaaaaaaaaaaatctagctccagcaacttctatcactcttttccaagtattgctgtgtaccacccattttgtgaacattctcatgtacccaaaggaccaggagtcccttctccctttccaagacagccgttggggcctgcgggctgcctctcacccctgtccagatcttccccctctttctctgcagtaggttcttcctttctactttcagcccaaatgggtttgacctacctgggggaggaaacttaatttaaccctcctcaagcactcatttctttcactgccaaactgcctagacaaatctatgtttattcctcccttttcttcaaggatctccttgataagctcagtcacccttttctcagtctttttttttcttctccttcaaagggttgttatagtatgaaatattccatttaaggcactcaacaaaatgcctggcacaaggtaagagccatgataatccactgatcacaaataatcaatgactcctcattacctacagcttcagatcctctctcaaggacatggtctgccctgtgtagcaacacagcacaaacccctatccaggcatgaagcactttctcaccctcagtgtgacttgagtacagcccattcatactttgccttcttctgggacacttttctttattctgtttttcgaatcctccctttcttcaagtaacacgacaagtcttactttaactagtgacaccttctagaacctaggcctgcactcttcaataccataatcaccagccacaagcaggttttttttttgtttgtgtttttttttttttgagatggagtcttactctgtcaccaaggctggagtgcagtggtgggatctcggctgactgcaacctctgcctcccgggttcaagtgattctcctacctcagcctcctgagcagctaggactacaggcacacaccaccacgcccagctaatttttgtatttttggtagagacagggtttcaccatattggcctggctggtctcaaactcctggcctcgtgatccacccgcctcagcctcccaaagtgctgggattataggcgtgagccaccgcacccgacccacgtgtagctatttaaattgaaatataagctagataatttaaaatttagttccccaattgtgctaaccacatatcaaataataaccacatgtagctggtggctactgtattaatcagcgcaaaataaatatttccatcactgtagaaaagttttgttggacagtgctgatctagaccatgaccacagtaaagttaccagccctacctttaactgctgtaagacctctgtgtaagtcatttcatgccttagtgcatactgcccccatatttttagttaacttttccaacatgtgcctttttgactcaactagactatcagttttcagatctgggctgacttctttttatctcccatgatttaatcagcatgaaaaaaagtgtttgttaaaggaaaaagaatacgcagattagaggagaagaggcttcagagttagctgggagagaaaaatagtacttgtaagggcagagatttatgttgcttcttcactttgtattggccctttctacacagtgcctaattgccttaagcctaaactgtgaattgtcaaagaagcacctctagaaacaacagggaaagaaatttagttttcagagcaactgcaaattagtttgtttttttttgttttttttttgagccagcctctcgatctgtcgcccaggctggagtgcagtggcgcgatctcggctcactgcaagctccgcctcctgggttcacgccattctcctgcctcagcctcccgagtagctgggactacaggcgcccgccaccacacccagctaatttttttttgtatttttactagagacggggtttcactgtgttagccaggatgatctcgatctcctgaccccgtgatccacgcgcctcggcctcccaaagtgctgggattacaggcgtgagccaccgcgcgccgcgcaaattagttttctataattgcattttcaccacacaataaggaagaacacacacacacacacacacacacaaaatcccactttagtatcaagtggactcctgcccccacatgctgttcagcctggagaagctttaattgatactcattctggactttgctcttgtcttcccctccactccagatttgactctgtaaaatgtaagtaaacatcaaaaaaagacgggaaaaagaaaaccttttgtctttcagccaaaatacatatttattgtaggaaaattagaaaatacaaacaagtaaacagaaataaaagtcccatgaaagcccaagacccagaaaaagaaaatcagttttaacattcggggtgaatttccacagatttttttcttttttgtgcatacacataaactcatatgcacatttttatgaaagaacgctctcattgtatttactattttgtaaacagcttttgttgtcctcttaacattcctccaacaacaaaaacagtttttagaactgcttttgacatctttttaaaatgcttaatagctgttacactagcttatagcttattcaacatatctcatacatattttcactttgaattattcttagaagactgaaaccagagagagacaagatagaaaaaggaaaaatttcatctcttaaatttgagaaattatatttttaaaaaccttctgcttttatgcaaaacacactttcagataagggtaagaaggactacatttataattctgttaataaaaatgaatcagcgaggttggcaaagaactaactaatttcctgactactctagctcacaactaatataaaagtaaaagtaaactgacaaaatgtgttattaaaagaaattctgaattgcaaaaaatagcatttcttctcatttaaacaaatcaatttttatcttgttttgttttgttttgtgttttaagagttagtgtctcgctgtgtcacccaggccagactgcagtggtgcaattatggctcactgtagtctcaaactcctgggctcaagcgattttcctgcttcagcctcccaagtagttgagattacaggcatgagttacccactgcgcctggcacatttttatcattttcaagtaaaatatatatatctatctgagacatttctgggaattgctgctatgaccagttgaagaaatgggtgaaagcacaactattagcaaaaagtcttaatctgaatattttctacatcttttatgtcacctgtgtggtttggggcccgtttgctggctggattaatgatacttgctcgccattatgactgactcttagggattggatatgcagtattgacagtattgcacttctgtgtccaccatctccgtctttcagctccactgtttgtagaagatagcctctgctcagcggcatagccctcctcactgtggccttcaccactcatgaagtccagggcagttctagtctggttgactaccagttaagttaccccctaatagacttccatgaggacctcattgacttccttgagtatagtttgtaggcactgccctcgtacctgggtgcttagcctatagggggttatttataacttttgaaacctgctctctcaggttttattgtctgagtcttttcctttctggaatctggatgtttttcttaggtttgtttcctgctcactgttggtgtgctttaccagctgtagcaggaagagtgctagcactgtaatcttgtaattcattcaacccctctcagcctcagatgctttatctataaaatgagaagcttggaatagatgacctttaagttccttccagttctaaaattacagagatgccagggcttattaagtaacatgtgaggtgcaacacaaccaaacaggaatagacagaggcatctttcctgttttcgaaagcttggagtctgaatcattacttcctcattatggaaacgtgatgaggtttgtttttttgttttggtttggatttttgatttttgattttggttttaataaatagctacaatttattgagtgcttataacacgctaggcattctgctttaaatgtgggattatctcagtcctcaaagcaaccttttaaagtaaataatgccgggtgtggtggctcatgcctgtaatctcagcactctgggaggccgaggctggcagatcacctgaggttgggagtttgagaccagcttgaccaacgtggagaaaccctgtctctactaaaaatacaaaattagccaggcatggtggcgcatgcctgtaatcccagctactcgggagcctggggcgggagaattgcttgaaccccggaggcagaggttgcggtgagccgaaatcgtgccatttcactctaggttggacaacgagagcaaaactctgtctcaaaataaataaataaataaataaataaataaataataaaatttaaaaataaatagtatttggattattatccctgtgttaacagatgaagaaattgaggcacagaggggattagtaatttatccaagattacacagctgataaagtggtagagctggaatttgaattcaaatctttctgactctataacttgtaagtcattgtacttcaaaaggcgaaattatgctccatgattacttgttaagcatgctatgtccagtagaataaaggaagctttaaccaaacttcattgttttgttttgttttgttttcaataacaaagtctactccacctaccttgcaacattgttgagagaatatatattaatgttgcaaggtaggtgaagtaaacattgttaaatatgtatttttaaattacacatatatttaaaaatatacacatatttttatatatatgatttttttaagtgctcataaaccatgaagccccacagaagtgcagggtgctattatttcctcttatgatttcactttctgtctttcatttcttagcatatgaattgtacttcttttttcaactttttttagtagttgccctaaagttgcaatatacatttacaactaatccaagtccactttcaaatagcactgtaccacttcatgggtagtgcaaatactttataataatgaaatatccctaattattccctccagtataactgctgtcattctttgcatttatatataaactataatcattcaatacatcattgctatcattttgaataaactatcatctgttagatcaacaagaaaaagttaagttttttactttattttcaactattctttctctattgctcttcctttctccatgtagatcagaatttctgacctacatcattttccttctctctgaagaacttcttttaacatttcttgcaaggcaggtctactggcaacaaattccctcaattttcatttgtctgagagagtgcttatttctccttcgtttttgaaggataattccacaggatacagaattctacgttggagggttttttctcaacagttgaaatacttcattctactcccttcttgcttgcatagtttctgagaagtcctgatataattcttacctttgttcttctataggtaaggtacttttctcctctggctcttccaagaattttttctttatcattgaatgctctggcatatttcaaaataactttttcctttctccttccagaagcatggattttttttctctgatattcactgtgagaacctaccaaagctctaagaggtaaaacccacacaagtgtgagaagcttccatgacagcctcgccccactgccccatcctagggtttttaactctcagacttgtccactgtgagtctcagcatttcttcaattacagtttaggttttcctcatgagtactgcttcactcagagatttctgtttctgagatgatgctccagcatgttgcaattctctgtatctgcttatctgaccccccagcttaggaggcagcagtttgccctgtgacctcacttctgtgaagaatctaagaatactggcctcagcaatatggtggaaaacacctctacaaaaaatgagccaggcaaggtgatgtgcgcctatagtcccagctatgcaggaggctgaggcaggaggataacttgagcccaggaggtcgaggctgtagtaagccatgattgtgcccccgcactcagcttaggcaaaaagacaccctgtctcaaaacaaaatctaagaagagtttgttcagtttttgcttgtggttagaatggagtgatgacttccaaactccttacataaactggaaactggaagtcttcctatgtatttgattcaacctgtttatatatcttatgcatctgtgcagggtaaggtttgggttgtaaattgataaagtacacgattcatggcttttgacaacctggaggagactctaggcggtaaactaaagcaagtgtttaaaaatggccttttgaggccaggcactgtggctcacacctgtaatcccagcagtttgggaggccaaggtgggcagattgcttgaaccgaggagttcaagaccagcctgggcaccacggcgaaacgccatctctacaaaaaatataaaaaattagcagggcatggtggcatgtgcctgtagtcccagctacttgggaggctgaggtagaaggatagcttgagcccaggaggtagaggttgcagtcagcctaaatcacaacactgcattccagcctaggcaacagagccacaccctgtttcaaaaaataaaataaaataaaaatggccttttgagacttctggttccaccaagatagagtagtcccatttttcctaggccctctcagaaaaacctggatataacacaaaaaacaagcataggaagactttgaaagttggaaagaagtcagactgcctagggatcccaagacttgaggaatgacatgtggtaaattccctagtttcctcatttcctcctaaatgtcggacaaggcactacagaattctgcagccctgcaccatgaataggcacagacaaaacaaagacccatggaaagcctgttttcctgagtcaaagaatagaaaaaagtgtggcccaacaatgaaaaacctcatcagcttcttccctagtccaaccaaacactgatggaacaactgcattccccaaacctcaacccccagcacagtttcagcagagccaaccaggaagttgatattccactctaccccttaacctatggaagtgggaggcagctctccagttccctgtgggtgactttggtaggtctgactgggagctgaccttttattccctaccttatagaagcagacaatgctccagttcccccagcagattgagcaaggagacaagcttacatccccaatcagaggcatcaaggtggtcgaagttggtgccacactttcactgggatgttgtcagtggagcaataggagagctgaacttccagcccaccatttgcaataagaccatgtgagtcagtacttcagttttgccaagttactgtcagtggggcccagagggaaactaaacatgcctgtgaagaagaagaaggaagaaggaagaagaagaagaagaattattaaataggatacaaatccaaactcttataatatgctatccaaaatatccaggatacaataaaaaatcattcatccaagaaccagaaaaatcacaacacggatgagaaaagcaatcaacggctgtcaaatgatgagataaatcaagtgttcaaattatctaacaatgatattaaaatagcatcataaaatgcttcaacaatcattcaaattctcttgaaacaaaaatttaaaacccagcaaaaaaaaagagaatttattaaagaattaaatgaaaattatagaacagaaaacaagtacaagtaaaattttaaaacttgctgtatgggctcgatagtagattgaagataccataggatagaatcagtgattgaggacagacagatagaacttacccaatctgaacaatagagataggggaaataatgaacagggtctcaaggatctgcatgatatttaaaaggaaaaaaaaattcaaagaatagctgaaaattccccttacttggcaaaagagatgaaacttcagattcaggaaactgaacaaatcccaagtaggataaactgaaagaaatctatgatgctaagacatgtgataattaagcttctgaaggttgaagataaagaaaaaatattgatactgaaaacagccagagagaaatggtgcattattgataggggagaaccaattcaagtgacagcagatttttaacctgaaaccatggagaccagagggaaatggcataacattcttcaagtactgaactaaaagaattgtctacctagaatccaatgtccagtgaaaatgtccttcagtaatgaaagggaaatggagacatctcagatgaaggaaaggtaagagaatttgtcaccagcagacctaccaaaaagaatggctaaagaaatttcctaaacagaaaggaaattataaaagaaggaaacttggaacacgaaggaaaaccacagcaaaaaaatatgggtatatacaataaactttcctcctcttgagtttttaaaatttctaaattgatagtggaagcaaaaattatagcattgtttgatgtagttctaaatgcatgtagagaaaatatttaagactattataaacagggtgataatgtaaagggaggtaaggtttctatatttaaactggtaaaaagatgacaccagtagactctgatgaatatatataatgtaaaacctagagcaaccactaaaaagatatacaaaggggtgcaataaaaacgttgtagataaaggggaaggggtgttattgtttaatgggtagagagtttctgtttggggtgatgaaaagattctggagatgaatagtggtgattgaacaaataacccacaggctcgcaggatacaggaaatcagataaatgaaaacaaagagaacacacagaaacaaaaaaatggcatacataagccctaacatgtaattacattaaatgtaaatgtacatttgcaaatataacaattaaaaatgagattggcagagtggattaaaagccaggtgctgtggtgcatacctgtaatcccagctactcaggaggctgaggcaggaggatcacttcagcccaggagtttgagaccagcctgggcagcatagcaagacccttactcaaaagaaaaagaaaaatgtcccaactctatgatgtctgcaataagttcatttcaaacataatgatacagacaggttaaatgtaaaaagatatacaaacataatcaaaagaaaacataaatggctatattaataccacctaaagaagacttcagagcaaagaaaattaccagtgacagaattggacattatatagtgataagagggtcaagaagacatggcaattcaaaatatataagcactagacaacagaacagcaagatatgtgaaataaaaaactgatagaactggaaggagaaatagatcaattcaaaataatagttggagacttcaacacccatctatcaatgattgatagaacaactagacaaaatcagcagggatttgaaaaaactcagcatcaccaccaacagacatgatttaatcaacattatagaatactccacccaataacaccaagaatacacattctttttcagtgcccatgaaacatataccaacatagatcatatcctgagccatagaacaaaactcaacaaattataaaaaattgaaatttgttcaatttgttcaattgaaattgaagttatgttctgtgagcacaatggaattgaaccagaaatacataatacaaaagtattatggggctcaggacagttcagaaggagaggagccctgggagaaggctgagctcagatggttggggcagttgggggaaagaagtgagctggctctggagggccaggctactccatatggcaccctgctgggcagaggcagctccatgccagggcacaggacttggtgaggggaacaggagctggacctcagtcccattggccccctggctgggtgccctcttacaggggcccaactgtacatggtgaccctggatgttggcctgggaacctgtgatcttctactacatctggggctgacagaggactcgggggctgagaaggagacatggtctcacgatttggagtagagagaaggcttgaccagaagggactggctgtgcagcaggatagctggaggcctattggctgggcatcctgtctactgggtcctgggccggtcttggcagcaaagtcagggcagatagcaccagcaagccacaaccgtcctgctccacagagcgctagaacagccactcatcagttacagcaggactataacgatgaccaagaagagaagacaaaacagaagagggtaggtagaccagaaagagtgttcagaaagaagcttgaaagaggagaggagagacactcctgagtagtagcaccaacctaccagctagatttgtaacctccaactactactttctggcctcagttttgtcacctgactaagagggttggaataaaacgaatttaagtctcttttacctttgactaggactgacccaggctggcctttcaccagctcctgtccccatttccaagggaagctgggtggggggtagagggtgtggatgacttagtgtggtccatcctcagaccaaaaacccagctaggggcccacacattactgtctgaaacaccatgctcaggtgtgaacaaagatgcttggttactgtggacttttagttccaaggagggctgtgtctttcttaactcaatggaagaatcaaattaggagcctggctgggcatggtgactcacacctgtaatccagcactttgggaggctgagacaagaggatcacttgaaatcaggagttcaagaccagcctgggcaacacagcgagaccccatctcttaaaaaaaaaataggagcccacatcttcagattcccagggctgagattctgggaaactcagccaaactccagagctgatgcaagtagcaaaggaccttttttttggtcactggagcctggaggacagacaagggcaagaggcagagaattccagcctttacaggtcacagagaaagtggaggaggaggaggtagctgatgcctccacacccaggagggagggggaaatgatgagcaagatttttcaccctttcagtaaaacaaaaaaaattatttctcctatttccttctctgagattaatgataaactgtctatcccctaaaagaaaatgataaagactctaattttacttggaggcttagaaatgccatttctacgcaaaacagggagcccataatcagacttgagcggggcagagctttgatagaaaatgttttcctctctccctctatttcttcccctccttccccttgcaaaccaagatgcccgacagctaagaacaatgctcaataaaatgaaataatattttagtcaaaataggccaagactgctcccagccaactgtaaattagcattttgagggcaaatatgcagacaatttgagataatgaagcctgattattcaatccaatgaatgttaactagggagcagaggctccactgccttatctcactcccttcgatttatttttttaatcgtttcacatttgaactctttatttgtttctgttttatgcgccccctcccttcctctgtcacacacacacacacacacacacacacacacacacacacacacacacacacacacagagtctccctcccttctctcctccattcctgcccaggctgcagaaggggaccgttgcaggggccatcagtctttccacccagcctggccttcgggatggggtcagcacgcctcatggagcccctactgtgtgcatggtcctttgtagagttgcagggatttgggggtcaatgtgcactaaacagatgacacacaccctgcttcttagaacaggcctgggtgcaggagctggagaatggcaggtttataaaggaacatgccaggtacatgtggggctcagggaagtgggggtggaaggacattgcctttcatgtccttcaatccaccctccatgaaaggtcaatgtggagcacgccctgtccccaggagtcatggaaaactttcttaaattatcctttgtcccaggcaggactcactgcataatttgcaggacccagtggaaaatgaaatgcaggggaacttgcccaaaaatcattgagaatttcaagatagtcatggcagagcattaggacaccaagcaggggaccttctgagctcggggcctgggcaactgcgcacgccacacacccatgcagctggcctgcctccagcagctaaggggcagcctcaggccagtgggaggtaacataatgaggccttctgaaggagggttgaagcccttctcaagtgaagagagaggtttctgagacgctggggagggtcccagctgactggggctagcccctggggttgcgggttgccataggcaggagccccaatgcctgaacagctgtcagcatggtggtttccccttggaggtacccatccttcagcctagagatgatgtttacttggtggcggaaagaacagctcccaactgggcgaggctccccgctgttacggtgctcacctggcctcaacctcctccttgggtcctggccctgctttttccctcacgagtgtggcctcccagtccctgccctgtccccatgagctcctgcctgggtccagcccctgcagctgcccttccctcggggcccccttaccactcctttcagtgtgtgtagcaggaagtccccgcctgagcatggcctcccaccttgtctgctctgctcctcagcttgccctctccccaccagacctcctgcttgtcgagtgccctgtccatcactctcatcttcccgctgcctctgctcatgctgggccctcacctggggggtcttcagcccccttccacctcctatctcctctccacccatttcttcacacccagccaaagaaggcagctctgccttttaccggatgtgctcttgagtgggtgatttcacctccttgagctttagtttccctgtgggtaaatgggattgtagtggggcctgtctcgtgaggtgagtgagaagaccaaccaagctggtgtaagtaaagccccgaccccgggctggcccacctgaatgtgcatacctgttagcttgcactctggggagcctctgggaagcttcagaatgctacagccagttggaacagctgccctcctagaacttccgtagcctttggaatcctggtcacgcagtgtagcctgcattcttacactgtttcctccacctgatagaagtttcccaagagtagtgtggtgagcacttaggacgtgctccctcagcctcctgtgccaccctccttttgtctggagaggctggaaaattaagagctgcatctcccagattcccttgcagctaggcttctggaagtgaattgggtgatactgatcagttagactcctgaaactcagaaggtggacatgagactctttcctgccctgggtttctaatggctatcaagatagtagaaacacaattgcctttttctgcaccagattcccattgtccatcctctagcttctgggtgtcaagagtcaaaaactgttgttttggtttcagtaatggcttgattctggtccttcctacccttccttccttctttccttccttccttccttctttcctccctctctccctccctttctttctctttctttcttcctttcctttctttctctctccctctttctctttctttctttccccttccttccttctttccttcctttccttcctgtcccttccttcccttcccttttcttccctcccctcccttccccttccttccttccttctttccttccttccttttccttccttccttccttttccttttcctttcttcttttcttttttctttcaagatagagtctcgctctgttgcccaggctggagtgcagtggtgcaatcatgactcactgcagcctcaacctcctgggttcaagcgatcctcccacctcagcttcctaagtagctgggactataggtgccaccacgcccagctaatttttacgttttttgtagagagggggtctcagccttctgcttcagattactagtataagccactgtgtccagctgattctgggtttcttgatctctgtattgcagctacagtggtttcaaactcaattcaaggggtggtctcagaggttgtagtgccactgggagttagttcagaattctggaattccttcctggatgttcaggttagaacctaccattctggcttttccaaaaattttgaaagtatctaattctctgttaagtctctctttggtgggtcagtgcagtggatcatgcctggaatcccagtattttgggaggctgaggtaggaggatcacttgagcccagaagtttgagaccagcctgggcaatataggaagacctcccatttctacaaaaaataagtttaaaaaattagctggggccaggcatggtggctcatgcctgtaatcccagcactttgggaggcccaggtgggcagattgccaggtcaagagattgagaccatcctggccaacatggtgaaaccccgtctctactaaaaatacaaaaattagctgggtatggtggcacctgcctgtagtcccagctactcgggaggccgaggcaggagaatcatttgagccctggaggcggaggttgcagtgagccaagatcgagccattgtattccagcctggtgacagagcgagactctgtctcaaaaaaaaaaaaaaaaaaaaaaaaattagctgggtgtggtggtgtgtgcctgtagtctcagcttcttgggaggctgaggtgggaggatagcttgagcccaggagattgaggctgcagtgagctatgattgtgccactgcactctagcctgtctcaaaaaaaaaaaaaaaaaaaacaaattagctgggtttggtggtgtgtgcctgtagtcccagcttcttgggaggctgaggtgggaggatggcttgagtgcaggagattgaggctgcagtgagctgtgatcatgccactgcactctagcctgtctcaaaaaaaaaaaaaatctctctttggttaaaaatgcccagatgggctttctacattaaatcctgacaggcacaagaataaactaagccatctctttctcctgcacccccactgcacagcacctagtgtaggtctccctcttcctaagaaagccgcatgtcccataccagctgacccggcaccatggctggcctctgagctgcccgagcacatgctggacatttgcctctttgtgcatcgttcatttcctgccgttgccctgctctgtcctgtaagcaggaagctgactcctgcaaattacatttcccttgtccacatgcacagtgccttgtccactggtttcttgttgggttcaaccaatgcaaagcactggtgagaaaccggagggtgagagacggggaaggccagagtatttcctgtcctctctctgcttccagtggcatctattttgtggagccagcttctgccaggcaacacctgcaccacggcctcccagctcccagccattggcccctccacagttaaagctctgccctggcaccccagctcctggagtcatgtaaatactatctccctgctctgactgtctagatctatgggtagtagcagcttcctgaaattgctaatcttcgagttgcctcaccctcccctgttttcagcttttccaacactgtcgtaactgggttctcaaatgaaatcacctctctagtgagctacctggtgagctgggttttcctgacagtgtggttcctcctatctgctacaagtggggttcggggccttgagccacgtcttccctccttgtggacacagtctgtctcccctgcggcctccctggccattttgtcctggcccagcctgaagaaacatctgggcaaaatccttcggggtccctttccccagctgaggagtgggggggcgcaggggaggagccagggcgaacggcagctttcgccaacacctcactgttctcttctcgacatgtttactcacaggctgtctgggaagtgagaatcctccctaatggatgtttcacccaattaaataattaactccaagtgttgctaagcatcctcgcctctcaccttccagtcctggaggcgtcctcatgccaggctgcggctgctgctgagacaaggagcctagtgggaggagccaggagtgggggacagtgcccctgatgcttctgtacaggatgagggagataaatgcacctgagagggaaggtaaggagggctgttcagataggaggctgaggggaggctgagactcacaggaagtggcattagaaccttctggagcctttctattgaatattaagtccttgaaggtttccctctcccccaattcttcccatacgccacagcagggtccttgttccttcaaagaaggggaaaggaagggacacaggcttcttcctaatgggtagtcttgcgttatgaggagttacagagctgagctgctctactaaccagacagtcacataaggaaccccgaggggagaggctaaatacattcatactgtggaatatcactcaaccgttaaaaagaacaagatacattttcctgtatagataggaaaagatctgtaagatactataaagtgaaaaaatgcagataccagtacatgcagtttaatttaagtaaaaataatgtgcacatgtatgcatatacttgtctacctgtggaaggaggactggaactagggacaccaaactattccgaggggtgatatatagaacaaagctcctttcatgaaaaattgaactcacatttctgcagtgtaatcacacattctatctggatttattgtttaattgttttctattgtcaaacatgtctaagttattgacattagaacagagaaactccaacagagaaagggagcacagctacattttttttcttaaagattatatactatttctttacatggatgtcttgattgatttagttattgattcatattacaatggaaggctgaatcaacttatacggctttgaattaattgtataccttctattgatgagtgaataaatagttttttaacattcaccacaaaacatataaacattaacaattttgtgatattttacataaaacgtgcaagaaattctaaatttgaaattagtatttattttatagaacatattatgaaatactttttaaattagtaatcagaaaaaagatgattaaatagtaaaaacaatcatttgtatttttaccagatatcatcacttttaaaagtttggtttatattcttccagatagaacaatatactaaaataatataaataggttattatgtcaacaaacatttatatatatttttacagctggttacccccatgcaaaaacgtgccatatgtaatttttctatctaatatatttgaaaatgtatgttatttaaaagttttcctattgtaaacaatactataatgaatattattaaagacagtcttaagttagcaaagactgaaaggacatgttctctagtttagagtgtatgacattcaatcaagacctagaagacttatgccatcccccaagaatgtactaaaaatcatctgggattatagaaggaattcagggaaccctatctgcaagattatttacatgccagatccagtaatttatgatcttcttggtgtctgtaaagtcataaaagtcacaggattacaccatagtcatttgcttgaaattgcattcaagatatctgcattccattccttagatgctttccaaaataataaaatacctggcaggattctgtgtggaatctcagtcttcctatgtgggatgatcacatgtagcatccttagtgccaaacctaataaaacaagcttattgtttttggttttggcttttttttttttttttttttttttggagcatggttgaaaaaacttatgatacccagaacaggtttaataaatttttctaaactggatattgattatcaaagccaattatatgcctctaatatattgatttggagaatttagaaaatcaaatatttcaaatatatcagaaatctacatactaataaatttaaatgaaaaaatttctattaactaatgtatgtcagcagcttttattgacaaactcattttatttttccaaaggcatacaaagtagtttctataataaacctggcaaaaatagatatctagctagcattagcccaataatacaaataaaatcaaatcttgaaagaaatggaactttttaccattccagatagtataataaatgtaatagtataataaattcgcatagctctataacgcagatttggctaaatatgactctataaaatgacatttaaaagaacagtgttgtatacagcatatggatgacatagtttcttacaattttatagtaaaataataattacctgaataaggtaacatcaatcacattcatttaaaatagttgatttataaactagcttgattttaaaacaaataaaagaaactatctactaaggtaacaatgagtatcaattagagtgtcacttcacaaactttaatgttcatacatatgatggcatcttgttaaaacagagcctctgtttcagtagttctgcaccgacctgagaagctatgcttctcacaaacttcaagatgagattgatgttgttcttctatgaactatactttgagtaacaccagattatgagattattaataattcaaaaaataagcttattttttaggaaaaagtataaaaaaatcaggcattcaaactccacaaaaatactttttaagccatattacaaatagaagctttaaaatacatttcttttctctgcatggtttatgaatcttcatttataggactggctaacattgacacaaagttcacagtgggtattatatccatatatctacataagatgttcagcttctctcattctcagcaggtatggtctcattaacacctgtgattttaaaagcctgagtttctcccagcaagatgtagttttattaatatgtgttatatttatatatctctcactttgctatgttataatgtggaaccaaacctatagctattgctctagtatctgtttacttcataaatattgactgctagaggtgtgaatcctactagggtcttttgcataattatatgagggtaagcagtaaacaaaaatgactgaagaataaatgaaaataataacttagcttaaatgtaaagtaagatgacaagaataccatgaaataagagtcacagaaagaatgtttgctgctgttatttaaatataaatgttattatttttgaagaaataaatgtgtatacatctatctctttcagaagaattgtgaattgtttacaaatatattttctgaaatatcttttttttcttagtactgaggtctgatggtaaatgtttagtaactagctttgtataataaaaagccagatttatggtgttttcagattttcatggtgtaaaaattcccagtggccaatttcaaactactgacatgagatctcggaacatagcattaggaaaagatgcagaaatgggcttttttagaagccagtgcataatacttccaacacaacagtgacttagcagactgagcgtcactttactttaatgattaatcacaataattgtcaactgacattttttatttaatgacttataacatggttccaattataaaatgtggaaaatataagtaaaataaagacaaaattaacaataaatctaacacccccaaaatgattgttacacatatgtatatatcctttgagagcttttattaaaatatttatacttgtatttgttacaaaattgaaaatgtgttttatttcactttggcattctacccaaactgacaatatactataattttctacaattattacttattcctttaaaagtacatacaaaactgaatgaaactctatgctcccaatatactaaaatcaaatgattttattctctatagtttatagtttatattctataaaatctatagaatgattttattctctaaatatacatatttagaatgttttgaaaattattggtcaatgaacattctgacgcagaaatccttgtaaatattacctctgcttctttagggtaaatacctaaaagaggaattattgagccaaaaagtgcaattactttgagggtttctgataagtgtccctaaattgcactcaggaaaatttgtgtaagtttaaactcttaagtggagttgctggagaccctctttcacctgattcataaaacaatcttaattagaaagaagaaacaatccaaatgtctttgaggttcaagtacaccacatactatcgcatttaatttttatagtctttaattttattagttcaatttttcatatttgaattgcctgttagcattctttttcttttaatttatgtaggactatttacataataatgccatcaatcatttttatatgtgtgtcaagtttatcttctattgaataatttatcttcataattttgttcataatatttattgaaattagaatgcataaatattaaacttaaaattatgttatatagtataccatgcatgattataaatattatgtcaaatgtataaagtggtttttgctgtcagtttctgatttctccacccgatataattattttatattacctctaatacaacagattcaattctggataatttggggaacaacataagaacagtagtaatcaaaactaaataaaataactacatgcagtttacaaaaaaagttcacatcctatgaatatatttaaattatacttcacttaaatgtatcatttcactatgcattttctattgatttcataatcatattcctttattccatttttccccctctgctggcagaaagtttctattttctgttggcatttagagtatcctaacatttacaacatgcattcatgatgtattaaactataacatgaattaatatttgcctcaatttacagcaaaatgaagaccttctaaaattgtaactccatttatttttcccttccaacttccatgctatttttataatacattttagtatatgctatgactcccaaaaacattgttattgctattattatgctacattgtaaatattcatttaaatttacccactggaatacaactttgtgtttcttattacttcctgaatctataaactaccacttaataccatttcatttttgtttcaaaggtaaccatgagtgtgggttctgtcttagtgaattacttcagttttcagtgatctaaaaaggtttttgtattatcttcacttgtgaagttttaactgtatatgggattgaagattagaaattattttctttaggccgggcgcggtggctcacgcctgtaatcccagcactttgggaggctgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggaaggagaatggcgtgaacccgggaggcggagcttgcagtgagccgagatcccgccactgcactccagcctgggtgatagagcgagactccgtctcaaaaaaaaaaaaaaaaaaaaaaaaaaaaaaaaaaaaaaagaaattattttctttcagtgcatagaggttataattctattgtcttttcacttacattgtttcatttagcaagttaagagtctaaaggtgttcttttaaaggaaacgtgtttttcccctgactgtccatgatatttttctcttttactctatgtttctgcaattcctctctgtgtcatcaggttttgaattgctttctgtgtttttctgctttggattcatgtttccctttcaattaatagtttaattcatttagaagcatatcttccttgttcttgctctactttcttgagcccgtaattatatgtaagacttttcattaacctttgcactctacaatattttctatccttttctttactatgtttgattctacatattttattctaacatacctgctagatcattaatttccttatcaactgctctcaaacctatcttttgtgttttttatattgtttccttttcacatctgaaatgccaattttaagcattccaattatttaataaaatgtttatattttgttttttatcttcagaataattctactacctgggataattctactagtgatgcacaatttttgttccttagctcagctagttcagattcttgtctcacaaccaggaagaattagacaagtggacatcaaagagtgagtggagtagaatttattaagtgaaaggaaagctctcaggaaaaaagagaggatgtgggggttggttctcctacccaaagacaggaaagttccccaatatggctgagcccagggttttttgtgggctgaatagggagtgtgtgctgattggtttgtgagtatgcagaaaaggttaaagcaaagacaccactcaaaggtgggcatgacaacatagaaaaccaattaggcggctgggtgcagtggctcatgcctgtaatcccagcattttgagaggccaaggatagtgggtcacctgaggtcaggagttcgaggccaccctggcaaacacggtgaaacttcatctctactaaaaatacaaaaaattagctaggcatgttggcacgtgcctgtaatcccagctactcggaaggctgaggcatgagaaacgcttgtacccgggaagtggaggttgcagtgagccgaggtcccaccaccgcactccaacctgggccacacagcgagtcactatctgaaaagaaaaaaaaaaaataggtaaaataggtgaaaaagggggatcaatcagaggaaagcacacaaaacaggaaggtgggtcctcaatccaatccaaagatttacccagcacagtttccagcttgaatgttggatttcacggggaactcatccctatctgccttgggatttgtctgcctcctgtctctatcaatcactagctggccttttctgttattttgctctttttccttgttttctttcattttgttttgcctccttctgtgctaggttatcttttattttatgctggatttatatttgaaaaatttattttgttcacttgcaatactcattacagatacaaagaatggcattgttttatatttttataatttatttaatgcctgacttaatataagacatgctgatttattagatctacttctgctttcggtatgttgtgatatcatacattatgtagtctctggaaaactctacttactttacacatgagagagaaagagagagagaatgaaaaaatcaaataagatcttaatattgttatattatctcaggacctcatccctttgcctcttgagagtgggatgttaatggcttcacattgctcctgattcactattttttgtttgtgccattaagtttgtcaaaactattgaaaacagtagagacctcacttatacagccattgacatttattcctctttttgtaacattatgaatgctaatctcaaaagcacaaagtttgaaaaatcgttgcttttatctttaaattacctgggtcttcaatctttcatccctttggacaagtggaaaattccatacttgtagtttttgctggtaaagtatctgaaactaccctgtggtaggcaccctctgagataaaccctaataattcccgcctcctagtattcacagccttaggtcatcccatctttaccttaagtgtgacgtagactggcttcaaaataattctgagaaactatttcactttcaaaattataggctatgaaaagactgtgatttacatcttgggtactctctctcagatggtctcttgaatggctcactctgtggatagccagctttcatgatgtgaggcagtctcagatggtctcttgaatggctcactctgcagatagccagctttcatgatgtgaggcagagtcttgtggagtaatccacagggtggtggtgttgaggtccaccaaaaagcacatgagtgagtttagaagaaggtccctccaccacctcctttgaaatgaatcttcagataagatcacaaccccaactggcaactgcacagcaaattcaggagagcctttgagccaaaggtgcccaaaagccatgcctgaattcctgatcctcagaaattgagataataaatgcttgtttctttaagatacaaagacttgtgctaataagctatgcagtagtagatagttaacacagtcttctctttcctggtttatcacatttgtgccaaatattctctttgctcaaactcaagcccctacttctaaaaatacaaaacattgcatctcttctctgaatctttcttgaggcaggttcttaaatttctatacctccatatgcacacaaaacacatattcctcctgacatctttctatctttcagaaccgttgctggtgaaaagagtgaaggtcctctgcgtacttttttcctgaattctcatggacctctctgccttttccaaataagggcaatctcctttccttgagtcattgttttcccacaaatcttctacttgactgaagtgttcagggcacataggatgacttcaatatgcctgaatttacaaaagacctttatcttgttttttatttttgattctattacagtatctgaggaaaggagtcaagagattgcctttctgtgttatatgaattgagagaaagttctgttacacacacataaattaataatttaatttttcacctcaaatcttttcttaaaaccaactaactataattttctaattacagaacaacttcttacatcagaaaatggctctacatttctactcagaactctctcagtttaggactaatcttactaactcattaaaagcttactaattcattattaaaatgctctggtttccctttttataagttgttcattacagtccatgtccaaatggaatggacctttctttgtaattctttacacactgtcttaggccagttgggctgctataacaaaaatggcatatactggatggtttataagaaacacatatttatttctcacagttctgaaggatgagaagtcaaagactgaggcactggcagattcagtgtctgggagcacccatttctcatagatgacatcttcttactgcacacttacatggtgaaagggtctagttaattctctgtgttctcttttataggggcactaatcacagtcatgaggatttgacccttatgacctaatatccacccaaagtcttcacctcctattatcatcacactgggggttcaaatttcagaatatgaatttggtggcgggggcacaaatgtgttatgggggacagaccataacacatatatctgtaattgttttattttttcagaaagtgatcgtattatttctgtgacatgttatgccagaaaataatactacctttacgcttgaatcacaatgtagctatcaaatataccttttcctataaaactccattacatagcatttaatatttaaaagtgatatttgaggcaaattattgcctcacagcttaatcctttcattccacattcaaagcatctcccatgattgtcctcatacaacaacaatctgtctgtgcacaagtggattaattcttatctattttatactttaaacacttacacttctaagtgttctctacatacttccgattagactgcaattacttctgcaccaacctaatacaaaataacttgtttttttttaattttgatcccacaggccttaatttgtatcaatcacttttaataaaagtgaggttaagtaatattttttgagtctctacaatttatttagtggcatatacactgcagatctcattctcttatctttcacattagtgatgcagttatatattagaacaggaccttattaagataataatgaagatatttttcactgctccagtggtcacgattggattttcatcattcagatacctaagaacagtggtccacagcctttttggcaccagggaccagctttgtggaagacaatttttccacagatggggcacggagtacagtttggggatgaaactgttccacctcagatcaacaggaattatattctcataaggagcacccaacctagatacctcacatgcatggttcacaatagggttcatgctcctgtgagactctgatgccaccactgatctaagaggagacagagctcaggcagtaatgcttgctccccactgctcacctccggctttgcggccccattcctaacaggccatggactggtacaggtccctggcccaggggttggggaccgctgcctaagaacataaatatggaaatatttttgctcaaatgcacctaaccttcagatggctaaaaaccttttagcacccggggtgtaggattgagagtggagattactggctgagagaaacagcaaaaaacattcctcccattgaaattaaatcactctacaattgggtttaattgctggacctacctggtaactaacaaaaatactaaacataattgattgcctcatcatttgaaaacaagaggtcactgaatcaaataaatggtaggaaaatttagaaccaataaaacaaaacattttggataaaagttatttctctcttagacctgttgccatgagagtcccataaatgaaccagatttatagttagcagactttctcagtcacttataaataatgaccactgacacataaaatgcattcacaagtagatgcttagattaccacaaaggccttaagacctaaaacatcaataatgtaatgagctttgttttttgctacagacaaacaaaaaatacaccctgcaattttataaaaaattcaggattaaagatttatgtacgcttatgactcaaatgtaaccattattgtaagaatgcatggtaagcatgacattgtttcactagtcttgctacatcttaaaattaattcgttcattcatctgtccatccagaaaggatgttactatgatatacagcttctaaatggcccccaaccaatccccaaatcttgtcattgtggaatcccttcctcttgagcatggactagaccatgtaactcacttcaaatgaatgcaatatgaaaaaagagatgttacttccaagactgattataaagggattgtgactttttctctactaggccctattttactctctctcttttttctttttctctccctttctctctttctgtctgtctctctctctgttcatctgtctctcactctttctctctgtcaaaaccctgattctaaggaaaacaggaaggtatgttttagtgaattctcataattttattttggcccagcatccattttgaatataaatctaactttctcatactagaagcaggactcagtcacacttgacagtttccagttctttaaccacatccaccctcagttcccaaatgtgattggtccacatatttgcctgatacaactgctccctggtgaccacttctacttccctatgggacagctagacatagcctacctgactgaccccactgaccctcagacctcacatggactgtacagatatgtcacagtgactacctgtcagtcacagcactacgtcctggaactctaaaacttatgtttgcttgctttaaacccaccacttagaactccctgtgggtaacctatttagataaggtcctggatccaataaaggcattggctgatagggttctctctctctctctctctctctctctctctctctctctctctctctctctctctctcctctctctctctctctctccctccctccctccacactccctgatctcttcgagtggcctccagcatgcagtgtaaatctcaagacctctaagtaataaaatttttattttcatcttgtgtcttgccaaatcgttgaaagaatactctctatcttaaggatcctaaattaaaatacatgctataaacagccctacagagagaggcacatgtgccaaaaagcttatctttctggctaactgccagtaacaaccggagggcagccaacagccaaacaagtgaccttataagagaattccacccccagtggagactttaaataatcacaaccctggcaaagaccttaactgtagctttatgagaattctgaatcacaggtgcacagctaaatagtgcctggattcttaattcagacaaattgtgatataacaaatgcttgttgaataagttcttaagattgggggttattttttatgaaacaatacataaataaagcagttaagtattaatacatagactctataatcaaatgacctgtgatgaatttctggctccataattcttagcttctttatcttagtcaatttatacattttttatatatcaatgtccttgtttataaagcaggtataataatagtacctctcacatcaagttctttcaagtttaaaacccaaatgtacatacagagatcttagagcagtgcctgattcacagtaggcacttaaattttagctactgaagctcatttatttgaacaataatattaagactataaaaagttactaatacactttgcgaaattgagcaggtgacataatcaccttgggtctcggtattctttcattcattcaaaaatatttaataagcaccaattctgcatcaacctgcgtatatatttataataagagggagagaaagcaacaggaataatagtgctgccactaagtgaaagaggaagactgcaggagaaacagatttcagggagaatatacggggcagtcaaataccaagagtgaagttgtatgagctgtcaatgcttgtgcagttaatatgttatcattatctaaggagcattatctaaggagcagtcattctcaaacatttatgagcatctgatatagggcccaagaagttgcatttcaacaaaatgacaaataatactacagctgctgctccaggaatcacactacagtccattaatgtggaatatgttaaaacaataaaaaaagtgagtttgattattattatcatttataataatcggggaaaaaatgcttgtccccctaaatgtaaaaccgttcttggtttaattgagaaataattgctatggttgctgtggaatttagtaaattttataagtataaaatataaccttccaatcaacacatttttcctacataaatttaataaacattgcattgcacgtggaaattaataagtggaaatcttagttacactgtcagttccaaaataaacagacttagcttaaacatttgtttcaggtttaagttactagcgacatagaagttatccctatctatttaatgttgtgcaatgttaattaaaattgtatttaaaaattttttttcaaaggtttattcctactatgtattgactttgtattggaggccgtattaaatttccatatttgctcttacatttttaatatctttcttaggattttctacataaatagtcatttgtaaacaaatgtgttacgctcctttatttccaatcagtatatttttaaacgttttttcttgcttaaatatattagctacggtctctagtagaatgttaattggaagtactgaaggcaaatgtattttcgttcttcaaaaattaggaaggaataatcaattttctaccattatgtatgatccttactgtggaatttttatagatagcctttataaagctatttatatttttctgaaaatatttataacgaataaatttttaattttgtcaaaagctttttctgcacttcttaagatgaccatagatttttttaaattatagcaatgtggagaaaataccttaattgattttgaatgctaaaccaatatttcattcctggaataaaatcttttttatgttgccagatttgatcgttaaacttctataaaaaaatctttgcattatgtttaaggggtactcctctgtatttttaaagttttgacataatatggtctacaatgatgaattcctaaaatgagttttaggtattttccactaattttttggaaaaattttgtgtaaaagtattattttttcttgaaatattttatataatttaccaatgaaggtaattagcccaggatttttcttttttggaagatttttatttattaatttaatttatttaacagacatggtgttattctggttttatgtttcttcagttatactgtagtttatattatttaaagcctttgcacatttcatcaagaatgtcaaatttgacaaagatttattgacactttttcctttttattgttgtaatacttgtagtagagggtagcaaacttttcttctgtaagaggccagattggaaatattttaggcttctcagttagtgtagtctctgacataactcttcaaatctgttgtaatgtgaaagtagccatagagaacacaaaaataaacggatgtggctatgttctagtacaattttttttttcacaaaaacaggctataggcaatacttggttttgagaacttaatatgctgattctaatttagagatatctagatgtataaataggatcaactacaatgtgccctgttgtattacagatattgtcaatttgtgttttttcttttttcctcatccgattgtctagtggcttttccttttcatttatctatccaaagagcaaaattttggtttgatacattttctctatctatttttttggatataactttcttttctaaaagtttgggtgaatatttaaggcatgcgttttaaaccttccttcttttctaatacaagcactcaagatttataatttttctaagcatatagaaggaatttgtaccccacacgttttaataagatatttaaaaatctttttcagtttgaaatattttctaaatatccttctgacttcctctttgattagttagttatgtaaaagtgtgtttcttatttttcaaattgttctgaaattttccagatatatttttgttattggtttctatttaaattcctggtaatgagaaaccaaactctatataacttcaaatctttgatatttcctgagacttttaaaagaatcactcaacatatgttccatctcattaaatgatccatgtatgcttgaaaaaaatgtttatctattgcaccaccataattcagcctggacgacagagcaaaattctgtctccaaaaaaaaaaaaaacaaacccttgatcttatcctttttgagtatagtttttataaatatctgttaggttataaagttgtttaaatcagttttgtctttatttttgtctattatatcaattactgagaaatagatgttaaaaatctctaaatatatttatgagtttctgcatcatggattctgaatatctttattggttttgtcttcattggcattgtcatatcttttaaacaaatttactatttttaaattatgaagcactactttaagacggtgagtggcagcactcaccgtcttaaagtgtattttgtcggatattaatgtgaagacattagctttctataagtggtgtttgcatagtgcatcttaaattttaattttaactataaagtgaatattttatgatcagcatataattgtcttatcatcctgataagctctcattttaattggattgtttggtatctttatattttgtgtgatttgttatatgttttctattatgcctaccatattgttatttgacttccactgttttctggttcataacttttctaaaaggaagtcagtaataattcataatgctgttttctttatttaatgtcatatttttctagctgcttatacgattttttcaacataccttaaatgttccattatattatatgtgcttgaggttctctaaacttattatgtctataaattaatatcttttagcatatttggaaatttttgcctttttaagtcttctaaaaaaaagtcatcaaatatgttgttattccacaaatatctcttctctttctctaggatatcaagtacactgctcttaaattgatatgataaacctcttaaacccttaaaatgatatgataaacttcttgatatagtcccacagatcacaaagattcatcatttttctccctaatggtccctctatgctcttaaatcagatatttctattaatttgtctttacatttgctgactcttgtttctatcatgtttattatgacaatcagttcattcagtatttgtttttaattttagaaattttgttttttaaatataatttgcttttggtttaaaaaatcttattttggctaaattatatattttcatttattatgaacatgttttcatttatgtcatttatcattactatagtagctactttataattttttctgttaagccaatatttaattcatctcaatgtatattgcagttgattgcccctattttttgcaatgtaggtctgctatggtctagatatttatgattcccaaaactcatatgttgcaattctaaccccagggtgatagtattaggaggtgggaccttggcatgtgattaggtcatgataatggagccctaaagaatgggattgctctgcctgtaaaggagacctcagggagatttcttgctccttcacccagtgaagtcgcagaaataaaatttagctctgaaccaaaagcaggccttctccagatactgattctgctggtatgatgacattggacttcctagcctttagatatgtgagaaagacatttcttttgtttataagctacccagttgatggtcttttgctatagcaacacaaatggactaagatagggttatatgtgtttttaaaatcacacatagcctaactatgaaagaatgaaaaaatatatattcagtaaacaaaaacagccagaatggccataatgatatcagacaaaaaagactttaagccaaaacatgtcacaagagacaagaagaacattatataatgataaatgggccaattcacaagaaagatataactattataaatatacatgcatccaacatcagagcacaaaaatatataaagcaaacattgataaaactaaaaaaagaaatagcaagacaacagtagtagcatatttcaatattccattcttaataatggataaaacaactagacagaaaaacaaaaaagtaacatttaacttgaacaaaactctagatcaaattaaccaaagacacatatagagaacatgccacccaacaacagcagaatacacattcttttcaaatgcacatagaacattatttagaatatatcacatttggcaacaaaatatgttttaacacatttaagaagatagtaatcataccaagtaaattttctaatacatatggaatgaaactagagattgatagcagaagaaagactggaagattcacaaatacgttgcaattgacaacacattcttgaacaaccagagtcaaaaataaatccaatgggaaattaaaaaacatcttgagaccaactaaaactgaaacacaattcaccaaaacttatgagatgcagcaaaagtagtagtaagagaaatgtttatggtaataaatctctatgttaaaaacgaagagagttatcaaaccagtaacctaactttacacctcaaggacccagaaaaacaaaataagtccaagacaaatgaagaaggaaatattaaagcttagtatagcaataaataaaatagagacaaataaaatgataaaaaaatgaaaattagttttttttaaaagaccaacaaaattgacaaacctttggctagactaaaaaaaatagataaggctcaaatgaataaaagcagagttgaaagagaagacataattgatgccacagaaataaaaaatgacagtaagagactgctatgaaaaattatatgccaacaaattgagtaaccgaaaaagaaaatggaataaaattctgaagcaaaaaacctaccatttgtaatagcattaaaacctgaaatataagaaaccagatttatcaaaatatgtgcaagatatttacattaaaaactacacaatattgctcatagatattaaagaagaccaaagtaaatagagaccatgctccttggttgaaacagaatattcttaatattccaattctccccaaaatgatctatagagctaaggcaatcccaatcaaaatctaagctggctttaaaatagaaactgaaaagccattaagaagttcttgtgagtgtggctggttggtctagggctatgattctcacttagggtgcaaaaggtcctgggttcaaatcccagaggagcccaacttttagttcaaaagttcttgtgaaaacaaaaataatctagccaaaaatattcttgaaagaggaagaaatttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagaaagaggaagaaatttgaagatatacacagtctgcagccagacacaaaaaaattacatattggatttttcctttttatgaaatgtccagaaaagagaaatatataaagaatacataggcctgtgatttcctggtctgggagtagaaaggatactgactgtaaataggcattaaggtatttgtttaaagtgaagaaagtactctaaaactggattgtagttatcattgtgtaacaaatatttgtgaaaacaattgagctgtttgcttataataggtgaattttatagtatttacattatacatttataaaactttttaaagtatttttaataaagctgtgtcattaaaaagaccaataatctgccattcctaacatgtttagtaaaaaaacatgaaacacgcagcataaggattttaaaaagatacttttttgccaggttaattattttattttaaaagcgaagactatttttttcaaattaagttagagaatcacccaacattataattctctgggaaaatgtgaagttgtgacttataagtaaaaaaacctgaagaccatgactccagaaaaagaaaatctaatgcaaagaaattctccttactccaaattttgagtcccacacattttaaagattttttttcaaatccttttatattaactaatttatgatacttaatgggtcccagattatataaaaattcttattctatttgattccaaaatctgatggagcacagaaaacaaccaccacaatatcgatgagaagaaaacacaacaagatgttatttaggaatatcgggggaaactttattacaaagctgggaaattgaattcattttatattaagaatttaataagctcttctgaagatgaattcatttcatgaacatttcagcttataaatataaatacaattattctgtgaatggtacagagtgaaaaatttaatgattgtcttgatagtgatttaaaaattatataaaagtatataaacatctctatatatacgtataccacacaagcgttgagttgattttactgtgaggcatccacattaacatttaaaattcaaaaaacaattttttcaggcatataaatggtttaacatttgtttccggaaattctaacaagtgaaacttgacaagaaaacaaaaataagtgttgtgattattgaaagaaaatcaacatatacttctatttgctggtgatatgattattctattgaaaagaactgttcacgtttaaatgaatagcattaatgtgatacgcacaaaatagtaagcttatggcacagaacttttttgagaggccaatgtagaaaacaaattgttattaccctgatgatatttttataagagaaaacccactaatgtgttgattgaacagaatttctatcaaaatctcaatatacattttgatttaataattcaaaaaatatttacaaatactcaattagaggagataaaaatagattattcactgaatgaatgactttgatgcaactttctaacgattcagggaaatttaaagttagattcctcccccacatttactgaaaactaaatttatttcatagcaagtatatatatatatgtggtaagagaattattacaaatatagaatattatatgtaaatatgtataaaagtttggctggagaagaactgcctagttgtgacactaaaagtggagacaatttaggaacctatttaaatatgtaacaattaatattaaaaagcaaataattttttaaaaattataataaatgcaaataaaaagcattactatttcataaagagctcttacaagtcaataaaaatttaaccggtagaaaaatggataaaagttcactgaaagtaatctctaaaataaataatttgaataattaataagcatctaaagaagcattgcacatcaatacattgtcaaattaatacattttttaaaatgacaagctgtcacatttttctgttcaataatcaaaactaaaaatatgttgcaatatccagcagtgactacaatgaactgatataggcactatcctacatatttttaagaaataaaaactcgcaaattttctggatgtctacttgctaacttttaaaaacatttagcaaatggaatgtgcatttgttttactaaactattcctttcaatgaattaatcctaaataaataataaaagtatgacacagttacagggatctttataagttatgtttataggagcaaaaattagaactatacaagatgctaaccctctattaaagagtcatatttcctccatacaatggagaactgtgagcccattaaaacctgataatgtcatgatctctaatacatagtcaagtgtaaaaataggtagcaaatcaaaattatcttctctcaatgtacatctgtgcaagtctgtatatgctcacatgtgtgtgcataaatcagtatttcatattaatataaaatatctaggtgaaccacatgttgaccgtggctttgcattgggtttatttttatttttgtgtgtgttgttacaatagaatttgtataacaagaaagaaaaaagtaaatatgttaaagttaaaatatctacaaagtacaagaaatatgaattaaggaaaagtagagaaatggaatcctgagtcttataaagaataacaagaataatatctattgtgacccaaacttaaaaatttccctcttttgaccaatttctcaccctgtgtgttattagtcttcttttgatatctacctctaatttatgttggattaactgaggtaaagacacagacacatttctctgtgtcatttgtattctggcacctctctctatttggctcaacattagactgtcattttcattttctcaggtaattagtgataaccgtgtaccaaatattaaatatataattcatgacaattacagaacaatttcctggggatacaaaatatctgaaatataatttaccctctctgagtgttgccagttgaataaaagagtttaaagttattatgttgccttggctatgtccttatttctgtcttgcaatgcaattcacttttggattcttgcctgtattcctccaacagatcaagcaacacctaactaatagcgtaagaatctggccctctaattcaattcttgtacattttctggaaattaaacttgagaaattgacttctattgtagacttgatcttagattactgtccatgatctctggagtttttactcttgccactgggatcctaaatttgtccccttcctagtctatcagaaaagtacacccagcacattggggaataataacaattaattaaagacagaggataaagcctattgagacataatacttcctctatattaatgacttgggaaatgtatttttatgtaatcaacagaagcattgagtctctattacctaaattatctttatttgattagagacattactaagaaccttaagctttgtaataattgaacccaatattttcaatatgtgaaaagtgactttagtccttgaatattatttatttttgttatggctacacaaatgtatgcccaaactgtattctaacagatattgtggtaattatttgataacaattacaaattgaatggttttcatttaggaattttaaagccagttggagtgaaaatgtcctcatcttctctgggacaggtaaggaagtaaccagtaagtttgaaaaatatttggaaagttacatttaatttcgtaatcagtgtattatttcctttatgtttagcaaaatttgttggttcttgtaataagtttggggtcttcccccaactgcataaagatacataaattgggatttttgctgactcaagaaaccttagccaaatttcattgatatttcttcaccattcctctattaacaaagtttaaaaaaagataagaaatatgaactcaaagtatacttttatgattactattttttaaaatcacctatttttgtgactgctttattgaaacactgaatcacttcatgtatctgcctagtgactcaaaaagtgttattacaattcactttaaatgaaagtgccactcacaatcttgataattaatgcaggtaaccggctgtgtgagaaagttaacatcagccttaacctcatgcactgaactgtttttcacatgtcagataggcatttcattttgaggaaagccatgtttttgttccttttgtggttggaatttataattaattatacaacatggagatgctgtattttaattataaaacattttaatgtggaacacatgagacctaggatacagaatgtagcaatcaagttgtacaacaaataatcaaacctctaattatgaaagctacagtggttcctgaaatctaaaagcaaaagtcacaggatggtttatttaacaatagaatttattatattttatatcttcttcaaagcttactttgtttttcctcttataggaaatcctttttacctacatagaaaagttacgttattggaatttacatccctcctccataagaaaaaagacatcttctcttccaaatgtccaccatgctaattttatctctttcttattatatttaactttaaaaatcttgatcattataattgctgtgggtcgtatattcactgtgaatattctgtgagagatgacagttttattcttaataacctgcatattaagaatcgccatgcctttttcatggttagtgttcaatccacatgttaaaagaatgaaaaatgcattactgaattatcttatattacccttttttgcagaatcattctttgtagtgttagtgaaatatgccgaatattaaaataggaaccaaactttttataaaatgctgcctctgctgtctcacaatgcctaatgctacctctaaacgatagttattattcttttctgtcatataaagaaacatagtcatgccaattggttttttgccactatatatccagtgggaatcacacagagaatcaattcattacaatgataaattacaccattaaatagtatattatgccagaataatctagaaggtcatgaaagaaagattaagagatgacaagagaatctacaatgtgtaagaaagtgcatgatacatgaaaaaataggttttggtttgatatctaccaaatatgttaaatgaatatataaccctgtaaaaattgaaaaattacatacttgtaaaatcagaataaaacttgagatactcatcttttgtataacttacatgaaattgtaccaagtgatgactttttaaatacagttctagttatttcatatttctactcaagtaatgtggtttgctccataggagttatttgaaaataaacctcttttcaaatgctcaaatctattattgttctgtcagttgtgcaactcataaatactctttcctattctcttcaaaacacagaagtaatattaaaatcagtgggaaatattcttagacaagtcattgatacaaaatattaaacatatataaaaagtaaactttaatattcaccatgtatgttattattttatattcaattttataatttgttaacacacaaaagtattatgtcctgaccatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctacgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagtgacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagttgcagggctatatataaaacacggccatctggctcaacaatccatgaagctgattaagcaatacacaataatgtagttaaatgacttgactcactagttaggaccagaattcaagttgcaattccctgtgtgattcttttcttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatctgatactgcattttgtcacaaggaagatgctactgggacaacattctgggatacacagtgaacatcactatggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggagatacgaatgggatataactattcagaaagttatgacactataataaatggtgtccacaactgtaggtttacctaccaaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcacacttttaaaagcaccctataactctaacactaccttgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcagatcacaaggtcaggagatccagactatcctggctaacaccatgaaaccctgtctctactaaaaatacacaataattagccaggcgtagtggcgggcgcctgtagtcccagctactcggaaggctgaggcaggagaatgacgtgaacccgggaggcggagcttgcaatgagccaagattgcaccactgtactccaggctgggcagcagagcaagactctctcaaaaaaaaaaaatttttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcctaggtttctatcaacaccacgagagaaacacaccctccagcctgggtcccagaatgaggcaggtgaggcagaacggcagcagaacagccggctacacatctacagcctaaagcagagctgcctgggccaatgctatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacaggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatcaacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaaagtccaacaatgatagactggattaagaaaatgtggcacatatacaccatggaatactatgcagccataaaaaatgatgagttcatgtcctttgtagggacatggatgaaattggaaaccatcattctcagtaaactatcgcaaggacaaaaaaccaaacaccgcatattctcactcataggtgggaattgaacaatgagatcgcatggacacaggaaggggaatatcacactctggggactgtggtggggaggggggaggggggagggatagcattgggagatatacctaatgctagatgacgagttagtgggtgcagcgcaccagcatggcacatgtatgcatatgtaactaacctgcacaatgtgcacatgtaccctaaaacttaaagtataattaaaaaaaaaaaatttcaaaaaaaaaaaattttgtctataaaacaggtaacaatttgaatgaagaaaacaaaaatttaatgaatggcataaaaataaatttcaagaaaatgaaaggtgtgtatgatgacttaattaaaagaatgtaaaggaaaaaaaaaaaaaaagattttccagagtagctacttgtctctgccatagaattgttagatagtttactgtaggtggactgtaaataaatgtttgcttagttctaacatttgactgatattgggttgatcctttgagacttggtatattgtggatatgcctaaagtttctttttctaccaaagatgtgttgtaatctatgtcattacagaagtaggagagggaaggaaactaccattaaaatcagtacttaggagcccaggcactgttctagatgtttgcatatattaatatgatttcatttcatctttacagtaacctagaagaaagatatttaaataatgactttccagatcaaaaaatgagttttgatggcttttctcagttttcataattggcagaactgatttccgaatcctttaagttgatcagttgacaggaatgcatttatgatttttatcttttcttttggggttacctttcagtttgactttgaaggatcactttcccctgtcattgcgcccaaaaaagcaaggccttctgagactggatctgatgatgtaagcattattatttcttgctaatataaattaatttatggatattcatactattcttccacttctgtggtattcctatcaattcctctatctttccaacacctttcactttatttattttaatactgaatagcaattattttgaagagtaggatctgttacattttctatggtctttaatgattatccaaaaattaatgtatgtattactgcatgatttcagtttgggtttgtagacattttattatcaactgatcacctgaaatgacagcatttaccttttttatgcagtgttttttaaattaaggttctcaatcgtatcaggttccatggtatattccttttttttttttttttttttgagacggagtatcgctcttgttgcccgggatggagtgcagtggcacgatctgagctcactgcaatctccgcctcccaggttcaagcagttctgtctcagcctcctgaatagctgggattacaggcgcccgccaccatgcctggctaatttttgtagttttggtagagacagggtttcaccatgttggccaggctggtctcgaactcctgacctcaagtgaccttcctgaccttggcgtcccaaagtgctgggattacaggcatgagccactgcacctggcctccatggtattattcttaagtggtccaaatatgtttttttaaattgtggtgtaatttacaaaaatgaaatacatcttgagtttacagtttgatcagttttaatatatgcacactcatgtaacctacactcctataaagacacagaatatttttataactccgtaaaatttccccgtgcggtttttttttttttttttgagacggagtcttgccttattgcccaggctggagtgcagtggcacgatgtcggctcttcacctcctgggttgaagctattctcctgcctcaacctcctgaatagctgggattataggcatgcgccaccacgcctggccaatttttgtatttttagtagagatagggtttcaccatgttggtcaggctggtcttgaactcctgacctcgtgatctgcccacctcggcctcccaaagttctgggattacaggcatgagccactgggcctggcccctcttgctgtttttaatcagctttattctcttcttctagcaatcactgatctgaattctgtcaccatatcttagttatgcctgttctagaacttgatgtaaataaaataatatagtatgtaatctttggtataagatttattcagcataatgcttttgagattcattcatgttgttacagatacccgtagtttgtgcttttttattgctgagtagtatgaatataccatagtttgtttatccatccttcttctgctggtagatatctaggctatttccattttttttttaagtcttatgaataaagcaagctactgccaaaattcactggcaagtctttgtggatatatattttctttttttggggggggggaggacagagtcttgctgtgtcatccaggctggaatgcagtggcacgatctcggctcactgcaacctctgactcctgagttcaggcagttctcatgcctcagcctccccagtagctagaattacaggtatgcgccaccatgcctggctaatttttgtattttcagtagagactggattttgccatgttggccagcctggtctcaaactcctggcctcaataatccacccatgttggcctcccaaagtgctgagattacaggtgtgagccaccatgcctggcccgtggacatacattttcatttctttttttttttttttttttaagagacagggtgtcactcttttgcctacgctggactgcagtgatgctatcgtggttgactgtaatctcgaactcctaggctcaagccatcctcctacctcagcctccaagtggctaggactaccggtatgctccatcatgcctggctaatttttaagtaagaccagttgtctaccaaaaaaatttgaaaattagccaggcatgatggcacataacctgtagtcctagctacttggaggctgagtttggaggatgttaaacactctttcatgtgctcattagctgcttatgtatctttttgtgaagtttctgttcaaatctttatcaacttgtaaattagattttaaaaaatatgtaagctggtgaagttcttacatgttctagacatgaattcttgaccatattttcccttagaatgtggctttaacagtgtctttgatgagcagaattttttattttagttatccaatatatcagttttttattttattttattttatttttgagatggagtctcgctctgttgcccaggctggagtgcagtggcatgatctcagctcactgcaagctccgcctcccaggttcatgccattctcctgcctaagcctccccaatagctgggactaacaggtgcccgccaccacacccagctaatttttttgtattttttttagaagagatggggttccaccgtgttagccaggatggtctcgatctcctgacctcgtgatccacccgcctcggcatcccaaagtgctgggattacaggcatgagccagtgcacccggcccagttttttcttttatggttagttctttctgtatctagtccaataatttttaatttagaataacacactgtattaagccttataaaaacaccagtaaattccaagatctggaaatagcataaaccacattctctgaaccaaatgcagtaaatcacaagtagaaccaaaatagactgaacatttggaaaatgtagtccaatcagtctgaatataaaaatcagttgattattagattatattagtagccctggcatcttatacatgtggaaagatgaatacaccagatgaatgcaggtggaccttccttcttaccaaaacacagttcagtgtagtggccactaacttgccatctacttttcctataaaacctagcctgagataatcttaaattttctctctcaatctctacctaaatagtataattcttctcccaatgtctttcctaaaagggcatgaaaagattttttttaatggtttttaaaggtggcttgccttaacgtttataactggcttgctattttatagttacttcattcttagcattgtcttttttttaacatactcttagatcaacttaatgtgaaaatgaaacttgaattgttttaagtgaattaattttcttatgatattataaggaggtattatttttaaaaattaatattctttttattcttctcaggactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaattttttttgttcttcaccttgtgtatgaggagcttaagttgaatactctaatgggagaaggaatttgttcactcgttgaacttctcgttcagttggcaaggtaaatttgtttgtaggttagaaactgccaggaagtcctgagatgactgtcttttccatgatatcatatagggaccttgtaaatacgtttctgaaatctgccttctcagaaaactaggacatctctgtaaaccacagagttgtttgaagatactggttttgtaagggcctgtgagccatgcagggatttttagtctttgtcctgagattagtggaaggtcacgaaaaaatggagatgacctgctcagattttcattttgacaggatgactgactgactatactgtggtgggagttctagaataacatctgctgttttgtaatatccacattcaaatagtgctttatagttgacaaaatcatagtttacatataaagtctcaaacaaggtaagtttcctattttagtgatgaggaaacttgcctaaatttgtttcctgggatatgagtgtttgatagttgtggactcattttgctatgctatccttgttgcagtctgaggttgtccctgtctttgaggcactcatagtagatccacaataagatagttctaataatacgtttcaacacctttcaagagctttgaagcaccttgtgtatggctcagaattctagggtcatacttgtgtgttgtttgacctttatgacctttggtgataaagaagttgaatttgaattgaaatgtcagcctctgagttaagacatagtacattttctaatttctgttgtcttttttgagatcttgaaattcaatcctgagacatggcagttttaatcaatggtaaatatctcttaggatgtcattactatcatcaaaattattttgtaattaaataatttccaaaccataatcatggctgtctgaaataagtaatgtgtatgatgttttacattttatcaggttttttttttttttacatattttatcttatttactctttaaaacttcagagtaagtgagctgatattgccccatttcctagaagaaaatactgaggtttatagacatgacttatggaagatcacacagctaatgaatagcagaggaggaactagatcatggtgcttttactgtagttttacttccacaaaatttagcaaaaagaggttgggttccatttgtcacactgggcactttaaagtccaaaaatacaatagagagactctagatttggttatctttctcataagtaagtttttaaatttaaagattcaactaattaatccttccaattctgttgggagaaagtgctgtaataccttcttttttgcatgcccttactgttttagggacttaaaattggggccttatgtagatcattactatagagactacccaacgcttgtcagaactactggacaagtgtgcacaattgatccaggtaagtagtcgtgcttttaaatattttctaaacagtgtagtgatatttccttgtatctttctcaatgaatagcagaggatgtatttcttaccattagcttctaagtcaggggcaatgcctttccaccaggcagattttagttcgtagtgcttgttttctgacacgtagtaagccataatatcttcagtgtatagggaaaattttacccatccctaaggttctgacttgcaaaagtcagagaaagagcttccagtgtcaaggatgctttttttttttgagacggagtcttgctctgtcacccaggctggggtgcagtggcgcgatctcggctcactgcaaactctgcctcctgggttcacgccattctcctgcctcagcctcctgagtagctgggactacaggtgcccgccaccacgcctggctaatttttctgtatttttattagagacgaggtttaatcgtgttacataggatggtcttgatctcctgacctcatgatccacccacctcggcctcccaaagtgctgggattacggcgtgagccactgcgccaggccaccaacttagacttgtagagtacagttagtaccactaaccatatgctacttaaattcaattaaaataaaacatatatttcctcagtgtactagccgcattttgagaactcagtagccacatggggctagtgctaccatattggacagtgcagatacagacacagaacatttccatcactactgtactgtcctagaccctgagctaaaggtactgaaatttggggcccagttgttggaacagagctgaatcctggatgtttcttttgtttttttcacctttagggttagggcaaaatttttggttagattcttcttcttctttttttttttttttttttttttttgagacagggtctcactctgtcacccagacgggagtgcagtggtacgatcttggctcactgcatcctctgccttccaggctcaagcgattctcctgcctcagcctcccaagtgcctgggattgcctggggttataggtgtgtgccaccacgcctggctaatttttgtatttttagtagtgatggggtttcaccatgttggccaggctggccttgaactcctgacctcaagtgatccacctgactcagcctcccaaggggctgggattacaggtgttagccaccacatccagcctttggttagattctttatatgccttgggaacaagaatttgctaaatttccatccagggtgggataaaatagaagtcatttaaattctacatttaataacatagttccttatgtgctgtggcagaaaacatgaagcattttggagaatatggaaaaacgttattccttttttttttttttttttttttttgagacagagtctcgctctgtctcttaggcatgatctgggctcactgcaacctccacctcccgggttcaagtgattcttctgcctcagtctcccaagtaggtgggactacgggtgcgcaccaccaggcccagctaatttttttcgtatttttagtagagacggggtttcaccatattggccaggctgttctttaactcctgacctcgtgatccacctgcttgggcctcccaaagtactggggttacaggcgtgagccactgcacccagctggaaaaatattattctagttgtttcaaaatgacaagtaactgttgatcatcttccgtttaaaataaaataatgttgtcttaatgtattttcgtgtctttttgaatatttatctaattttaaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttggtatgtatgtggagtgttactacctatctcctttttcttttaaaatttagttttaaaaagtacacctaatattaagtttttctttctgtgtatagttctgtgaatttcagtacatgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgccatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgcagatattttcttgtggtttctaccttgtcttgtctcgtcattctctaaatacatcaaagaacaaaagtgtttaattttgatgaagctagtttatctgtatttttctttaatggatattgctttcagtgtcatgtctaataattctttgtttaacttcaggttttgaagattttctcctgggtttctttgcatgttttacatttagatctctaatccattttgttaatcttttataacatgtcaggttttaagtcaaggtttttattatttcatttggatatccagttctttcagcactgttttttgaaaagactatccttcctctattgcatttgcacttttgtcaaaagttaatttggccacattcttgtgtgtctgtttctggactttctattctgtttcattgatctttgtggctgtctacgctgtcattactgtagctttatagtaagtctttaaaattgattagcgttactcctcccttcattactcttcttgccttttcatattgattttatttttatttttatttttgagacagagtctcactctgttgcctaggctagagtgcagtggagtgatctcagctcactgcaacctccaccttctgggttcaggcgattctcctgcctcagcctcccaaatagctgggattacaggatcccaccaccacgcccggctaattttttgtatttttagtagagacgggatttcaccatattggccaggctggtcttgaactttcaacctcaagtgatccgcctggctcagcctcccaaagtgctgggattaccggtgtgagccaccgcgcccgtcccctactgattttataatccgcttgtctatagctacaaagaaaaatcttgctgaaatttttttcaaagaaacacttctttatttatttttattattttttatttacctctagctgcaaatctcatgatttatttatttttagaaattagtttgttattactggttaatacatgtccaagatcaaaccttcatatagaaccatagggctgtaacggtgaatgaggtaagtttcttggcatacctgttcctcagtccccccatcctggagcagcctgctcataggccccttgtgggccttttcaggtggggtcttcccaggcttgcaggagaaccatatgcttttgtcccttctctcaaatgttggcagactgcaaatgtcttttcctcctgcccttctttttctttactttacgttttgctccgcttcatggtgagaagtgcttcagagtccccccatggctccaaaacagacatacagaatgaagattctgtttaaaaaacacagatttttttaatgatagcaaaatatatataacataatatttgtcattgaaattgttattattattatttcttgagatggagtcactctgttgcccaggctggagtgcagtggcacgatctcggctcactgcaacctccgccacctaggttcaagcgattctcctgcctcagcctcccgagtagctgggattacaggcatgagtcaccaagtctggctaatttttgtatttttagtagagatggggttcaccatgttggccaggctggtcttgaactcctgacatcaagtgatctgcccaccttggcctcccaaagtgcaggggttacaggcgtgagccactgcgcccggcctgaagttatttttgagtgtacaatccagtggcattgaatacgttcacattgttatgttgccatcaccactgtccgtacccaagacttcttcatcatccccaacataaactctgtacctattagagtgactccccattccccttccttccaggccctggtaattccgttctctttcttatgaatttgtctcttgtaagtacctcatattatgggaatcaagcaatatttatctctgtgtctggcttatttcacttagcataatgtttccaatgttcacccatattgtagcatgtatcaaaattacattgttttaaaggcagtattctatatagtattccattgtatggatataccacaatttatcatttcacctgatgatggacatttgggttgtttccaccttttgactgtggaatagtgctgctgtgaaccatgggtatgcaaatatctgttcaagtctctgctttcagttctttttaatatatacctggtggtggaattgttgggtcatatggtaggtaattcgatgtttaactttttgagaaactgctaaactcattttcatagtggctataccattttacatccttatcagcaatgcaagaggaagggttccaatttctccacagtcttgccaacacatattattattttctatttgtttttttaaaaattatagccatcctagtatttatgaagtgatatctcattgttttgatttgcctccttaatgattagtgatattgagcatattttcatgtgtttattggccatttacgtatcttctttgaagaaatatctatgcagatcttttgtgtatttgaaaattggatttttatttttgagtttaggcatttttatgctctagatattaatgtgtcagatacatgatttgcaaatattttctcccattctataggtttttctgtgaatgtcttttcagtaaaactggcatgagtgctcagtttacctctctggcctttcatcttagttttatcctcttggtattcctttataacttgtcagctcagagatctatttataaaaatatgaatttatttttatttataaaaatattctgaaaaatatcaacagaagcccttattgataggtttttggtttcgtcattataagttttattggactttttttattttttattttttttatttgagacaaggtcttactctgtcacccaggctggtgtgcagtggtgcaatcatggctcactgcagcctcaacctcccggggctcaagcagtccttccacctcagcctcctgagtagctgggaccacaggtgcacaccatcacacccggctaatttttgtatttttagtagagatggggttttgccatgttgcccaggttggtcttgaactcctgaccgcaagtgataaattttttttatgtgatgttagctaatgagacatttgtagtaaccttctagcttatggtggctctttttctattgactcacttgtatatgcggagatggcattgtctgtgtaccatttgttgaaatgagggaaaggaaggaagtgagataacatttattgggagcctgttgtcttcaaggaacttcatgtatgttttctcatttaatacagagatcttatgtacttttgtgtttgtgttatatgttgaatattttaactcttttgagagactttttccttggtcttatctttttcttttcctcctcaaagcaaataccactacagctctgtactactagatacttcttagatagtgagagagcactattcgatacctgttggaatgactgaaaataacttttggtgaggatatggagcaaccgaaactctcatacattactggtgggactgcaaaagtggcacagcactttggaaaactgtttggcagtttcttgtgaagttaaacatacacttatataagacaaattccaactgcttggtatttacttaagagaaatgaaaacatatgcctacataaagacccgcatgtatgtgaatgtctttggggccaggcgcggtggcataatctcagcactttgggagaccgaggagggcggatcacgaggtcaggagatcgagaccaacctggccaacatggtgaaaccctgtctctactaaaaatacaaaaattagctgggcgtggtggcgcatgcctgtaatcccagccactctggaggctgaggtgggagaatcgcttgaacccaggaggtggaggttgcagtgagccaagattgtgccactgcactccagcctggcgacatagcgagactccgtctcaaaaaaaataaacaaataaaaaataaagcagctttggtcatagtgaccacaaactggaaccaaatgttcatcagtttttgagtaggtaaacaaagtttggtatgtctgtataatggaatactactcagcatgaaaaggaagaaactagtgatccttggagagacgtgaatgaatctcaaagacgtatgctaagttaaagaagtagcacgaaaaagactacatatcatatgattcattcacatgatattgtaggatagacaaaactgtagagcaagaaaacagatgaattgtttccagtgctgggtgtaggaggaaaggattgactacaaaaggaacgagggaactttttggtatgatgaaagtatactatatgtgagtgtggtagtggttatgtgatataacatttgtcgaaactcacagagctgtacacctaaaatggacgaattattctatgttataattattttctagttacacttcaattatgtagctaggtgtggtggctcatacctataatcccagcagtttgggaggctgaggcagaaggattgctcgaggtcatgagtttgagcccagcctgggcaacacagcgagactctgtctttacaaaaaataaaaataatataaaagaattagctgggcatggtggtgtgtgcttgtagtcctagctactctggagactgaagcaggaagattgcttgagccaaggagtttgaggctgcagtgagctgtgattgtgtcactgcactccatcctgggtgacaaagtgagatgctgtctctggaaagagaaaaataatgttaattttcttcttttgcagagtattgcactgtacatacttggtgatgagagctcggtttctgatgaatcctcacagtatttaaccagaataactgtaggtaagttggtgcaatgttgcctctggaaacaaatttttgtagatgtcagtatcagaattgaaaaaagaattgaatttttcttgtttgctttggcggccatgtcttacctttttagtactgttctggtctgttgcggtctgttgtccacaactaattttcaggtatcaggattacttaaaatctaataaatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaatccatatgcaggttctgcagggccaattgcaggacttgagcatgcagggatttgggtacacatcgggtgtcctaaccaatcccctgagtattctgagggccttgactgtacttttcagcctgccacagtattgcttattttattatttttttagatgttgtttgctaatggattcttattttcaaatgtcttctacatgttacatgttttctttaccaggatgactatcaaaattaagtttcattttgttgccttttagccccccagaagttgcaagcagaacaagtggaaaacaggtgacttttatttagactgtgcttttatgtcagacacttaaaacaatattatttactgttctgcttaattactttatgttttattctcttataggtttagtttcaggcattctacgtctgtttctagtctagctgaaagattggttggctggatgactaatgtaggtgagagcttctttgttacctgctaactaggccgtgcttcctccagactagctagaagtggaaggcatgaggagagaggggctctggctttgtgaaaaggcctcacaagattgagattatggttcatcaagccatattcttttttctcgacaatctcacaactttcatataataatatgtgggataccagctttttatcttggtgcataaggaatctttatttgccattacattggaacatttgaggctatggctatgtaagctggtctctgagaatggagaactctaatcaccctacatatacacctgaaatcattgtgatactcagatatcagaaatgggtggttttggcaaagtctaaaagcaataatataaacatttcagggtatacttttgaaggataaatgcacttttgaagggatttcaggcaccaagatgaacattgaactgggaagaggaagaggaaggaaaagcgttctatattccctattccccaaacctatgctcctaggttttaaattaagtaaaataccaaagaaattttttttcacaaagaactgaaaaacaaaattaaaaattactgccacgaagacatgattttaaaaatgaggatattatatgggatgtatgttaaaaagtaaagttttaatgaatattaaaagatgtttttgaagtcttatctaaagtatgttctaaatgaagtttctgacaggtttttttttttttttttttgcattttaccttaaaaatgacaataactgttgcgtagtatacatacaggatacctatgctgaaaaatattggattagttctatccatttgtatattgcataatatttaataagtgttattctcatataaggaaacattttttgcctcaatagttaatcgactttttatattataaataatgcatagtattataaaatttagaaaatcatgataagaaaaacatgatttaattaacctgaggataaaaaaatttaaatatgaaatatggtatacttacaaaataatatgtcaaacgtatatgtttagtttagagaatggtactaaagtgagtattgatgtactggtcacccacccctagaaatagaacattacccgcatagtagaaggcccttacatatctgttcttggatggtcccctcctgtcacacaccccaatgttatagtgaaccactgccctacctacatttgtgttaccttactcttgtttttctttatagttttacatctttataaattgctaggttttatgtagttttgaaaatatatagatgtaaatatatgttcctttttcttcactcaactttgttttttaaagattcatccatgtcgactcacgtagcagtagcagtgggtcattcattttctctgatatagagattactttgtttgaacatatcacaatttaattacccattctgttaatgatagacaatcggacttacccctttctccatctctttttttttttccatagcaaaccagtattgctaatgaatatttttatacctgtgtcttggtgtacctgggtgtaagtttctatatggctgttgatggatcaaatgggtggactgacctatacataccaactgttttccaaagtggttgtaccagtttacactaccattggctatggataagaattattgttgctcgggccgggcacggtggctcatgcctgtaatcccagcactttgggaggccaaggcgggtggatcacgaggtcaggagatcaagaccatcctggctaacacggtgaaaccctgtctctactaaaaaaaaactacaaaaaaaattagccgggcatggtggtgggcgcctgtagtcccagctactcgggaagctgaggcaggagaatggcgtgaacccgggaggaggagcttgcagtgagccgagattacaccactgcagtccatcctgggtgacagagcaagactccatttcaaaaaaaaaaaaaaaagaataaaaagaattattatcgctctacatagttgccaacacttggtattgattggctttgacatttacatttctcagtggctttaatttgcattttcctgatcactaattaggtagagcatcttttcatatgcatattgcccatttatgtttccccttctaggaaatgtctttttgtcttttatatttttctattagattgtctttttttcttcaggtttttacaagttctttcaaagagacttcctatactagtccctgatgttaagacattagtctggtagtaagaggaataaaatgaatttatttgtcaggatagatattgttgccaacttcagctaggataattgggacagtggcaagtctaaattaaaatgtttctctcttcctttaaccattaggattcactttaagagatttggaaactcttccctttggaattgctcttcccatcagagatgcaatttatcactgtcgtgagcagcctgcctcagactggccagaagctgtctgtctcttgattggacgtcaggatctttccaagcaggcctgcgaaggaaacttacccaaagggaagtctgtgagtatcaacatagaaagttcagagttccaattttagccttaaataaaatcataaagtagaaatgttcttcattttcctttaaggctttttctaagtatatatattagcttgtcttttatattatatgccagacggggtttgtaattgtatgcgtcttattaattgttaagttgagcataggagcaggagattttgtgaatgttctgtcttgtgcctggatctttctttgccttgaatcaggacaagtcctgagtgtagtcatggaaactaccatggctatttccctacttgtaccatattagtaattaaccacttcgtaattattacataggaaaagggagagcacatatatcctgaatttggatgagtaattatatataaatattttctactgcatatttttcgatgtgttgaattttttgaatttaaccttttaaataggtgtaaacatatttatttaatcacataaaactgcagccccagggaaaaaatgtgtttttttagtagagttgtttaaaaagatgtcttaagctatccctcccgaaatactgtctttcatcaatcatcaagtctgtttttttttttaaatgagttctaggaatcctgcaagtagaaagtaaaattatttcattactctccaattatctttttatatcatcctctcttaaaacttgaaaatgaaacttttaaaacttattctagaattctaggtaactttaaaaaatgaacagtagaatctcatcaaggaggattcaggaataataattccactcctggtgactcttttatgttcatgtccctgagaagacagtgggaatttggtcttacctcttagtagcttttgaatcaatacataataatcagtgcattgtaactatgagtcaccttaggtcttattactacttcttcagagcctatatcaaaacttattcctaacctcagagttgcctaatgtgtacccatgccggagtcagtttccatgggcatctgatctccagcacggtcatcccagcacgtctctcctttaatctgcgcctcaatcacagctcttcgttgaattagtatttacatcctgttttaaacagaaaacaaatctttttgcttataaaatgattttcctgtgagagagagcagttcagcaccattagcattaaaatattaatctgtatttgaatgtcattttaagtaattatgtctaaatacagtttgttcagttgaggctacattttataactaatcccatctaaatttattttgtcactgtttgagactatgttttatagctaactcacccattagaatatagtttttttttttaaattagatattttataggagctaaaaatgaatttttaggaactaaaagtgattatttggtcgtatctacttttttttcaggctgaccttgttggtttcacattaaatgttgcaaaactttaacatttcaacttggagttattcttttgttaaaagagtataatactgtttttgagagaatatgatatgattccacgcaattcacatctgtgttgcagttagatttaattatttggactgggaagccccatattaaagcacatgctgggcttagaacatgatgacaatcaaggaatttaccctcttacttgttttgctgtagttcagtacttttccttctaagaaatttttattggaaacacattttttaaaaatagtgaaaactggctgggtgtggtggcacatgcctgtaatctcagcactttggggtggccaaggcggaggactgcttgagcccaggagtttgagaccagcctaggcaacatagtgagacctcatctctacttaaacaattttttaaaaaatttagccaggtgtggtggtatgtgcctgtagtcctagctatttgggaggctgaggtgggtggatctccttgaggtcaggagttcaagaccagcctggtcaacagggcaagactctgtctctacaaaaaataaaaaaaattatctgggtgggcggtgcacatatgtagtcccagctactcgggaggctaaggttgaaagcctgcttgagcccaagaggtggaggttgcagggagccaggatcacaccactgcactccagcctgagtgacagagtaagaccctgtctcaaaaaaaaaacaaaaaaaaacttactaatggaatccaaccatgatcctgtctatttaaagtagtaaagtaaaaggtatttcattgtgtgacttcccccaacccttggggtatatcctttcaggcttttttccttctccttctattaatgaacagacaatatttaaattagcattattagcagtgactagtattcatattctacttgcaataatttttttttaagaaatgatcaggatgtagttagatttttttttatagtttattcagaatatttctctgttcgtatccagccccttgactgttgccctaaatttaaactctccccgtcatttccaaatatttccaagtaggcaatgtagtacttttgtttgtttgtttgtttggtttgtttggttgtttgagacagaatctcactctgtcacccaggctggagtacagtggcacgatttcggctcactgcaacctctgcctcccgcattcaagtgattctccagcctcagcctccccagtagctgggactacaggtgtgcaccactgcgtctggctaggtaatttttgtatttttagtagagaccgggtttcaccatgttggccaggctggtctggaacccctggcctcgggtgatccacccacctcggcctcccaaagtgctgggattacagagtgtgagccaccacacccagccagcaatatagtactttttagaaagatttgtagattagagtcccagtatacattgcggccccaacccaggcctgctttggaaaacatattttctctgtgctagtatagtcatgacacatcagcctatatatcctcatgttcagcaaatgcacgttaactgcttttgaaattattattataataaatctgttactcaggtgctctcatcagatgttccttcaggtacagaaactgaggagaaagatgatggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacaggtgaaagaaaacacgtgtactatctcttgtcacgtttcattgttacatttgtgtcttgtttatatttgtttttccttcaagtttttagcatttaaaaccctaaagagatttaaaagatactttcaagtgaaaatatgccctgtgttttaagttttcatccaacttcaacaaaccacgtgtgttagcaaaatgtctttggcttttgaggacgtaattgttgtatttcataccgtcctcctcttgaaatacatataacagtttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttatatcagtattttttttttggatatgatagataatactccaaataaaaatagataagcctttcttctgccactcccctgcacaggatacatcccctgatacattgtaagactcacatgcctgtgacattccagagctattctcttgggacacttctattttaaaattctctcctgttcttttatctgcttgtctctatcatctatcattcatctgtcactgttttctagttctctttactttttttatggtactgttttgaggggaaccgtcacccacacttagccacaggctgctgaagatctgaattagttgtgatttccctattaactgtttcctctccacaagtacccagttattagtcacctgtgaataaaaagatggagtgacagaagttgagtttagagcataggatttatgagcatggcctctagagccaggcatggccatgctgtgctgggtgactggttaaattactttacctcttgttgcctcagttgcttcatctgtaaaaataggcatacttcatgggatggtgctgtgtatcaagtgaattatttttacatagcacttagaatactgctcaatacatagtaaagctcagtgcagtcagccattattagtagtagagttcattgattctaagatgcaagttttttcactttttaatatctctgaaatcagatgtgtatttcagtgaacaggtgtcatagtttaactggcagtgctttctctttcttagtttctcatgaaataatgatacatcttatgagtggcatcttatattcaggggatataatattgttctcattataattttgttacttgtgcaaagttgaagtgaattatgtgtaagatttcctctaaaaaaattctatgggttgcaacagactcttggctttgaattttcctgatcccaaattaatgtggcggtcatgttcccagagaatctttaagacagcaaaatttttctctccagttagctagaaaagcagttatgtgtgtccagttaaggagggagtatgcttatgaatagctttgtctgcagagaaaatgttcgtcagttgtcagcctctgaagggatatttctgtgtcttcagatataacttgtataagcgtttcttagttataaatgccttacttccaaaatttctgttagttttttttaagtggatatatggaatgttaagctattttaacagaggaacaagttgaagagtggtatattaatttcacagtagagccgacagaaaccattttaaccttgaacatacctgatacataatggtattagtcctataaacctagccatcatgtaagtgaaaccaatctgtatttcccttggagacaccatgaaatccattcacctctaacatagggaccttgtttcttttcttgtgtacaggccacagaaatggtacttctgaggctgtattggcaaaagggatgggaggaggatcccacatgtactgaggacagctagactgaaattaacacagtgataaaaaccccaaaagtactgtattttcctttgagaaggttagcatccatcggagtggaattttaaatttcttttgtttttttgaatgcctagagagagtcggcttggtttataggccaggtggttttcattcaatgtaaatatgaaacaaaacagaggaaatatgtctctccctaagagtgtaataggaacaagaatattaaaatgaaaataatcatgtttgggtagttcactcacatctgtgtatgaatttactttgagacaacttcatcttacacagtacaccttcttttgaaatacttacagatgatatttcaattgcgctttgctttaaacattttcacatgttggtttttactttaattacagattactccaattgtgtcagcaaactatggctcttcctgtaggacgaggaatgtttacctttttttcgtaccatcctgttccaacagagccattgcctattcctaaattgaatctgactggtatgttaaattctgggctcaatgagaaaggaaagtgattaagtacatgcattaagtgtagttctttaaattagttaaaacaaaagaaatgctccctctatccccagtgattttaaattttcctaatagctgctatagtggttatcaaagctcaaataccatgtcaaactaaaccttgagagaagcagaatatagttcgttactcatttttgctttttaatgaggtgatttcaagatatacaaagtcacttggagaagttcagaaagatataattgataatgatgagactattgaattttaaataatcttgagtataatatgtaaaaatatttagttttaaaatgtcttatgtcatagtttaaacagatgatcattgtataaatcaagaaatgtcctaagcaaaaagagaaaaaatggtcacttgcagtactcccactcttctgcatcactccttttaacattttaatatatatgtttactaagtttatttccacatatttataattttatatttgtttaattatcagaaaatttaaatctattttagatattttttaaaatttacagtgaacatccttttatatctagcaaataaatgtatgtgtttataattatgtgtatgtattgtatacacgtgtttttaatcgatacattcatttttatttgcttcagagtatttcattcagtggatataccatagtttatagaagcagcctggtattgttggaaattacagttttttggtattataaacattgttggggcgtattcgtcctatgtatttaggctaaatgcttagaagtagaactcttaggacagcaagatgaatggttttaaggaacatgtcaaattgcctttctggttggtgcaagtttttatttctgctatgtataactgtagttatagtcttgattacaatgagttttttagtgtatgtccgcctaatgctgatttgaatgtgttctaaaggtgacaattacatagttgaaattatcattgaaactctattatagtatatatggttttgtgaaacctatacaaaatgtatgtgtaatgtatgttgtagtagtgtatagtatatgtagtagtatataatgtataatttaatatatgataaatagtacataatatatgcaaacataattgtacagtattttaaattgcatactttaaaaaatccagagttccactcagatttgtgaacagcttgtgctttgagcagcatgcaggaaatgagattgactaagtgaagaacacattcccatctccatatcatgcttattctgagccctaatctcactgagggacatagtgagcagagttgcttttaatatttaaattgtctcagaggtaaagcacctatggcaaaattttaacaattattgattcttgatggaaggcatggtatatagatgttcattttagtagtctttccaactgtttatatgaaagatttcatataatgagtgcgggttaaaaaggaaatctaatgcaaaattggcaaatgttaaaatgtattcaatctgggtgatttagcactcaagcgatacttgggtgggtttaaaaaatatatacatgcatctttttttctgaatacatttaattgaatttgcatgatttaaaatgtgtttatgacattaatccaacattttattcttttagtcattctggtaggccaaaaagaaaggttatcctcttaatttaggaaagaatattttcttaaatagttgcttaacccacactgatgtggcctgttgtacttttgtatgttgttattctcattgaagaaaatttaccttaccctttgcattttattttctctcgtgtataaatattatgtcttttgcatatgatgaatgaaagtttcagaaagttcactcagttttttcatattgatatgtctgccttttttgagaaagtgcaagtgtaacttatgaacttattactcattgtggtgctaacactagcagttgagttagcttttaggtacaaaaagcatatagtaaagacaaataagtcttactttgtgctttgtgtgtgtatgtgtacatgctacaaataagacactctgcatctacttaaaatttattttacataacatcttagaactctttaaaaatggtacttttaaagctgcagtgaaatggataactttatgcagtaattaaaatatttatgttaattattttatctgtgacttaagacagtattcaaaatatatttaaaaagattcagtgtttgctgtgtataatgtagatcaaaaagaaaagaatcaagaaaaaattcgtagggaacatatagcattgtgaacatataatttacattgttcttaaatggaccataaaagtaaatctagtgaatgcccttttgaagttcactgggtgactcaagtctataaaaggatgctttttacaaaactatctctaagcattttaaacaatagcatataattagatatctatatctgtatgtatatagagagagagaaaaaaaagagagaagggggcatatataggtaagagctgtagcagatttattaaggttcttgtgtctttttttttttttttttttttgagatgcagtctctgtctgctgcccaggtgggagtgcagtggcatgatcttggctcactgcaacctctgcctcccaggttcaaatgattctcatgcctcagcctcccaagtagctgggataggcacgcaccaccaggcctggcttttgtcttttcttaagatgtcatttttccttaatgtccaggggaaaatataggatagaacatttgaaattaacatcaatgtcatcagatgttgggatttataacttgtatagtttaacagtgatgttagtcttcattttggtttctaagctctctactgtttgaaagaaagatttcaaagcagtgattatcccagtcatctctgtataatgttaaattggtatcagttatctcattatatagcctcatacattttagcaaaaaggacaatgaactgtttagacagtgatggtttttccagttccattaagtttgactcacatgtacaaaagttttaagtggtcatagagacctaacattccaggcattatggggttaatggttttgaatgtagaaaatgtaagtaatcttagtctcaaagatctaaatttaacaatcttggttttgtgaatttttattctctcagtgttcttcgtttggctggatagggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttagccaatgagtatgctggctttctcgtggctctgggtttgaatgggtaccttaccaagctggcgactttcaatatccatgactacttgaccaaggtgagacctgtgctcccagtgcctggctttgtgccttgcctggctattgtagtagctcctaattgctctatttgctcttctttcttcattcttgtacttctaagtccatttgtctcatagtacgtggaataatctttctaaagcataaatcagagtatgtcacttctctggtcaaagccatttaattaatgatctcccattgcttttttttttttgagtaaggcagggtagaatttaatgagtgacaggaaagctctcaacagcgagaggggacccgaaggtgggttgccagccacgaggctgagtctagaggtttttatgggcttgaaatgggggaagtgcatgctgattggtctgtgggtatgcttgaaaaagcaccatttagaaataggcacgatagtgtagaggaccaactggggaagggcaggtatatgtaaagtaggtgaaggataaggaccaatcaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttcggataggggtgatgactgttctgcttcatgctgacagagggtgttgttttgggaaacagcagtcaggtctctcttagaggcctatctaagtgtcccctggtaaaagagagccatcaaccgaggttccatttgcatgaccacttggagtttgatggcctctaggcgagaaaaaacaaattttacaaggaggttaagtacacatggaccaaatatgagtattacaatgagaacacaaagaggaactaaaagggggaaaatccatgcccatatattagggacacctagaaaggacaggaagaaaacctctgaaaatggactgttctattccaggattttgcaaaatagggttgtcatgggcatgtccccctagattattagatatgttataattaggcattgcaatgcttttaattagatttctgatccataggctgcagaatccagtaatgcctgataatccctttagttagctgagggtcttggggagaaggaaggagaaaatggatccaattctctcctcgcccagtgtcctggtcccttctgacaagaccaggcataggtacttcactgaagtctgacggagttgagccttggactttgaaactttatgtcctctgtcagttagaaaattaagaagagccttattgcttttctgagaaatttcctcagttggggcacagagtagagtgtaatctacatattaagactaacttgagtttgaaagaactcagagagatctttttgagattgcctgcccaaacaggtgggggctgtcttggaatccctgtggtaacaccatccaggttagctgggtagtctggttggagggatccctgaatgcaaacaagttttgggagttggggtataatggtatgcagaaaaaaagcatcttttaattccaagaatgcaaaccatttagttccttcaggtatctaagttaacaaagtatagggattgggaaccactgggtaaattggttaattacaccagttactcattaaggaggtggagatcctggaccagtctccattccctgttgggtttctttctgtacttccaatattaggatattacaaggactgtcgcagggtttaacaaggccctgcatccttaggttattaatgatggcttctagttgtttcctagcttctggttttaggggatattgtctttaattagggaaggagatgagatccctgagatggatttggactggtgagactgttgtagctcagccagtattttcctgaattgcccaaacatctggattaatatcagtctccaccagagggaggcaaagagtctgtcctggagccataaggatggtggttcccatgtgagctaaaatatccctacctcagaggagtcgggctttcaggtatgattaaaaaggcataggtaaacgaaaggtctccctaggtacagctaagggattgagaaaaatatcgagtcagaggctttcctgagacgcccctcacagttgtgctaagggaggaggggaggcccagaatggagaggagaacaggaatggctgctctggtgttgagtaggaagtctgtcctctgagtcctttgacctccagactcacccgggactcctggatggtaatgcagcctgggctgtcagagctggggaggagagccctgggacccatcagtcctgctggaccatttgagaagccggctctgaaccttgggacgtatgtttctggaggcagtttgtcttccagtagtctcccttacagattggacagggccgtgggggctgcttctgatttcgggggcagactctcttttagtgctcccacactgataacagtcggtcatagaatgagaagctccctgggatcgagaggtttatatgcctgtatggcagctattagtgcctctgcctttttctcgttccttttctccctttttcttgggcttcctcatggtcccgattataaaagaccaaggtggtgactttcaggattttctttagagtactgtctggtgcaatagctaactttttgcagcattcttccaatatttggggctgcttgggttataaacttgtctttcaaaattaactatccttttatagagtcaggagagagatgtgtgtttaattaaagcctctctcagttttttccaggaaaacagaagggttctcttcagacccttggtttatggttgataacttaatgtaattgagagatttgcctctagttttcagatcttccactgtgcatccctaaaaatgttttctcggccactttcctagagcagtgtctgagtcccattgaggattattggtggatgctgcctgcttggctgtcagaaagggctccctaatttcttcccccttttggtaggtgccataataagataaacatttcatctccaaatgtctcagtgacctgtaaagccgcctgcttctctgaagctctaagagtctagttgagaagtaacatgatacccttccatgaaagctcagacatttgattaaggttctgaaaggcttcaatatacctatccaggtcgacacaattgtcctagatttctttttatctgcctcaaatcttgtaaagaaaaggggacttgtactttgataggaccatattcactatgcatttcctgtaaaggaagaagtgatgctggagcgcatccaggtcgaactcttctaacaggatgaggttcaaaagggggcctggataagggggacgagatgatccaagaggagctgggacctgggctggtgcaggggcctctgtctcctcttctaaggaggcagactgttttttcccttctgtctggattaagtctggctggatatcactgctataagtgcaaggtctattatacattgctgacagagcttgcggttattctgcagggcaaaaaaggcctatacatatggaattttggaccattttccttctctgtggttgaagagatctagctataggatagtattatagttgttattttccccagctgactaggtctccccatcttccaacttctagctgggccaagccttgctactgataaataccaggtattttttcttcagagtctgaggatcaaaggagtcccaatgtctcgcacttgagaggagtgcaggctacccatttagaaagagagaggggagaaaaaggcatccttagtctttccctctgctgtgctagagtccaaggcgtctctcaggcttgccttggtcgtggatgtgcgcgcagccaccattcatgaccagggggggatcaagccagcaggagtagttgcgttcacttgcactcagccttgaccctccttgtcaactgcctttgatttctctgaattctatatgagctcaagactaagatgaatccgggggggtccctgcatattatttgtctataattctcatctggctggcagtttatttagcttcatcaagcataacccagcatcctgccctgaaaagaagcaatttctcaaagagacacataactaagtaacatttctcagaagagcagtaggaaaaacatgataggaaagattggaagtctttgtccgacacctgaacaggctgttggggactgggggccggtgtagggtccttcggatgtacccttggccagatacctttagttgccccaggaccttattctgatcccacacgatggctgaacttctgtgaagggaaactggtttagaacaaggccaaaattcccaacaccagagggcaaagggggatcgaccattgctcttaatatacattctaggagctggtgtgatcctgttcacttctccagccctaggtggtaccactgttcttcgttttttttttttttttttttttttttttgatgtggagtctcaccctgtcacctaggctggagtgcagtggtgtgatctcgtctcactgcaacctctacctcccaggttcaagcaattctcctgcctcagccttctgagtagctgggattacaggtgcacactaccacacctgcgtaatttttgtatttttgatggaaacagggtttcaccatgttggccaggctggtcttgaactcctgatctcaggtgatctgcccgcttcagcctcccaaagtgctgggattataggcgtgagcctctgcacccagccccactcttcttgctcccccacactctaaccatacagattggctattttagctctctggcaaactaaactctttcacttcacagcgttattttttttttaaggaatctttatttatataaatatataaaattcacataccatacaattcactgtttaaagtgtgtggtacagtggtttttagtacattcacagagttgtgcatccatcaccactgttaattttagaacatcttttcaccccataaaggaaccttgtacccactagtggtgactccccattcctctacctcacccccccaccttcacttcacttcctgccaaccactaatctactttccgtgtctatgggtttgccttttctggacctttcatatgaacggagtcatacaaaatatggtattttaggatgggcttctttcacttagcctgataattttagggttcatccatgttgtaccatctatcagcaatacattcctttttattgttgaataaatgttttattttatgaatgtacattttattcataagttgatgaacatttgggttatttgtactttttagctattacgaataatactgctatgaacatttgtatacatgtttttgtgcggatgtatgttttcattactcaagagtaatgaagtaatggtaagtagtggtacatacttaggagtggaattgctgggttatatggtaactctgttaaactttttgaggaactgtaaactgttttccataatgactgcaccattatacaaccccatcagcaatacatgagagttccaatctctccatatttttgccaacacttgttatattgtgttgagtccagcctcattcttttgaatgtgtccttccacttgtcccagcactgttttttgaagactgccctttacctgttgaattgtcttggcacccttgtggtcagttgatgttaatgtgagggttcatttctgaatcgcctcagagccatttatttacatgctgttttatcacctgaaacagtcttcctcaccttctaaacttgagtgtcctctttcctgccactgttcctggctaatttgttttcatccttcaggtcctaatataaatttctttgtataatctttagagatttcatccctaataatcctctagtccctcccaatctaaattaagctattttaaaatactctttcataatactttgtactttcttattgtactactttttaataatatatttgtttatgttttttaatttaacactttttttcctattaagtcattaggtccatgagagcaaggaccatgtttgtttagtttactgctgtattctcagtgcctctcaccttgcctgtcaacataaaagtacttcttgaaagtggcaggcagtattttattttaaactatgtatttgttttgtttctatcttagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggtatgggattaatagtgctgaatcttcataggcatgtactctccactccacattaacccaattaaatagtaaaattataaaaattaaggaaagacaatggtagcttttgtgagcaaagaatgatctagtactaattaaaaaaaacaacaaaactctaagtaatgttatccaaggctaatgtaactgcaggttattaacctccatgtttatttgctagctcattactgaattccagtggtcacatttaatgaggtacctgtggttttaatcagctatgagtatgctgtttatccggctttaccagcagtgtctagcagtggcctgcacttaaaactcagagtagattgttttggtccctgagagacactaaactaaacacatcacagtgtttactgtgttggataacagcacttccaatagaagtcaagtaatggactcctgctttcctcctttacatgctggtgggtatgttggtgatgaacctggaaatggtaaggtccacacactcactttagtgaacattgtctctgttttttattgggtccaaactttttggaaatcttaatgtgttgtcatctttttctgccaaatggaaatgctattggcattattaatatgctcaacaatttagttacatacttatatgtcctattcaagatcttttctatatggatttgtgaatatattgttaaagatgtattattctttagtatcattgtatcagatagctattgccacagtgatgctacatacatacaggcatagcattggcccaggcagctctgctttaggctgtagatgtgtagccggctgttctgctgccgttctgcctcacctgcctcattctgggacccaggctggagggtgtgtttctctcgtggtgttgatagaaacctaggagagaaccagtgaagattgggacccataatttagtctactataatgataaatgaaattattcccaaagttgaaatgttttggctatcacaatacatggtagcataagtcagagatctgaaaaacgcttattctgaaaatattcaacactggttgttaaagcatgttcatctgcaaagtagtctacccttctttggctatatcatgatgatgtctaatggtgtcattgcacagtctcacagctgcggcatacctctttcacactgtatatagaagatttcatctttaattcatatgtatatgcctttttatataattactgtcagaatgtacattaaaaaaattttttttttttgagagagtcttgctctgctgcccagcctggagtacagtggtgcaatcttggctcattgcaagctccgcctcccgggttcacgtcattctcctgcctcagccttccgagtagctgggactacaggcgcccgccactacgcctggctaattattgtgtatttttagtagagacagggtttcatggtgttagccaggatagtctggatctcctgaccttgtgatctgcctgtctcagcctcccaaagtgctgggattgcaggcatgaaccactgtgccccgcctaaaaattgtttttatagatcattgttataaatgggttttaaaacaaattttgtgtaatattcattgagtcgatggtctgtaaaatgcctttttttaacttttagaactttttagattgtttctaataatcctttgttgttatatataaacattacactgattacctttgtgtgatttttttctttaatttttattatttatttatttatttagagacagagtctcgctctgtcacccaggctggagtggagtggggcgatctcggttcactgcagcctctgcctcccaggttcaagcaattctcctgcctcagcctaccaagtagctgggattacgggtgtctgtcagcatgcctggctaatttttgtagttttagtagagatgggatttctccatgtcggacaggctggtctcgaactcgttgacctcaagtgatcctcctgccttggcctcccaaagtgctgggattacaggcaagggccagcacgtccagccttttttctttttttttaaattgcatttttttcctatagggataaaatttcaggaatgtgaacattttttcagagggaagggttttaatacatagtacattttatcgttttcaacaaggtagtgttagagttatagggtgcttttaaaagtatgaattttgtatccagtcagacttctaggatcagtacacagaaattctaccatagtagggctcattattatatacactcgaaataaatgtctaaacataatatttaacagcttaacaacataagtaagtgacctccttattcattatcatcattcgaacatgtttcaccacatgtgatgtgtggatttgaaagtaatgaaaacaaaatgtaagatatttcgttgttgttgttgctgagatggtgtctcactctgtcacccaggctggagtgcagcgacctgattttggctcactgcaacctctgcctcccaggttcaagcgattttcctgcctcagcctccccagtagctgatattacaggcacctggcaccctggctagtttttgtatttttagtagagacagggtttcaccatgttggccatctggtctccaactcctgacgtcaagtgatccacctgcctcggcctcccaaaatgctgggattacaggcatgagccagcacacccggcccagatgttttaacaaaaaaataaaactttttttttgaatactctttcctttttccctttaaaatttttttctactacttggtaatttttttggtaagactcaaagtttcacagtatttgaatatcattgcttataaagacttaaattggcaatttaaaaagaactattttgggccctttttttttggtaggtaaacctacagttgtggacaccatttattatagtgtcataactttctgaatggagttatattccattcgtatgtccagtgcaacttgctagaaagttaactctaagatttttatgagatgagattttgagaagctagtttgaactgtgttgcttttgtttttacaggacggcctcctggtcctgaaatggaatactgcactgacagagagtcatactccttagctgctggcttggccctgggcatggtctgcttgggggtaagcatagcctatgccttcccatgcttcagttaggacatctacatgttgagacaaataacgttgacacctaaacctgaatattgtcccttactatgacttaatctgctgcccagctctattgtctttttggatatttttcaaagtaccagatttgcaaattgagagaaactgtggtcaagagtgggactttaagatttcttttcctccagcttgcagtgttcatgaacaaactgaagggaataaagttttttttttttaaagcgttcaagacatagaatgaataagtgacagcccactatgactgaaaacagagaatagtgaaaacgtatatgatcgggagccttaagagtctatagtagctgcttgaaacaaaccctaacccccttttgccatagtgatgttcactgtgtatcccagaatgttgtcccagtagcatcttccttgtgacaaaatgcagtatcagattgacccatctttaactccatccaagagatgtgtacagaattaccagaaatgtttcattaaatgattgtttcacttgaaatgtggttccccttgaaaaaccaccaatacattcttatggtcaaactaaatgatataaagaaagttataaggccgaggtgatcggatcacctgagattgggggttcaagaccaacctgaccaacatggagaaaccccatctctactaaaaatacaaaattagccaggtgtggtggcgcatgcctgtaatcccagctactcgggaggctgaggcaggacaatcgcttgaacccaggaggcggaggttgtggtgaatcgagatcacaccattgcactccagcctgggcaacaagagtgagactccatcttaaaaaaaaaaaaagttatagtggaaggaatttttttcatgtgtgttctgaaaatccaccttgtggttgaccatctgttagggccttgaattcacattggcacgtgagctaaagaggctggtggtataatggaaaataatcagctgggtgtggtggctcatgcctgtaatcccagcactttgggaggctgagatgggcggatcacgaggtcaggagatccagaccatcctggctaacacggtgaaaccccgtctctactaaaaatacaaaaaaattagctgggcatggtggtgggtgcttgtagtcccagctactcaggatgctgaggcaggagaatggtgtgaacccaggaggcggagcttgcagagagtcgagatcgtgccactgcactccagcctgggcaagaaggcgagactccgtctcaaaaaaaaaaaaaaaaaaagaaaagaatcacacagggaattgcaacttgaattctggtcctaactagtgagtcaagtcatttaactacattattgtgtattgcttaatcagcttcatggattgttgagccagatggccgtgttttatatatagccctgcaacttaactataatagctgtataaccttgggcttaatccctctgtgccacactttccttatttataaaatagggttttaatagtagctatttgatatggctgttcattcatgttaaacacacagaatagtgcctgacacagagcatgcatttaataaattactattattatcatagttattgttggaaaagttcttaagtacaataatgacagtattcaggtatttacagttccagtttcaattatataactaatatttttctttattgttaaatgtcactaactctaaagctcttatgtattttaagacagtacttaaagttgaacattcatgtattaaaacttttatgagaattattaatatttattaactcatgattaatgtttgctttaaattggaaataaaaaaaacaaaacccaaaataacctgctttgaagttagttcatttttatatttgttatgggtatgtgttgtggatcttccttcataaaatttcttttcactcgtctgttattgtcttttccagcatggcagcaatttgataggtatgtctgatctcaatgtgcctgagcagctctatcagtacatggttggaggacgtaggcgctttcaaacaggaatgcatagggagaaacataaatcaccaagttatcaaatcaaagtaagtacacagcaaagtaatagatcaaaagtctggaagctgggaagttaattggaaaatactagtgttcatactgacattggtaaatgtgttaattttaagcatagttattattcagaggaattttataataatttagaactcttttacatgcataaactcttctttcaataggaaggagataccataaatgtggatgtgacttgtccaggtgctactctagctttggctatgatctacttaaaaaccaataacaggtatttctacccactcacccttcctcccgcggtgatagtgtgatatcctccctgaccttggttgtaaaattcagttatctcatgtgtttctttcccctgtgctggattaagctgattttttgttctttcaagtactgtaagtttttgaaagaaaacttgcagtatttgaagttataaagattttacctggaaataatgtatttggctattttaatggtatttgacaatatagttttcaatttctgttcatttctgttttgtagttgatgtcagtaacacccaaacaatgcccatgtttgttttcattaatttagcatattgctgtgaggactggttaagccagaaatacttatcatttagtgtgatcttggttaccatgtaaaacaatggtttttgcctacttcaggagcttttgtaattaccaaaccgtctaccttcctaacttgctatattaatgctgacgcttgaaagtaagatctttggcatttatgcttacactttgcatgaggaataagttgagtacaagacgttatgtcatgtcttaagtctattaattaaaaacaaattctaagattcaaggagttttcagtgttccacatttctccctttagaaaaagtaaatgtgtgcagaattaacaaagtgtttaaaaatagatatttattactttactatttggatgaatgtgtagggcagtgcttccttggcactggggatatttcattgagcaaaactaaaaatatcttccctcatggagtttatgttatagtaagacatacatgtacatctataataactattacattagaaggtgtgaagtattgtgaaaaatatgtagagctgtagtggagcgggaagaaatgttttgaaatagagcttgagattcttgattgtcttgccctctacttgaacagtgtgccttactgttttcctccaccaccagatctattgcagattggctccgagcccctgacaccatgtatttgttggactttgtgaagccagaatttctcttgcttagggtatgctttgtcttcatttgtgttaacatgagaagtctatttgtggttcttaaacttagcttgtaagccgggcacagtggctcacgcctgtaatcccagcacttcagaaggttgaggcaggaggattgcttgagtccaggagtttgagaccagcctgggcaacacaggctgttctccatgactgaatgaatggcaaacataaatgtctttacaagagagccttttatttttaatttgtcatgcatatctaattggcagtgttcatttgaaatttcacaaataggactttgggaatcccaagaaaggtaaccacgttgatatttaatacttggagtgacatttcactgtctcacattattattcaaaacttcctaaaaagcaacaagtgattaggacttttttactgctttgttttacatttttggattactatcagggatgtgataatactgttaaggttgaatctaaagaaagtaacaattcacttaattgtctaaaattttccctctaattcttttttttctgatgtttaaacgtagcatatagaagcttttaaattatgtgtagatagagctatgattctttcctttgtgatttttttcttttccagagtacattttaaaaagtacccgcacaagccctctaaactttggtgatattcaactcaattttagtttttctttgttaaaatttaaatctttattttaatgagtagtttaatgagtaagacggttcccaacttaggttttttaacttaaccatagtgtgaaagcggtactcattcagaagaaactacttccaattttaattttaatttttttcttgtactcctggcagtatgatgctctcatggtgttgggtaatggcagcaagctgcagctcccagtcagccatgcagtcatgagggtaaatgacccatactctacagtttactatgctgacagagaatttcactcaattataggctaatttgagtgttcggagcatgtttaaggtaggctaggccaagctgtgttgtttggcaggcaaggtgtattaaatgtattttctttttctttttttttttttatgagatggagtctcactctgttgcccaggctggagtgcagtgacaccatcttggctcactgcaacctttgcctcctgggttcaagctattcttgttcctcagcctcctgagtagctaggactacaggcgtgtgtcaccatgcctggctaatttttgtatttttagtagagatggggtttcaccatgttggccaggctggtctcaaactcctggccttcagtgatctgcccgccttggtctcccaaagtgctgggattatagacatgagccactgagcctggcctaagtgtattttcagcttaaggtattttcaacttacaataggtttatcagtacataaccttactgcatttgcatatacttatttttcaaaattctcaacagttgggaactgattcttaaattgttctgtttattattatcattgttataaaatgtatgaactttacttgctctaattaattttatctctgttgcatttttaagacacttgctcgatgcctgattttgtgggatgatattttaccaaattccaagtgggttgacagcaatgttcctcaagtaagtacatataataaatattatatctttagtagcataaaattatgatttcttatgggatttttcaaaattctgtaaaatattttttcttatgaaggcaatattgatcattaggatacctcttaaagacctaagaacttccattttaagattctgtgctgcacagaccaccgccttctcttttagcctcaggtccctagaaattgtagtttttaaaaattaaatatgaatatcggtgttgcgtgggagttaaaaaatgaaaggaaaaaactaaatatgtttgccagaatactctaaaaaagtgttgatatttttgtcataattaagtgcacatttctaagatgctattttacttcgtgacaattttagatctcctaataactcttttaattactttatatcatatttattcgataagccaagtatactagttaaaaatgaacagatttttttggtaaaaactgaaaaccgaatattgtaactagccactgcccttagacaactgtccatgtctagtggtctcagtttctttatgtagattgtttctttcagtattttcagaggaaaaatctcaaagattgaaagaagttaatatgaacacccacatcaccaatagactctataataatattttactgtataaacatgtttcatcacttatctatccacttatctattcctctatctaatccaacattttttgatgaatttcaatgttagttccaaacagtaatacactccatcccaaaattgtaccatatatattaactggaattggtatttacattttttccttttaagataaaatttatatatcgtgaaatgcacaaatgttaagtatcctattggataagatttgactaacacatagacctgtggaaaccagcctctatcccttgtgccccttccctctttgtgcattcacctgtacccccaggtaaccaatatgtattttgtttatctcccaaaatatgttaatttccagatgtagaactttatattaatgaagccacatatggcatatacccttttgtataagacttctttcagcgttttcaagatattgagtatattaatagttcatcctttttattattaggtggtacagattgagtatttcttatctgaaatgcttgggaccagaagcgtttttggattttggaatactcgaaattatacttactggttgagcatccctcatctgaaactctgacatctgaaatacttcaatgagcatttcctttgggcatcatgttaatgttcaaaaaggtttggattttgagcattttggattttggattttcggattagggatcctcaacttgtgtattccatttgcaatcctattaggtggggctggaattactgaggcatagggtagatggtatatttagttttattagaaatgataaatcttttcccaaagcggctgtaccatttgacacattgaccaacagtgtttgagagtgttggctgttgcccatctaaccgataattaatggtgttagttttttaagttttagtgctgctgatgaatacgtaatgatatctgactgttgtttaaatttgcatttctctgctgactgttaatgttgagaactttttcattggtttattggtcctccgtctatctttttttgtgaagtgtctgtgcatgtcttttgcttattttttaaaaaaatttgtatttttattactgcgttgctggagtttttttaatgcattctagaaacccgttctttgtcagatttctttttttttttttttgagatggagtcttgctctgtcgcccaggctggagtgcagtggtgtgatctcggctcactgcaagctccgcctcccaggttcacgccattctcctgcctcagcctcccgagtagctgggactacaggcacccgccaccatgccctgctaattttttgtatttttagtagagacggggtttcactgtgttagccaagatggtctcgatttcctgacctcgtgatctgcccgcctcggcctcccgaagtgctgggattacaggcgtgagccaccacgcctggcctgtcagatttcttttgcaaatatccctcccaatctgtggcttgcatattcattttcttagtaataattttaatgagcagaagatattagaatgttaaataatgtctgatttgtcagttttttcttatggttattctctattcctatgaaaaaaaccatttgtctaaccccatcatgaagataatcttttctgcttttctctaaaagcttccaaagttttagttttgtgtatacttacataattcatttcaaagtaattttgtatatgatatgaggtacatgttgaggttgtctaccagggaagctcatcagagactcagcacccaagtttttaattgggagctgacatgtaggtaaggtactctctgccttgtatgtacccaagttccagattctcaggagaatgtgtgttagcctaaaccacgctgtttgtagttcaagcacggtaaacacagatatatacattttgttttaaagcaaccggttaatttacttggaatcagattgtcattctttcttggttgctagctctaatcttggtgcacgtctttatcctgtgggctgttggagtctgccctgtgcacacatggttcatggatcaggcagacatttgcacagaatttatatacagagcttggggccctgtctctgtggctctctcctttgtcatattctgtcctcacctcccaatgggtgtggtattttcctgtatcctggttgttaaggccaagaaggttatgagcttttaattgtagcttttgccatctttcttggcgcagatagacctgctttcagagcagaaaccgcagaaaggaaaatgtatctagtggtgttcctctcttccatggatcgactctcccctctagaatctgcttgcgtttgtcctcactccagtgtcttgaggtcaggagttggtgaattaagcccacctgatttttagaaagaaaattttattggaatatggccatgcccatttgtttacttattgtctgtagctgttttttgttacaaatgcatagatcagtagttgctggtatttactatttgacccttttagaaatagtttaccgacccctgccatagatagtttggattttatattttgtctagggtttacacttggtgtatgagttgatctgataggaatttattcatctattatttgaggaagtagaactcctaggtttgtttttatttgtttagttcttccagttttgttaatcactgatatgaaagaggtgaggaagaattgttttaaatgactcgctcatttgttaccataattttaactctagcatattcagatgtcagagattttagtttttttgaaagtgctctttgaaatgtatattgtaggatgaaatactttttctttcactccttcattcagcacatactcatgaatcctctgtaaatgcaaggcacgtgctaaactctgtaatacattaaagatacatcagacatatagagtgttctcaaaaaactttagtttattaaatgcactaagttcagcttactgagattaaacatgtgtacaagtaactgtaattccaaagtggaaagtataaattcatgtcagagagtggtcttttttgcggcctggtgtggtgactcgtgcctgtaatcccagcactttgggaagccaaggtgggcacatcactcgaggtcagagttcgagaccagcctggccagtgtggtgaaaccctgtctctacaaaaaacaaacgaacaaacaaaaaaacacaaaaaacagtggtcgttttttgtttttatgaaaatatggtttttggacttttagtatagaataacatctctctcttttttacttcagactttataatgttatatttggtctttattacatcagggatactgcaaataggagagataacaatttcacagttctcctgattgatatttcctatcagcttccacttttctctgggttctcatctggagctacattgattctggagcagggttccttgtagtgagcaacctagcgttaaaaggaggatttttttttttaaaggtcactttgtaaactgcttgtctgtttgaacttagggcatatgtaaaataacaactagcatcttcatagtactttttctttcataaaaagctttacatacagggtgcggttactcacgcctataatcctagcgctttgggaggccaaggagggtggattgcttaagcccaggagttcaacaccagcctgggcatcatagtgagatcccatctctacagaaaaatacaaaaattagccaagcatggtggtgtgcacctgtagtcctagccacttgggaagctgagatgggaggattgcttgagtccgggaggtagggctgcaatgagccgtgatcgcaccactgcactccaacctgggtgacagagggagaccctgtctcaaggcaaaaaaaaagaagaaagatattttaagtctttgatttggtgatattcagtacataagaagactgtattataagtgccttctaatatttatttattttattttattttatttttgagactgagacagggttttgccctgttgcccaggctggagtgcagtggtgcgatcttggctcactgcaacctccacttagcaggctcaagtgattctcgtgcctcagcctcctgagtagctgggattacaggcccagctaattttttgtttttcagtagatacgggtttcaccatgttggccaggctggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttgttacagctagatattctgtgtatgtttttcggtaaattgttcattacctatactaaaaggaaaaggatgtcttttctaaacaatagttgtaacatagctgataaacatattgacagtttagcttatcttagcctagtgaataacctcacctgtggtaggtatgttggattaatgctggaaacatcccgtaaagaagaagtctgattagagttgtctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctatttaattattattattattattttttttttttgagatggagtctcactctatcacccaggctggagtgcagtggcgtgatcttggctcactgcatcctgcacctcccagattcaagtgattctactgcctcagcctcctaagtagctgggattacaggcgtgcgccaccacgcccagctaatttttgtacttttaatagagatggggtttcaccatgttggtcaggctggtctcgaactcctgacctcgtgatccacctgccttggccttccaaagtgctgggattacagtcgtgagccaccatgcctgcccttaattattattcttacttagcccatcttagatttgaaatttgattacattcaatgagattaaaatataggcttttgagtgaaacggtttggtaaagcttactttgtataaatatagccatgataagcagtatgttattcttcagattattaaatatttgtaatgagaacattgatatctaagtattcttgctttctatattgacagattataagagaaaatagtatctctctcagtgaaatcgaattgccgtgctcagaggatttgaatttggaaactttgtcgtaagtgatgtataatgcaaattagctatcctagcgtctatcagataattaaattgaaatataccatgtgggagtaatattgtccttgatttaagtaattatgaatcccacatgtttctaaccattatttatcagatgttcatgacgttggttaaagctctctgaagtacagagctcttgccctcaaaaagcaatattggagatttaacttgtatgtatttgttttttatcctttccattaaagaaattggcaacaattttaaaaattgtttttgctgcatatgaaactgtaggcaaggggcaaacttcatgagtaaggtgacccgatgcttctgctgaaaaaaaaaatacatagaaatctgctgactgagggcacttcatcattcccagaaagatataaactagcttagagaactggaatatttattgttacttatttcaagttaattttaaagtaaaataatgattattaaatttcttgtcacctgttttcagccaagcacatgtctacataattgcaggagcctgtttgtctctgggtttttgatttgctggctcagaaaacttaccagcatttaactgtttggtaagaagtattttagtttactgtgttctttttttttgtttgttttaacaaagctttaagatgcttcttataacttggaattttttcttttgtttttctagcataaatttgccaaagattttatgacttatttgtctgcacctaatgcttctgttgtaagtctttttatcattctccttgggaataaaattaaacttgaaaaaaatttactgatgatccagttacttatgtgttatcagatatctctgctgtttttttaaatgtagaatgagagatctgaagaaccattagctcatctttttatttttgttttgcgatattaacttaggtgagaatatgattaccctggaaggatgcacaggtatctagttcttgtgacaagagaataaaaaaggccataatattcacgggttgtcatacctcatgtaattctgtctcagtattaaatattgggaatttcctttttaaaaaatattagtacttagtaaggattcagttgcttttgaggcattgcttctctgatgacaagactgagagattttatttcctggtaaaagctacatggatttatgcaacactatttataatatggaaaagttagaaacatcaaaaaagtctaaaagtagttaattaaatttgattatggtttatttatatattcttacacagtggagctaccaaaatcacgttatacaagaattttttgtggctgggtgcagtggctcatgcctataatcctagcaactttgggagaccgaagcaggaggatcatttgagcccaggaggttgagatcagcctgggcaacatagggagaccccatctctacaaaaaataaaaaattagccaggtgtggtgacacacacatgtagtcccagcaacttgggaggctgaggtgggtggatcctttgaccccaggaggttgaggctgttgcatcactgcacttcagcctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgtgtaggtaaaggaaaaattcagagaaaaagccaaaacgttaacaccagttatctttgggtgtgacattccaagtgattgttatgtcttgatattcaatatttgaaattatttctgttgaacttatatttcataatcagggaaaatatttgtatttacagatttttttttttctctgagacagcgtctcgctctgtctcccaggctggagtgcagtggcgcgatctcggctcactgcgagctccgcaccccgggttcacgccattctcctgcctcagcctcccgagcagctgggaccacaggcgcccgccaccacgcccggctaactttttgtgttttttagtagagacggggtttcaccatgttagccgggatggtctcgatctcctgacctcgtgatccgcccgccttggcctcccaaagtgctgggattacaggcgtgagccacagtgcccagcccagatttttttttaagttacaaacttttgtagtcttctaatgatggctaagctagttctgataataaagaaatgtaacacaacagttatagtgatgtcatctcttcacctgacagacaggtcctcataacctagaaacttgtctgagcgtggtgctgctgtctctccccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtaagtgaatatgtatttttccaatgaaaagatctcattggtgagatctataagggtgacttacgttgatcttgaagataacatgaaaaatttaaattctgactagctcttagcttaactagcagcattattcgacttgatgggcttctttgtagtttaaccgtcaacttatggtctactcagtagaattaccatcctctctgacacactgagcatcactgtatttctcagaatagtctgtgctctgttcttcagtgcattactgcttgtgcccacctggttaaaaattttaccattctactaagctactttctcagaaaggtcacaaacaaaatcgtttaccagatcctgtgacattttcttagttttcagctttcttgatctttttccaacatgtgccattcctgactacatcctttataagactgccctggctttagatgaaccaaaaaccatgtacagaaaagtgtataaatcataggtgcacaggtcaaagagctatctaccacagaaaaatctctttgttatcatgtagatcaagattctgtatagcactttcaactcacagcacccgtctctgcttctgccatgcacccctctcaatcactattatcttcctttccccaaagatagccctatctagtcttctaacaccttacgttgattttgcctgtttttgacatttaaattgaattatacacgatgtatccttttgcactttacttttgctcaacattatgtttgtaagattcatgttgtatgtagcaatggattattcaagtttcagtgttgtattacactttcattgtatgactgtaccacattttattgatctcccccattgatggatatgcttcttgcttctagtttggggctgttatgaacagtgctgttagggaaagttgtacatgtcttcgattttgttgtatatagaactgtgtggaattgggtcataggttgtacgtgtgtattcactttcagtgaataataccatcagtgctgcagtgcacttgtaccattttacatactcatgggcaggatgtgaagttccagttgttccatatccttgtcaacccttgttattggtatagtctttttagtagtctttttagttttagccaactagtaggtatataacaggatctcattgtggctttaatttctgtatttctgaataatgttcttgagtaccattttacacttttaatagccaactgcaaaacctcttttgtgatgtccaaatctcttgctacccagtttttgtatttatctatgttaaaatttttatttgtggtaaaatacacataacgtaaaacttatcaatttttaggtatgcaattaagtagtgttaattatattcacactgccgtgcaaccaatctccagaaatttttcatcttgcaaaactgacattctatagccattgaacaactccctgtttgcccctcccaccagcctctggcagccgccattctactttctgttttgatgaggttgactgctccacattggtttagctttgtattgatttctgtggattctttaaactatgtcctaagcccttggtcagctttgtttgttgcagctatctttgccaccctagggcttgtttgccttttcactctctctcagtggtgtcttttgatgacacaattattaatgttcttcttttatagtttttacttctttgtgttgtttatgaaatattttcttacccagagaaaaggagatattctcctatcttatcttctagaagtttttagcttttccattcacatttgaatctaaaatctacctggcacggatttttctccatgtttttttcccgctgctattgaaaagtttctccttctccactactctgcagtaccacatctattatataagttaagtgcctatacacctgtgtttatttctgggctattaggttttgctggtctgtttttctgtacttgcaccaatactccattgtcttatgagtcttggtatccagttgagtaaatccttcaaactcggttttcttcttcaaaagtgtgtttttctcttggctccttgcattttcatataaatattggaatctgttccatactaaataatctgataaaatattgatcagaattgccttgattgtatgtgtctgtgttaaggagattagaatctgttacagtattgtcttccattctgtgaatatggtatacccctgtatatatttagctgtagtgtgtgtgaccttgatcaatggctacagtgtctgtgtaggctaattttcccctcttctttaaggctgagcttaccattggaactcaccttttcagaagtacaaaaagtaaagttgatcagaaaggtgtgtatttcctctcaacatgttttgtggaattgtctttctttaattgtttagaattaataatggtcaaagaaatattactatgaaaattcttatttattttattctatgatttttgaaaattttttcctttcaaaatgagcctctccgtgtctcttaatcccatctttcattgttccaaactgtatgactctcctcgctcttctttcatatcgaattgatttttctaccattctgctactgcttttctagtgatttttggtttttaaatggtcatgtatactctgtaacaacatttaaacttagcatagctacaccattatgtttctacccaaaatttctaacattagtatcttaatatttatctttgaattttggtttatcaaaagggtacaaagaaaatggcttattccatgcacatgccaaaatagatgtatctctttgcttaaattttgaaatctcttctttctaatccattaaatatataagcatatataatgaattataagtccttatttaatactccaattattttaaaagacagggaaagagatttgggtatatgtgtgtgcatgtttgtgtgtaagaaaagtatttatactcaatagttttagaagtggttttatgtgatgtcctacaccatctttatttcaaaatattttttagaaaaactctgggactttagattaatttgcctgtttgctatactaaatttgagcaacaataaagtaatttaaggaaaattttaatagaccctttaccaagagaatatttttaaagtctatgaaactttatcttaaaagtgtatcatattggtgaggaaagaatttatatttagaggaatagttgtttatacagtcattgtaactttttttttttttgagaaggagtctcgctctttcgcccaggctggagtgcagtggtgggatctcggctcactgcaagctccgcctcccgggttcacgccattctcctgcctcagccttccaagtagctgggactataggcgcccgccacggcgcccagctaattttttgtatttttagtagagatggggtttcaccgtgttagccaggatggtctcgatctcctgacctcgtgatccgcccgcctcggcctcccaaagtgctgggattacaggcgtgagccaccgcgcatggcctcgttgtaactttttaatgataacttttgccttttcatttagtcagtcattctaaaggaatcatcatgcttcacagaaacagaaaaaaactgtttaaataccaattacaacattctgtatttttaaaactcagatttataattgtatatttatatacataggcatatacataggcatatacattaataaaattggataagaaggtggcatacttggtacatgactcttcaatatttataatttctaggactgcattcatggtcttcactactctgctattttatgttaaaaccttgcttcaagggttgaaatttaacatttatgggatattactttggctttaaatagtgatgatcttgaaatggcccaaggactaaatgaaaagtggaatgttcacaccactgacactcttgtattatgagggcatcttatcagtatgccttactattataccccagtttcctgattctcaagaatgccttgaaagtatgtgcaatataatcaataacatctgtccccaccgaacttactttgcagttactctttgagcacatcaaattcttccattgccgctcttctctgtgccctttatccgcacttcccagctcacagcactgacaaccggtgagtctagtgattctgtcttcaatgtgatacttattaagttctctaaggggatcatttggttgtattttggtttcatggaattatttccaaattagcattgttttgttcttcaacttagttatattcctggctaaatcttttaagaaaattatctcacaaagtattagaccagaggataactttggacacctgatgactgaccagtcttccaccattctcagatctatagaactgctctaaacccaaaaggagatcaagtaaagttgtctttagggaaaaaatcatcaggtaaaggatagttgccaagggaagttcaggatactttttttgtgctctaattatttaattccaagagaaaagtttgtctgatttagtggcaatgtctgtatgagtttctttttttcctttcacatagatgccgagaaattgtgtataaatgacatagacgggacaagaaaagcaaaatacagcaaaaaaccagagacaatttagaagtggcagtgagcggtagaacttcaaaccatgtagaagcagttaaaagctctgtgttttagggtacgaggaaccaccaacacttaagtttccctagatatagtttgagacatagcagatctcttgcatatgggggcagagaagaaaatagcccctataagacacctgagccctgtgctcaactgaaggcatcccatgttgtctccccagagacaggtcaagagccctttattgtttatgggagaagggtcaggagcacttatcacagtaacctaagccatcattttaaactacactacaatgtataaccaacgacagaagaaagatagctgttttacaaaagtagcctaatctgaagaccacactctgatggtaggtgcagcacaagaatattgttaagttaatacacttctgacatgtggcctcatgcctgtcatttaggaaagattttttgagttgttaaagccaattattggctagggtacagtggagagccacactcacatactgctggtcatagctatttggcttagctattgtaaacgaagccattttccattggtgacaagaatctttttttttttttttcgagatagagtctcgctctgtcgcccaggctgaagtgcagtggcgtgatctcgggtcactgcaagctccgcctcccgggttcatgccattctcctgcctcagcctcccatgtagctgggactacaggcacctgccaccacgcccagctaactttttgtatattttagtagagacggggtttctccgtattagccaggatggtctccatctcctgaccttgtgatccgcctgcctcagcctcccaaagtgctgggattacaggcgtgagccactgcgcctggccggtgacaagaatctttatgtaatttgttagtgtcattttttctgatctttattgattttatttttaatagatttatagaaataaatgtatttgagtaagaagagggaagttactgtctataaagctttttaaaattgaagtctcattttatccttctttttttttttttgagacagagtctcactctgttgcccaggctggagtgtagtggtgcgatctcagctcactgcaagctccgcctcccaggttcacgccattctcctgtctcagcctcctgagtagctgggactacaggcgccagccactgcgcctggctaatttttttgtatttttagtagagacggggtttcaccgtgttagccaggatggtctcgatctcctgacctcgtgatccacccatcttggcctcccaaagtgctgggattacaggcgtgagccactgcgcctgggcgatttttttttgttttttcttctgagatggagtcttcctctgttgcccaggctgcagtgcagtggtgtgatctcagctcactgcaacctccatctcctgggttcaagtgattctcctccctcagcctcccgagtagctgggattccaggcatgtgccaccaggcctggctaacttttgtctttttagtagagatggggtttcatcatgttggccaggctcatctcgaactcctgacctcaggtgatccacctgccttggcctcccaaagtgctgggattacaggtgtgagccactgtgcccagcctatttttcttttatgagatcttaaaatatgaaaacttttttgtttttacattctaaaatagaaatcttaaagtttaaaaaactgtttgagaaccccaaagaaaaatattgccatacccacatagatgtttgatgtactgtgtttcaaggacgtgtgtatatgtatgtgcaagtatgtatgtgtagaagaactttgctgtctgagaagaattgacatcctgtcttcccccttcttccctatcaatccttaaggaaaaagaaaaaaaaatctgagaagataaaaacagatgcctatgttgagtagaaagggatttttgagagtgattgattttataagtggtcagtttgatagtaaatattttcatattatgatactttttacctccctgtaaaacctcttcactgtgaagactaaagtaaagaattattgggtcaaaggtcagttatataaaatttttaaaagataatttctccattactttttaatagaatcttatctgcctttaagatttctgttcatttgaagatattacttgagcttctgtcctgtcttagcttataggcaacagcagattgcagagctcatattgtcacagttgtttgttacccactctctgtcttttttgtgaacaggtatcatctccaggctctccggcacctctatgtgctggccgcggagcccaggcttctagtgcctgtggatgtggacacaaacacgccctgctatgccctcttagaagttacctacaaggtatctctccctatcatttacttgtaattttattaccactcatccgtctttgcaggtcataatatttcaaatgtgttgtccagtaaaaggtgataagtaatgaattgaactttcataaaaatggaagcttccaaagttattgtatatcctgccaggccattcatgctcatttatatgatctgggtatcactttttagggatcatcagctactcttttgtccttagagcttataatttgaaaatgtccctgttaactttatgtgactgacagtagtgttttgtataactgattgagttagacccattcttagatttgttagctgaaacttgaaaacccaaaattgtgtatttgatgacagctttcatttagatgcatagattacaagttttatatcctcctttcattcagcaaattattaagtaccttctgtgactcaaaaccgtgctaggctctggggtacaaaatgagatgacattgtcattttccttaaggaacttctatcccctggggagccaggcatggatacaatgggaatagagggtgataattggagatgtctgtggaatgcaggggaagcagagaagcaccctcgcttagctgttagttatggggttgaggctgtcaacagtggacagtgtttggactaggcctggcccactgagtggagctccttcccagcggagaaggcaatgtgcagaaacccagcagcattggagcacggcctttggtgctgctggcctgtgaggagcaaggcttgaagtgatgggaaggacacataccctgtgaggaatttagacatcagtcctttaagatttgagtaccagagaggattttatgccatttaaaggtctctgtatgaactgcggggatagggggaggtatagcgtggagatgtttcttctttgttgtttccactgactacctagtgaattgtggctggacttttacatttgtaaagggcactcagtggtatgaacaaaccaaagaagaattgatggctcctacccttcttccagaactccatcttttaaagcaggtaagctgggtgtgttcgggagttgggtccaaggggtcaattcaacagaatggcatagcgttaaagatagctaaataaaagcctctgctttcttcatgtattgtagcagataagaaagctgcagcaggaggaaaagtcagaaagaatagagcaagtcttttcttagagatctttattgatagcttaggtggcctcagaacatgatttacattcattttttgtctggaaatggagcttgttaccttccagatgcctctttctggctgttattgtttcctctgagaaacataggtttcagtttgtcagatgagcatatttttcagctttgggttgactatgtttacgtttatcttgacagattaaagtaaaaggcccaagatactgggaactgctcatagatttaagcaaaggaacacaacacttgaagtaagtacattaaatttctcaaatttaccttttaggaagtgaatagaagtatataagaaggtataaattatagattattatctggaatgtgactcatcaccctttaatctcattcaagactatatgtagggtatgtcttctgtaaaacagtctgtatctttgaaacaagacttgtgttagaaaatgaaagttttaatttcaaactccaaccctaaatatttatttattgagaaacttgcactgacttccttgtgacagtaatggacttatctcttggtatattaacataagatttagtttaagaaagtgtattagtccattttcacactgctataaagaactacctgagactgggtaatttctaaagaaaagggatttaattgactcacagttctgcctggctggggaggcctcaggaaacttacagtcatggcagaaggcaaaggggaagcaaggcatgtcttgtatggcagcaagagagagagagagaggtgcaacacttttaaaccatcagatctcatgagaactcactcactatcatgagaacagcatgagggaaatctgcccccatgatccaatcacccccaaccaggtccctctcctgacatgtggggattacagtttgacatgagatttgggtggggacacagagcctaaccatgtcagaaagtaaagctgatttgtacacgcacaaaagaactttattaatcagtgtttatcagaccacatcttttgttgcatctctttaccattcttttgctagaaagttctcctaaatttaagattattgtagataatatatactactcagccagtttattttgggtggaaataatcacgtgcagttattttagagtgttgatacatttatacctaaagtagcatgtcagttaagcctttaaatttcaaggaagtttaacaagcatgtaaaagtttttatagtttggtcccaatgtgaatttttccagactgtatattagctgttttctgtattgttctgtccttagatttgcagcattattttcttcttgctgcaaaccaattaatagatatttagtacctcatgtaccctaggcatagagctaggggatatagggaatacaaagaaatgttagacaaaatgttatcttcgaagctcataattgagccaatagtcaaagtgcctcctcatttaacaagttccatgaatctagacaccaaagaaaaacagaactttattctaggctttctcatagggactgatttaatcttagacacagtaaataatcatttaccttagtggaaaatggtaaaagcttcatctcctgtgaacatggtattgggaaaacactgtttccagccaagaactgccagtaataccttatattaaattcattctttttctttcaggtccatcctttccaaggatggggttttatatgttaaactccgggcgggtcagctctcctacaaagaagatccaatgggatggcaaagtttgttggctcagactgttgctaacaggaactctgaagcccgggctttcaaggtagtattattgattggtaaaaacggaaagaaataattctaaattgctggcttcctcgcccattgctataaacttcaaaggtggatctgcttcctttttcattgttgcagattgtaaagactgactgtggctctgtttgctttttatgtgataaaataaataataaaatataatgaatataaaatactgtatataataagtaatatatatataataaagtaaaatactgtaagttaatgtttacatttagcagcaaggacagtcacaccatatcttgacactgtaacaaatagtgattttattattgatcttcaaatcggtgaagatttacttaatttcatagcaaaaatagaaaacgagttttgcaagctagcaattattaactccatttaaaaaccaccatttgtttccttaatctcggtgaggataaactgatgacagattcagacttcttttattagtttgctttattatttgcacagtacttgactgccagtgcagtagtgtttgaaataaggaaatagttacgataaatgagggtaggaagcaatctcattcccttggcggggtcagcacatattttgctctatattcttgactcagataagtttccaacacaagaaatttgtcccataatcaggcattaagacttctgaatttaacttcagtttcctgtaattccatgagcaactgtgtccctgctggtgatacaaagtagagtagtctaaagtagttaggaccctaaggaataattagacggcaaaagtggggcaggcagactggatgagtggcagccagaggactgagttagcatcctttgttcttccaagtacggagacagcagtttattttaattcaactcatatttcattttagtcagttacttatgaccgagcctttataatggttcccaggattgaaatgtataaatagttcccagggttgacattggtgaattttgtttggcagtattcagtaagttgtttatgaaatacttttgaaagatttttggacacagtttaacttaaatttgtagtattgcttcttctaaaaattagagcatattccaaagactctaacccaatttgtgaagaaaatagataagtttagacttgagtttgaacgaagaaagtatataaaaattaaaagctatttctatttcctgcctactggagttcagaaataaaatataaacctcagtggaaaatagtaataccttcatatttcattttcaatcttgaaccttgagtgatactgtttttttcccaagtttaaaaagttgtggtaaaatgcacacaatttattgtcttaaccattgcaagttacagctcagtaatactaagtgcattcacattgttgcgcaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacgcacaaccatcaccaccatccatctctagaactgttgcatcttgcagacctgagatctatacctgcaacaataacccctcattctacttcccctagtccctggcaaccaccgttctattttatgtctctgtgattttgattatactaagtacctcatttatgtggtttcatacactgtttatctttttgtggctggcttgagtgatattcttttttccttaccttttcagtaacaattctagtttctggtaggctttttaattagtcagtgaaggagggaaaagccttttttggatgagttgtgtaaacaggaagacctgtttgttattggccttttgataaattagcagctcatgttaacttgtgcaaaagcttcttgtaacttcttagcagaacaggttgatgaggcaagtttgcatcatctgggattttttgggaatgttgggtgacaaaggggaggtagagttgttagaactgtgtgtattacagtttaagcgtaaggaaaataatcttttgttgtcttatactgttgtggttgtttgtttttttagccagaaacaatctcagcattcacttctgatccagcacttctgtcatttgctgaatatttctgcaagccaactgtgaacatgggtcaggtatatattctatggtttgccgagccccaggactagaatttgttattatttctatgcatgggtcacccaaaacatctctactatctatatctatctttgagattgatgacatgcgtcagtcacattggatgacttttgcttggcacgtatagatttgcatagcctaaaactattaaattcagcaactttctaccttgatagaagaaacaacttaaaatttataagacatcagttttgacagatgatagtttctgtcatctacaagaatgatacccatccatattctgctttatgttttcagtgtttaccacctttctcttatttttatgtaatttcattaactgtttcctctgtatattataacccttctttttattgttcatacacctgttaccttcaagattccaagggtgctgagcagatttttctttatttttttgttttttgctttttgagacagggtcggttttttctgttgcccaggctggagtgcagtgacgtgatcatggctcactgcatccttgacctcccggagtgaagccatccttccacctcagcctcctgagtagctgggactacaggcatgtagccaccatgcctggctacttttttaaaaaaattttttgtagagatggagtctcactatattgcccaggctggtcttgaacttctgggctcaaatgatcctcccaccttggactcccaaagtgctgggattataggcatgagccactgtgcctggcccagatctttgacttaatccaccatagagacaaggaaagattggatgcatatatggccttcagaaaatttctcaacctctccaaaatgtagtttcctcatttctaaaagtgattataatagaacctaccttacagtattgttttgaggattaagtgaaataaccttcccctctcttttttattgaatctttactatacatgggacactctgctaatacttaaatgtcatttaattatgaccctgagaataggtattttatcattctgggcttacagatgaggaaactgccactgagagatgtcacatgcccaagatctcacagctagtaagagctgggctgtgcactccaggtcacgggtctctaataaagcccatgcccacccttaaccccagctggacttgactctgccacctcccctaaacttgttctggtcagtgttttttttcttgcagctttgttactcggtttcctttctggatcctactcttcccagcccaacccaaggcatagctctgtgatgtcctatctactcattttgtcctagtttggtccattcctctcttctgtagcacttactatccttaactgtctcttgggacttaatttttttttttttattaatgtttaatgttacatgtgctgtggcttttttaaaagattgtagtgttacttttatgtcattcattataaaacttaagaatgggccatagtagtgctatacaatttgtttttgaattgattttggaatatactttgtgctacaaaacttctgattttctgcagaaacaggaaattctggatctcttttcttcagtactctatgaatgtgttacccaggagacctcagagatgttgcctgcatacatagcaatggatcaggtatggatccaaaaacctataccaattctggtgaaatttgtcctgtagttcaagtaactcactgaatagtgtggtaaggttcctagtgtccttccttttagtttcccatttgcttttggaaatttaagaaaggaaaccatataaaatttgaaagctctcaaaaatccaaaaagcttgggctttatgttgacaggagtgccccttggggggctgtcttcctttaagggttcccattcctcccttttgtctcccctgactaggagaggaggggagcactcccttcctctctcccatcttatttttgcctccctcctggcaatgcctctttgtagaagtctgcatgtgagccgttagtgaacagaaccctagcgatggcagtactgtgaaattagacctatgtgatgaagcttgcaagaggttacagagtccatatgcagttatctaggcattggagttcatttttaaatttctcttgttattgctattttaaaagagcctaaaggggtaatgcagaaaataatgcttaataatgttcttaaaggatcagaccaatttattcactttaggcaaattagtaatacatacaccttttcagtattatcatatctttcagacccagatttggagctaagccaagccagtagttttctaacctggcagaaatttgccttggtatcttaaaaatacagatcctttaattccatgtctcatctattgaatcagaatttctggggtgagatccagaatctagttttaaacagctctttaagtgaatatagtaagttcacagctgagcatctgagactcagtgtctaagagaaataacctttaatgataaaaataatttgctaaaaagctgaatggaaaaatatatttagccagaggataattcccccaaaccagaaaacacacagtgttaagtaacatcattaaaaaccaagttccaatataactaagtaggcccagaatgccattattgtctggaatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatctcaagggcagtattattagtagtgttcttcttgccctctaccccctgggatctctgccatgtcattgtacccagcttgagtttcccagaggtgactggctatgaccttttgggtcttggttattcggagctgttgagccaagaatgagctcattcacctttgttacttttccctgcaagctcctcatgtagggccatattgaaggaggtgagccattcacctgtacccagtgacggcgcctctgtgggcagactgcatcaaaacacagaatggaccaccccccgaccctttataattcggagccacatttaaaaaatactcagtctacaactctgatgaagagacagagcactctttgattaaatagattgttgtcctctttcctcttcaaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaaggtaatagtagcattgtagcatagcgctcttgtgcttttgagatacattcggttcaggcttttctgttgtaactttgttttttcattggtaagcaagataaatctgagtataagcaagaatggctatagatttaacgtttccagctagatgaattagactttgattatctactttagcttctttagtaaaatacatctgacccaggcagataatatttatagcattttaaataccacttggtgctcaggaccttgttctctcttccctagcatcagatcacatttcctttccagtgcctctgtctcctgtttcctaggggtgtggcctgttgccttcctgaggccagcagccatcctgtttttgtactggcaccacatgtacatgtagaagttgacgtgtgcttgctgagtgagcttgttgtaccaactcagttttgaaaacctgggaccgcacagctatgtgatgtcacagtggtggctttctatcagcaggatttgtgattgcaaggaaattgtagttactcgttaacagtgtagaagtgattctgacttacatgaggcaagcgatggggcctttagatttatggaaatgtgtctgtgtgttaaatacacctgaaactgattttcaggagtagactccttgatcttttcattctttttagttcattcaaatgctcccagtaaatatctgacagttgcttgctttgggttaatactaaccttagtaatagtagtagaaacaattcttgctttgattagtgaaaactattagtaatcaatagaccctaagcgtttgaatataattcagtttaaaactatccacctgtaacactaggaaataaatttctgaaaaaaattaaattgtaaaccaagttgtgagggatatacttggaaagcctgattgcagactctccatgtttatatttaaaagctgcattgtatttgtcatttcctgttcagattcaaagatcatataacttcataattttttggatagtcatttttatcctcatttttggggaaaaacatgttatttcaaaggttttcgtgtttcgtttttattcaatttaacatttgatcacctatggcagacctttgctattgataataaatacttccttaaatctttgcagattccctgatttgcacatttcatataatgtatggaactttggcagtgattagaacattctctaaaacagggccctgattgccttgttgctctttagcgcatttggtggtttccagcattgctgtcagcctccattgaatttgacttgccacacagatttatcaaaaatgtgtttattttttagtgaaaaactagaatttttttttaaaacaaaacctcttaaatatatagtctcctctcttacaagcactagcagttggcattggggtagagaacaataaattaactgaaaattggaaattgcattcatatttgtgtgtaaaaatcacagatgcatatgtggactttcaggatcactcactaacaactcattagatctgagataacccattgaatcactacactaatctgaaaatgcagccaatttatattatataaatgtcggttttgttttttctttttttgagacagagtctcgctctgtcaccagggtggagtgcagtggcgcgatctcagctcactgcaacctccacctcctgggttcaagcaagtgtcctgcctcagcctcctgagtagctgggattacaggtgcatgccaccacacccagctaatttttgtacttttagttgagacggggtttcaccatgttgttcagtctggtctcgaactcctgacctcatgatctacgtgccttggcctcccaaagtgctgggattacaggcgtgagccatggcgcctggcctatataaatgttttgtacagtatttatctcctcaaattataattttgggcaaagaaagcgggtttcaagtttaagaactttaaaaagttttattaactttttcatattttgttatggaaatttaaagaatatacaaagtaagtagactagtgtaataaaccacaacaccaattttaatagttgccagcattctcctatttttgcgtcatttgtaccttcacccattgccacactcaattttccaaattgtgccattttactttcccaccagcagtggattgcaatgcaatttttggcattgtcctttttttttttttttttttttaagacttgtcaagtgcagtaggaaagcaaagtaaacccaaagcaagcaaataaaagcagaaaccaatgaaaccaaaaacagataagcaatagagaaaatcagtgaaacaaaatgctggtagacatgagaaagtcattgaagagaggctgaaccaccatgctctccttcatgatgagctgttcaaagaagaatctcatctgttctcccttaacctttctccctctgctgcctcccccaaacctaaatgtttccacctcccagtagactgacatcctcacaactgtgttcagtggagtctacagttttcatctcactccatctctacaatggtgaggcttttagctacattttccttcttgaaatgagcctcccttgactttgtcatagcacactttcccaatttttaaaaaaaatcctctttaaaaattctcagtatttgtcaccatttcactgtcactcctttgttgacccttttggaagtcatccttgctcctttccctccttcccttctctgcgatagctgacccattgctgatgcctttcagtcctcatcatagatatttcttgaatttgtccacattttactatttctacctagaacagaatgatgattttgtgcctggaccactgttatagcctcctaaatagcctccttgctttttctcatctccattccaaccatctcaatttaactgacagaacagtcttttaaagaataaactgatgtaacactcctgcttaaagcttttcaatggctcctgattcagctgtgaaagaaatccctactgtgtggcaccaggacctgtgtgacctgcaaggcgcctgttttcctcaacaaagcctcttttataccacttgctccccacaccaccctggccccttccacttgctcaaaaacactgagctccttttcactgtggggccattgaatatgctgttttccctccctagaaccttttcctctcattcttcacctgcccaactcatatttatccatgcagcctcagttttaatggcatttcctcccaggccttccaagaccactctccctcaggcagctttcctgacatctttagcctgcccgctcatgctctctaccttttttctgtatcaaaatgcctttgtttgcaagtaacagaaggcctgacttaacctgcctttaaacagtaaggacacaagtatgcctatgttattagaggtctgcaggtaaggcacgtaaagggtcatctttttccagtgtcttcaactccatttctctgaggttccatcagctacattctgtgccatgactttatcctcagtgcatttttcagatggtaatcaaatggctgtaacatgttcacctctagctcagcatgatactcagaggaagaatagagttgcttctaggagttttgtgatgagaatgagggaatttctttccctggagcctccagcaagcttgtcattaagtacctcctcaggtttctggctcgagttgcatctcatgcacacctctcaatctatccctgtggcagagaatgtctcttattgaaaaaatggcctgggtttgcctgtctctgaactaacactgcatcaggagaatgggattgccttgatcacccaagatcagtgattctcaaagtgtggtttatggagcagcatgacctgggcacttgttagaaatggagtttttctggccccaccccagacctactgaataagaatctctgtgctctgtgcatggagtggggcccactcatctgtggtttaacaagccttccaggtgattctggcacatgttaaagtttgaggacccctggccaagactagtaaggatctagttctggagctgaagtcagtcccatcaaatataatatatggtggagggtagggtgcgacaaggggtatttcggggagacaaccacagtgaccactgcacctttatagcactcatcacaatttgtaattatgcatttgtttgtgtcattatttgtgtaatatctgtctcccccaacaacactctaaactctacaatgacagggactcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaaggtaattgcatatctaagtcttatcttcagtacctctgttacctacccctttacgttctagtttctcagtagttactgcccctagtttgactttcctcttcattaatgttgcagtgtcattgttagggactgttttggagcaaaaaagaaaaaattatcaactttatatatgaataactttcatttttattcagaaaaggatggattcttcttcacagagccccaaacactgatctatactaataaactaaatattccatattattctttactaattgatttttttattaaagctatttttctttattttctaggttttcagttgggttttttagaatcacatataatcttaatttctaatattacaaagctttacaactaataaatacctaattttgtgtttgaatttttttataatagttttaaaaattaatagtattatcacctgattgtatttttcagaatacagaaacagataaaaaaaatttatccattaagctgaatactaagatatgatgaattctaagcacccaatttttctgagattctcaaaaaaaatattttctgataagggcaaagattgttccatttaatcatttaaacttgaagtttaattacattactagttttttgctgttttgcaagcctctgataaaagtttactatctagagacttctggttatggccatgatggaattgcttgtattggactcacttgccctcaaaaacaaatataaaagctaaaaaaaaaaaaaataagaaaagggaagtacaacagggagagctttatattcaccctagcttctcccccaaaggcatttgccagttcatagtacaagaagtagagtgccagcaaaaagcagcaatgctgcagggctgaggagccagaggttgggtttgtgattgcccaagagcctagaacttgaggaacacagtctcaggcaggagagaacgatagaaatcataactcagactctggatatacctttcccttgagttacttaatgatattttagccttcatatacatgggataagacttcaagagatctagcagaagccacaaggccaaaaatgtaagcaaaaatgtcagcagcagcataggactgaggagacaaagggtggaattcaacgcttgttaaagtgaagtggctctgatcagcatcccagctcctcaggtgaattaatacatggccaagccctaagcctgctctagcctaattttagatctggtctgcttcagtttcactccaagcagacttgacctacaattagcctagagcagaactaaggtgatctgtgtgctttctccccacctgacagaagaaaatgtaaccttcataggagaaagaaaacatacccagagcccccacaatttttagtctacaggattcagtgttgaatcaaaaattatgaaacataataataataaaaaaacagataatagaaacagacttatgtgtgattcagatattggagttatcatactggaacttaaaataactatgtctaatgtttccaggaaaatagaaggaatgatagggaatttcaccagaaacctggggtcaataaaaaagagttaaatggaaattctagaactgaaaaatatagtaactgaaatgaagatctcagtattggattatttgaagtgaactggaagacacttatctgctggaagacaagtagaaagtaaacaaactgaagcacagagggaagaatggttaggaaatacagagaagagtacaagagacatgtggaaaccgtgaaaaaaaaaataaacatgcatggggttggaataagagaataagaggagagaaaaaatgagttagaagcaatatttgaagagacagaagctaagaattttgaaaaatggtgttaaatattaacccacagtgaaccctaagcaggataaatacaaagaaaaccatacctagtcacattaatagtcaaactactaaaaggaaaaggaagacattttaaaagtatagacttcttttcaggccaggctggacaaacagggttgttcaatggtcaactgtattagaaccagtaaaataccacttagatagtatttgaaggtagacaggcacttttgcacattatatttaaagaatttatatatatatatatatatatatatataaaattaaacaatattagtagtttcacatgtagttataggtcactttctgaagtctagaatgggtaaattctatcaaatcatatacaggtttgagtatccttaatctgaaatctgaagtgtttgaaatcgaaaacgttttgagcaccaacatgatgctcagaggaaatgttcattacagcattttggatttgggatttttggattaagaatgctcagccgaggctgggcgcagtggctcatgcctgtaatcccagcactttgggaggccgaggccggcggatcacgaggtcaggagatcgagaccatcctggctaacacgttgaaaccccatctctactaaaaatacaaaaaaaattagctgggcgtggtggtgggcacctgtagtcccagctactcggggggctgaggcaggagaatgggtgaacccaggaggtggagtttgcagtgagccgagagagcgccactgcactccagccccggtggcaaagtgagacttcgtctccaaaaaaaaaaagaattctcagccagtaggtgtaatgcagatattccaaaatctaaaaaaatccagaatccaaaacacctctctcttcggaagcattttggaaaagggatactcaatttacattacagtgtattaaggaatttcataattttaaatattgtctttgcatagtcattttcaaagggaaaaatgcctgttttaaacatgattgtgtttctgaagcttccttgaaaggagaggtatggctgaatttatttagagatgtgaccttcccaccccatttccattttagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaaaaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtggtataggtgaagtgactaagcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttgatcgtggacctccagcctccaaaattgcgagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaacgtatgtctgtaaaaggagggatttctggactagatgatggtgaaaaatgttcatataaaggcacctccagcttcgagttgccaacacaggaggaagaatgctccctgctgttcagatgctgatatgtgtcctgtgcttcctggatggccagtgggatcataagctggtagaagcaagatcttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcccttcttcctggatgtgaagcagaggcacggtggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttccctgaataaagaatgactggagagacattagttgtttgcacacatattaactcatacctaagggagaacagcttttagaacattgtcgatgaaagcaaatatcagctttaaaagagagaggacagaaagactgcagatggtctggaagcagcatttttaggccatctgattagctagcagggagcaaaggggaggctgggaagtcagcccttgagtaggcctgctggatcatcaaataaatcaattgcagctatttttggggcctcaaaaaatcctgagggtatggctctcaccatccagaacctgcagcctccttagagccatggctcaaagggaagtgctgcagaaaaacatttggctgttaagtgttttggcccaaaaatagcacacatcatttcctgttaaagcctgttggcccgaagtagtcacactgctctacctcatgtgcccaggactgggaggagaggcagacgctggtgaggatcttatgccagttacatcatggttcctaacttactaattccctgtgcccatcttttctacttagatagatagaaataggtatcatcgcttccatagacataattaaagaaaccatacaatttacacatacactcagagtggtggttctttccccagtagacgctgacatctgcgttcctcccttgcaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctcagctcagggggtctcctgacatcccagaggaagcaataaggtgggggtctttcatctctcagcctgatgatctgtgcacacccacttggtgggaggccagggtgcctgtgggcagatgggtcagagtgtgggccaggatttggagtagaagccagagcatgtgaaaatccaaaccaggaagacttcgttgcctcccgcatgcggggttgaaggcctctcttctgtggtctcccatcctcatgctgatcaaattgggggggaatgtctcactgtgtgaggatcaccccaattaagctgtgggggaggacacagaatctgatcccctctgtatccttagcgcatgctacctccagccaccaggggaaagaagcagaggtgaggtgggagaggtggccactctggacggtgtaactgggctggctgcctctcagcgcccacgagcaccccacagatatccacgctagtgtacaaaggttcccaagtggtggccttttcctgcttccaagggctgcccgggttcccccctctctgaaatagattggttgcttctcattacatcacaagctgcagaaaaaaaatttaaataaaaagcctctacagctgtgtccttaactcttacctgtggataaggatggacttgcctgcccaacatcctctatcttatgtctttgggtgaaagggaagctggaatgggcagtaggggctgcttggggcagtcaggaccttcaggcttcaggcaaggagacccactgatcagacacctgcatcaaatattggtgctgacagatcccttagatggcaccggtcctgcccctcctacagtgagatccctgtggctcagggagggaggttgactgccccaaagcacccatcacaaccctaatgaagctgactttcaaccacacttcctatactccaccctgaaccgggtccagtactgcctgcattcccagtccagcagactcttaggagaaagcagtgattaaatgtaagttaaaaggacttggcaccaggaagagtttatgaacacatttgagaagcagacatactaactcttctttacacctttggaaaagcaaaggctttgtgtaattggaatttgattaactgaattaatctatgtgttgctttcttggtcacattataacaaccaccttaatctacatttttttctcatagctaaaaagatttattcctatttcatatggtacattattatatgaaatcttaaaataagttattgattgattgaagcagagtctccctctgttgcccaggctggcatcagtgacatgaccatagctcactccagctcactgcaggctcaactttctgggttcaagcgatcctcctgcctcagcctcctgagtaaatgggactacaggtgcataccaccacacccagctaaatttttaaaatttttgtagagatgaagtattgctatggtgccgtctggtctcagactcctggcctcaggtgattctcctgccttggcctcccaaagtgctaggattacaggtatgagccactgcacccagcctaaaataaaatttttatactaaattcaataaaatatataaataactggaaagtcttaattctcagtgcttgccttgtctctgtagttaagggacctgtcacactcaggcactcttccttgtgatgctgtaggccatgtgctttaagaactcaggcacactagctcattaggggagcttaacataaggatggaggttggaagctagttggtgccactcgtgtttctttcatttgtcttacgttcgtttttgtgcatatcaagaatattttagaccaggcgtggtggctcacgcctgtaatcccagcactttggaaggccaaggtgggcggatcacctgaggtcaggagtttgggaccagcctggccaacatggcaaaaccccgtctctactaaaatatatatatatatatatatatatatatatatatatatataaattagccaggtgtggtggcacatgcctgtaatcccagctactcgggaggctaaggcaggagaatcacttgaaccagggaggcagagattgcagtgagccgagatcatgccattgcacttcagcctgggtgacagaggaagactccatctcaaaaaataagaatattgtaagtgctgcttactgtaccaattcagaaattagggcagtttcatcagctggaaatgtggataaatgtatgcaactctaaagttgaaggaagatgcgttagcaaatccatcatggttagcatccctagctgccatctgcctgccccgttggatctagagaagatgaggtcaaacctttctcactccatgttctatgcaaatttctgcaaatccacagagcagggtgtaggtgctgtctccaatgtcacttccctccaaactccctgctctgttgcactaattcatttgtggttcatctcactgtgccccatgcgtgggctgaatgtcagtcagcttggcatcttcactgcctccttttgtctctccttagcttccagctgttttccctatgtagtgtcagatgagagtcttccagtgggagatgcccatgcagggcctggaggatagaggaggaggtgaagcctttactctcctgcactggctacagcagacacagggcagatggcatactcctgactgcaggaagctaataccagctgtggcaggtgtcaccactcctgagtttctggaagtttacaggagcttctctgtcctctgcttccttcattttcctgtttggatctctgagcaaaatccatgaccccttgagggatgcaatgctcagatgtaaagtcgtccccatcctcgagtcccaccaaaaccacccactgccactcagggactaggctttgcttctagaatttctagccctctggttacctcctctgagctcccagtgctgttcacttttccattctcaaatcctcagttgttctctaaaatgccagaatttctttgcaatttcctaacccctgaacaaactcacctgggtggcaccaatctcaaagctgcagcagtgggtctcactatgctttcagtacaaccttacataagttcagagaaagcctggactgaggaaatgaaaacctgccctgctgctcatcaggctggtgattctttatccaatccactggtggtgagcccgtgggttgattccatgtctctgctattgtgaatagtgctgggatgaacacgtgagtgcacgtgtctttttgatagaacaatttattttctgttagatagatatactcagtaatgggattgctgggtcacatggcagttctcttttacgttctctgagaaatctccacactgctttccacagtggctgaactaattgacactctcaccagcagtgtgtaagtgatcccttttctctgcagccttcccagcatgtgtcattgttttacttttttaaaaaacaatagccattctaactggggtgagatggtctttcattgtggttttggtttgtatttctctgatgattagtgattagtgatattgagaatattttcgtgtttgttgactgcttgtatgtcttcttttagaagtgtctgtgcgtgtcctttgcccactttttaatggagttgttttttgcttgttgatttaagttcactgcttctttgttgtgggagggggaaggcggggatgggcgggagctacaagaaaagaggcatcccctcagacactgggttaaagaaggaagaggctctattcagctgggagcattggcagacttgcgtctcaagaaccgagctctctgaagaaagagttcctggcccttttaagggcttacaactctaaggggtccacgtgaaagggtcatgatagattaagatctatagatagcacatgtggttagagtgcggggttaatctttttcagcttttacttcctccttctcttcagagacaggagacagtaagagaaatggcctctctcctcattcccccctttgagaacctcactcactagtgggagttctcactttcatcttcactatccaggtcttcctgagagacagctgaggtcttttgatgaactaaggtggtaacggagcctcttagtgactggagaaatatgggtaatgtacaggggagtaacatgcaggttcctaatactattattattcctattataagagttttaaatcctcctagagctggaaaccattttccaaacaggaatccaggatcaagcctatgccaaacctgcacgggcacatgtgccagctttgtcatgtctctaactatcctcatgcttcggctatgcatggaccagtcagcttctgagtgtgactggagcagggcttgtcgtcttcttcagagtcactatgcaggtgttgtccgggcttggtctcgcctcccaagtctcagttggccgggagcgtccgcagacttgtgtctcaagaactgagctctcatcttttccttgaatgacctgagagactttgttaacatttgtggccttctgagctcccttctttaacccttccagaagggcttccctgtatgggtttagcctttgcataccctgtctttcatttgggtcccagtgggggtctgttcctggtaattggatcctcacatacttttgggggttttggtaatcagctggaacatgttcttccacccacttagttgctgcttggagcactctcctttcatctgtgttaaagaggtacatgagcaactggtggcaatcagctcaggtggggttgtgggtctggataatagtttggagcaaaccaattatagcttgaggcttttcagtataggatggggtattgtttttcagtataggatggggtattgtttttccaattgaggagatcgacagaggtgaagggtttgtacacaaaggcatgcctttccactatatgcccatcctcatctacccagtatactgttgctttctcatgggcatttgtatcccagttctaggcctcaaatgggctgccaagggaggggtttctcctgaggtctcacatcctgtcttttctaccctgggtggcctaggggtatgtaggccttgggaagctcaggcgcagtggcctcaggagtgggaggccttcattcttggtgaaacggggggccactggtgccatttcttgccatgaatcttctgatgttgggtcggacaggacttcaggagctgactcccctcagcgggtggagcaggattcttctttggctgtctgtccctttgctactagtactgctgctgcctgtcctcttaacgactgtggggggtctaaaaccagctgtaaccaagtgtctatgtacggaaactggtctgggtgtcctggcttaccagttaccttgtgccatacctttgaaacaaggggccagtctaggcttccttctgatggccaacctacttctaatgctggccagtctatctcacacaaagttctaagttttcctggtgtcatagtaactccatagtccccattaaatcctttcttgaaatttttcaacatagttcctagtggagtgggcttactttgcgttccacccatcttcctcctgagacaaaacaacactcacaccacaagaaggaaagtctgaaggggtcactcactcatcttgcctgtctcaaactcaagcactcattcactttcactttcctttttgcaaacaagttaagccaaatcaaaatcaatattgagatcaaagtgccaattgcaatcaagtcaagtcaaatcaaaatcaatactgagatcaaagtgctgataagggcacattgtgggtgatcaggcgacacttccactcaaatggagcgggcaaattcccaggactggtcctactgtattccagatgtccagactccaagtgccggttccttcccggtgttcagctgctgcattgatcctccatggggccctgccgtgcactgctgtgatgaggcattccaccagggcaaatgcctacccggcagtgctctcaggatctgcattgctcaagctggctggagtcccccacagggatgctccgcagggcaggccaaagctgcctaaggggctccctcaactgtccattaatcacctcacttctgggtcagggaaccaagaaatgtagcaggacaagccgcagacaaaacccctcagacaccgggttaaagaaggaagaggctttattcagccgggagcattggccgacttgtgtctcaagaactgagctctcatcttttccttgaatgacctcaaagactttgttaacatttgtggccgtctgagctcccttctttaaccaggtgtctgaggggttttgtctgcagctcgtcctgctacagtgacacttagcctcagtctcatttccagtagggtcaaactgatgacctgacatacttattttctgtgctctcagctgtgtctaaatatccctgtgaaccactataaattcatgggcaatcaagcgtggcccaaaaatatgaccagagtggcgcaaacctgcctacaatagcccttgaagctgattgaggcagtgcctagatgccctgcaagaaggctggtgacacctacccctgtctgaggcatcttcctcatgtctggtagatgctctcttcctgctcctcccccattgtccctggggctcctcaaggctctcgaggcagccactgatggccaggttctctgtgggagttggctctcctgtcagccctccttccttctctcttttgcccacattccctcctctcctgtcttcccccaaaattcaaaaactgtttttattcctgctgcatccccaatcattcatctggagactcacaggtggtcccttccccatcccctgagactccttgggagaagatagttcaggatccgagacttggtctagtacaggaatgagtgatagccaccctgagtgagtgccttcatggctctctggagttccaggcccttgaagcggagcttacacttacccagagtgcagcccatgacagtgtgaaagagcactggctgtagccaagcgttagggaccaaatgcttccaagattccagagcgttggtctagattcactgatgtcatcacatcattccacgaggaatggctctttggtttataaaaggcactcaaggaaaaggccatgagcctcacagggaagggggttagtgtcccagcccgaatgctggagtcacctgctcttaccccaacatgaccttcacgtggggcctcatcttgtgttcaatcaaatccattaatgatttcaaatgaaaatgttacattcacatagcagaaaattgagaatatgcaaaattaaaagttgattaacctctcatctatactacaaagttacaaatattgtttatttttattgccttatttgtgtttagtatcatattaaaatttaaaaatgtaagctttaatattttgagataatcatagattcacatgtgattgtaagaagtaacacagaggggctctagatacccctcatcaaaatttctccagtggtaacaacttgcataactatagttcaatatcacaataggaaattgagtttggtacaatccattgacattgttcagatttcatcagtcttatatacacttgctagtgtgtgtgcattttgttctatgcaattttatctcatgtatacacttgtgtgaccaccaccaagttacagaacagttgtattataagaatacttcctattactttttttagaacttcatcttccctaatccctggcaaccactaatctttacaaccttataattttgttatttgaacaatattgaccaggcatggtggctcacgcctctaatccgggcactttgggaggtcaaggtgggcggatcacttgagctcaggggtttgaaaccagcctgggcaacatgttgaaaccccatctctacagaaaatacaaaaattagccaggcgtggtggtgtgcacctgtagtccgagctacttgtagagccgagttgggagaatcacttgagcccaggaggtcaagcctgcaatgatctgtgtttgtactattactggtggtgaatccacgtgggtctgcagcaacctcagttcttgcctcctcagaagaaagaattcgactgaagagcataaggcagaagaagagactggggcaaattttagagcaggagtaaaagtttattaaaaagctttagagaaggaacaaaaggaaggaaagaacacttggaagaggcccaagtgggcgacttgaaggacaaaagtgcagggtttgttggggtttggtatgcaggcatacttctggggttttgtgttccttctcccctgattctttctttggggtgggctgtctgcatgcacagtggcctgctagcgcttgtgagaggagcatgtgcagtgtgctgactggagttgtatgcatgctcacctgaggcattcttcccttaccagctgaatgcccctaggaggtcatacaccagttaaactctgccatcttgcctcttagtctgcatgtgtgagcctacttgttcaactcctgagattttactgggaagctactgatcaccaggttcaggtgttttctatttatcaggaaactgcctttctctggcactggctgtaaccaattattattttagagagacagttaacaactgcttgaccatcacctggtggttgcctaacattcctggtttggggttgtgaggggctctctcctgccctgctcagacctgaccagctacctactataacagcaccactgcactccaccctgggtgacaaagcaatcctgtctcaaaacaaaaagaaaacaaaaatgaaaagcccccagtattacctaaatggaaccagccagtatataatctgggattggtgtttttcacttagcgtaattcctgatatccagccaagttgttgcatgaatcaatagttaattcatttttattgcctagtggtgctcccagtcatatgataagggcacattgactttgtaagaagctgccatactttgttctagagtggtcctgccattgtacatgcctgccagcagtgtctgagtgatccattttctccgcattgacagtgtttggtgttatcattattttctagtttaaccatataagactgtggttttaactgaagtatcttttcaataacatcacacagttggcaaataatgtttatcctttgcccatgtcttctcattattgagccataatttttaaagatattttattgggtaaacatatttacataacagtaaatgccttaattgtctttgtatattctaaatataatttctttatcatttatatggcttgcaaatattttctcccattctgtattttttttttttttttgagacggagtctcgctctgtcacccaggctggagtgcagtggtgagatctcggctcgctgtaacctctgcctccggtattcaagcaattctcctgcctcagcctcctgagtagctgggactacaggtgcatgccaccacacttggctaatttttgtattttcagtagagatggggtttcaccatgttggtcaggctggtctcaagttcctgatctcaagtgatctgcctgccttggtctcccagagtgctggtattacaggcgtgagccaccacgcctagccctgtctcttccttccttccttccttccttccttccttccttcctttcttcctttctctttctttctctttctttccttctttctccttccttcctttccttttctttctttcttcttcattctttctttctttctttctttctttctttctttctttctttctttctttctttctgtctctttctttctttgtctgtcttcttttctttctttccatctctctctccttccttccttcctttcctttcttccctccccttccctcccttcccctcctccctcccctcccctcccctctctcctcacttcccctcccctcttctcttctcttcttttttctttctctcactacattgcccaggctggagtgcaggaacctagattcaaagatacaattttagcactctgtaaccttgaactcctggcctcaagtgatcctcccacctcagcctcctgagtagctaggactataggcccatgccacaatgcccagctcaaggagtgatactttgtcttgtgcatcctctgtcttgcctttccacttagctatggcctggctagagttcttaatgagagaagtctgctataatcctttctcccaaagagcctcctttatacactacatggtcactttcttccatatacgagagaagagtaagcttgctctctcacatcatcattaccaaatctcagctgggcaattaaaggaaatacttggatatttacttatccaaatacttggacaatttccaaagtagaattatcacagttttggctttgagaaagaacttggtattattgcaggtattttgggaacacttatataatattttctattatacttcttgagaggggttggttatttagtgacatgaattaaggcattataatattaaagaatggggcatcaatttcattggtaagtttcctcttcagcagaaaagagataagaatgttcatttatgcataaaagaacttgtcaaatgctttttttttcccatcagttaatatgatcatgtaatttttcctccttagtctgttgatatggtgaattacactgattgcttttcaaattttgagtcagccttatatccctggaataacttagtcatggttaagaaaaaatatatattgctgaattttatttgttgacattttgttaaagatttttatatatatcttcatgacaaatattggtctgtaatttttaaaataccgtttttatctggttttggtatgaggttaatattagtttcataaaataaattaggaagtattccctgactttttttttgtaagagattttgtaaacttggtgtttaaacttttaaaaacatttgttagaattctcgagggaagttatctgaatctagagatttcttttatgtcagttttacaattacaaattcaatttcttaaattatctatttcatcttgagtgagttgtggcagtttgtaagtttcaaagaagtagttcatatatctaagttgacaaatttgtttgtagagttgtttatagtattcccttattatcatttaatgttttaaatatctatatcccctctttcattcatgatattgataatttgtctttgttttctttgttagatttgctagaggtttattttattaatcttttaaaataatcaactcgttgtttcattgattctctactgtgtttctggtttcaattatattagtttctgctctttactatttccttccttctttctgttttggttttcttatatttatttattttagagacaaggtttgctctgtcatccaggctggagtgcatgattatagctccctgtaaccttgaactactggactgaagcaatcctcccacctcatcctcctgagtagctaggactacaggtgcatgctgccacacctggctaatgttctttattttttgtagagatggagtcttgctatgttgcccagtctgatcccaaactcctggactcaagcagttgtcccagttctgcctcccaaatcactgggattctaggtgtgaggcaccttgcccggcctgttttggttttattttgatctttttctaatttttaaaggtggaaacttagattattgatttgagacttttcttttcttatgtaagtatttaatgctgtgaattttcctcttagcactgctttgggtacatttcacaaattttatgtgatagtttcattttcattcagttctatgtattttaaaaattttctgagaaattgagaactttctttttgacccatggattacttataattgtgttgtatagttttaaagtgtttgaagatttttcatatgtctttctgttattgatttctagtttgattccattatggtatgaaaatatactctgtatgatttcaattttaattttgttgagatttgttttatggccctggatatggtctatcttgataaatgttttgtgaacatttgaaaagataatgtgtgctgtctgatgtcactggggcaatgttctacaaatctcaattatattcttttcattgacactgtttttgtgttcttctaaatccttgctgattttctgcctagttgttcttttttattatcactttttatttctttatttggtggttttgcctagttgttctatcagttgttgagagagagtgttgaaattttcaactataatgtgatttctctctttctccttttggttctatcagtttttgctttacatattttgcagctctgttatttgatgcatgtacatttaagattgctatgtcttcctggtagattgactcttatcattatgtaatatccctttatgtctctgataatctttttgctctgaagtctgctttatctgatattaatagcaactcctgctttgttttgactgatggttacatggtaacatggtatatatttttctcatccgtgtatgttgaacttacttatattcttatatttgaagttaatttcatatggatagcatatagttgggtcatgatttttaatccactctgccagtttctgttttttaataggtctatttagacaatttacatttaatataagtatgagatattaaggctaagtctgccattttatctatctgtgcttatttgtgtgtttatctcttttttttctctgttttatcttccttgctttcctgtggattgcttgaaaatattttataattccattttgacttatagtgttttttaagtgtatttccttgtatcaattttttagtggttgctctaggtgctacatcctgtacatgtaactcaggaaagtctatttgagttgatgttttatcagttcgaataaagtgtagaaacttcatctccctttagataactttaccctatcacattgataatataattatcttaaatagtttctttctatatctcgagaagtatattagacaatgttataatttttgcatcaaccatcatagtttagaaaacttgagaagctaagtgtagcatatatttacccttattttttctctttttgtcctttcttactttctgctattagaagattctttctatcatcatttcctatccatctcaagaaatttccttagttattcttttagggtaggtctgttggcaataaatcctgtttgttttcctttatttgacaatatgttgattttccctgcattcctaaaggatatttgtgctagatatagaattaggggttgacaggtcttttctttcattacttgaaaaaaatctgtcacctctagtctctgttgtttctgatgagaaacacattgtcatttgaattgttttcctcttataggtaaaatgtcatttcaatgttttcaagatttcttcctttagtttcagaattgtgattataatgtgtcttagcacagattcttttgagtttgggatttggaatttgctcagctactcgaatctgtagctttttgtcaaatttgtcatttttcaaccattgtttctttgaatactttttaagccccatactctttctcctctttttcttggtttttgatcatgcaaatgctagaccttataaaaatagtcccatggatccctgaagctctttccccctgccttagtatatattctttttctggctcagattgggtaccttctatttttctatattcaagtccattgattcttttctctatcctcttgtttctgttcttcagccatattgctaaaatatttattttgtttattgtatttttttcaattctaaaatttctatgtggttcttttcaatatcttttttgctgagacgtttttattctttcatttgtttcaagcattttcataattgctcactgaagcttttctattttagcgagtgttctttgacattgtgttggcagaggggaaaagggcattgccttcttagtgccagatgggagtggaagtccaggttacccatttggcaccattgacacctatgctgggaaggggttccttgttactgctaggtagaggtcagagtctaagatttccatgtagctttcaccaacactactgagggggaagggcatgcttcattaatgccaggcatgaatgaaattcctggatctcatctggttttgtccaacaccattctggctggcgtgggatgggtagggtgctttgttgtagccaggagaggatgcaagtctagattctccactcagcctttgctaacaagtgtggggctggagtcacatttttttcatggtgtttggctgggggtgcttatgttgtagacagaagttttctgccttgttaggctgacttttttctggtcctttggctggggaagcttttcttggggccttttttttttttggctgtgcctgttggtatttctaggttgctgcttctctggcacccagtttgagacataagaagccaaaaagaggccaggcacaatggctcacacctgtaatcccagcactttgggaggccaaggtgggctgatcacttgaggtcaggagttcaagaccagcctggccaacatggtgaaaccccatctctactatagatacaaacattagccaggcatggtggcaggcacctgtaatctcagctatttgggaggctgaggcagaagaattgcttgaattcaggaggtggagattggagtgagctgagatcacaccactgctgtgctccagcctggatgacggagtgagtgagactctgtctaaaaaaaagaagccaatcagagaacttataaccatgtcattcatttcttatgtcctgggatccttattcagtttgtcttctttccatatttcaaagtctttcatgcttcatatataatgtccagtgtttttgcagcacttagaaggaggaatagagagaaatttatctactccatcttgtccataaccagaggttcaagagagtaattttattttgccattaaattttgagtgtctagaggccattactgttagcaaactttcttcaacagagggagtgtttaccctgaaagctgcatttatataaaaaataaggtaccaaaaaattaggaagaaaaatgcaacctgagagtatgtgataacttcatgtacacttcttttctcttttatttgttcactattatacctaaaagttatgagaatagagaataacattaataacgttctgacaatccttggaattctaagagaatataagacatccctctcttattttaagaaagcatggaatactgatcagcaaaaaaagaaacgacttgggtggatatcaagggaattattctgagtaaaaaaatctttgagggttatatgctgcatgattccatttatatagcattattgaagtgacaaatttatggaggtcgagaacagatttgtagctgccagtttagggaagagggtagggagagggatggctgtggctatgaaagaaatagcatgaggattccttgtactgtgttatctgtggtggtggtggtcatacaaatctacacataataaaactgcatagacacacacacatactggagtgcatgtaaaagtggtgaaatatcaatagacgaaaggattgtatcaatggcaattttgtggttgaggccagacactacccagagacttcagtgaccctcccctgctggtgatattgtactatatagtcctgcaagttttcaccattggggaaactgggtgaagggtgtatgggagtctctctagtgtttcttataactgtatgtgtcagtctacaatgaattcaaaagaaaaaagttttaaaaagcaaagcaaagcattttgctattttgtactttcttcctctgcagactgccctactcacttccctggtgcaaagaggaaatggacagtctaatgtggcttctgcttaatagtctcttgtgtgcatagagaacctgttttttcccaattgtgtaagagttggttgttcttttctccatgaactattgtttgggctttgagtgagtgaggggagatttggtcctattctggagttacaagagggagaatctgacttatgtaggcaccattggtttccactgctgtccttaatgcccttctgaataagccaggtgattttctctgcacagtcctgaggctacatccactgagactggctctgtacaaagatgctaaacgccagacactccccagatacctctgtgccccctcccctattgatggagagcagaagagatatgagtctttcacggaggctgacatcacatgcagactttggcctcaagtctttgtcacttgccaaggacagaagaaataccgtgaactagaaagcttttgtgagtataaggaggagaaaaaaattagccagagttgcaagatgctttatgttgtttcaagtttgttctcatctctaaaggtaaactataggacccacctgctggggcaggtagatgagataatcctgcattagtgaactgtagcatctgactttcatagagaatggttttcttagtagaaattggggcgcaaaaaaatgaatgcagttatgggaactttgcgatgagatgcaaaatatctgggtagaaagcagataaattaccctcatgtatgtattttagtataaagtggacatgattactaggtaaaatgcacagaatttctcagttttcattgatggtatgaaatgtctcacactcaaatgtcagtaagggccagaagaaaatgtaaatataaggagttagtggataaacaataatagaaagtatggggcattgtcaataaactggagatcttggattcaatatgaatgttttcaaattcaaatttttaaacattgtgatggctggataatcacatctgaccacagatggtcagcagctgcttcaatataagttgtgcttggcttttctacatcatgaacccggaaattaagcttttctgtatataacaaaagcacaaatatcaatggcgtaaacaagattaggtcacctgcttctcgttaggatgtagaaagacatgaaaactttcctcctgtggtgatgacaagaatgaaccacataagaatcgtacgttcatggggctttcaaagattggaagatgtaaggaagctctgatgaactgaattgtagagggcgcgccctctagatgagccgagaccctggagctctctggggcaagtgcctgaatgagttcaggtgggaaaagtagcagctgcctacaggcaggaggctttgcagggttaagaaggagcatcctgcgtcaggggcaacatgtggctctggaggagttccaaatgcaaatatccatctctcagcccaacaactctcttccttacctggaattttgctgggaaagtggcattggagaaggggttggtagcagggagaatacagacagccttacacatctctgtgaggcttgggttctggagccctgcagaaggtgaacctaaaggtgaatccaaactgtctgaaacagtagccactccccagcttccaaacatgaagaaaaggtaagaatcctttaattatagcaatgcaagaggctggggttgggctaccagagtttcttacattagatgtaaagtggtatgatatgaattcaagatagagattgccagactggataaaaaagcaagaccaaaccatacagtatttacaaagatacactttaaatatgacacagatacattgaaagtaaatggatggaaaaggaaaaacatggtaatgtccagactcaatgtgagagggaactcacacagaggtgtggctgattttggcattgggaggtgtgactcattggcattgggaggcatgggccattggcactgggaggtatggtccattggtactggaaggcatggcccattaggactgggagttattgaacattgggactgggaggtacggctcaatggcactgggaagcatggaccattggtgggaaccatggctcactgcactgggagatgtggaccattggctgggaggtgcagctcattgccctgggaggtgtggaccattgcacgaggaagcatggaccattgcactgggaggtgcagctcattgccctgggaggtgtggaccactgcactgggaggtgtggccactgcactgggaggtgtggactattgccctgggaggtgcggaccatagcactgggaggtgcaggttattgccctgggaggcatggatccttgaactgggatgcgtggaccattgcagtgggaggtgtgggctactgggggccatgtggcatttgagttatggcagaatgggtctgggaaagagaattctgggctaagagagtcttccgttctttcttgtttcctcctctggaaatggctacctcttcttcctcaaaggaagctgaggaatgtctgcagcaggcaggctgtgtggggacttctagaccacaaaggcctgtctctgtgacagcttaggcctggtggggtgttcatggctgtgaacaccccggagagaacatggctgtggtctttaccagccctccattcctcttcccctcatagatctgtgagagaaaaggaaaatggatgtgttccttcgttttaggtagaagggctttgaggactggagaacgcctagggagaaaggggtgatcaaaatataccgttgttccaggatgtaattataaaaaactgggctccaaatatgaattcaggaatacttggtccccgtgccaatgcagccaagcccctgcacggtgtgggagcaactcctggggttggtgggaggcctggctgatgcatgatgggtctgaaaaccgctcaggctttgccaggtatgtgtcaggcactgatggcggcgatcggaccggcctaggttggcttagcgcgccctctagtgggagaaggtctaaagagcaaaatgtgagcatccttgccacagggcagaaatgatgctgaacgtgcacgccacatcaaaggacatacgtgcttaagggacttgtgcttaacaattactgtgattagtccgttctcacgctgctctaaggacacacccgagactgggtaatttataaaggtgttttaatagactcacaattccacatggctggggagccctcacaatcatggctgaaggcgaagaagcaaaggcacgtcttatatggtgtgtgcaggggaactgccctttataaaaccatccgatctcgtgagacttattcactatcacgagaacagcacgggaaaaacccacccccatggttcaattacctcccactgggtccctcccatgacatgtggggattgtgagagcaacaattcaagatgagatttgggtggagatagagcaaaaccatatcagtcaccatcttaaattgttaatacattggaatttgtttatgtctgttgtaaaaaaggccagtcgcttagctatttcatggcggttttgaggaattaccaccataacttatgggagagtgttttggtaaatggttacataagtatgaggaattttaattttttcattagaaataatgtgtggaatttataggacaatttattaagaagcttaaatgtatgtatggtcgttgattaatctaggtccatttctctcctagagagctgtcaatagagattgagtgtgtggtaaggcttcctcctcggtgggccttttagtgataggatggtcaagtgaggaagggctgtgctcctgcggctcctaattctgaattacatttattgggccatgcagtctggtttagtgcctgagtttatgtatgggaaatgaattccatttctacatgctgggtccttatcagagcagaaaaaagaacccacgctatgcagatacataaatgtcacccacatgaacaaggcactgtcttcagtatggcatgaagggggcagtgatgaatgggcagctggagaggggagcgtgttcagatgagacaggctggtgcagacatctggggtcaaccacagcagacactaaaatgcagtggggccgtggtgagggggatggaggggatgtgggaggtgagtgggagctgagggaagaggagtggctcagaatgcagtggggggtctgcgagaggaccagagagggaggaagcctctccttgggaagagttgggggcaggtcaggagaggttccaggtagagtcagaggtggctgggctggggtggtgaaagccacccttatcctccctgtgactcttagggtcattgcactgcttttctgcttccagatgagatggagtagcagggacggcgtttatcctttcacctgacataattaacacaggacaaaatagatgaggaaaaaaacaacaaagcgaaactgttgccatcagacagcgcagagctgtggtccctgagagggagagacagacaagaggagtgctaggatttccccagagggtgtggcctggacactttccaagctgtggcccatggatgtggctgctgtcgtggtggggtccctccggggaaatcactttgtcagtgaacagcaacatccttttctgatttttctagtaccacgcattgttttctcccattgtccaacaaaggaggcaagaatgcagtgtgccgcattcctcctgcagcagcgctccggtggcgtaccttaacctcgcttttgttttttcatgtgttggctgagtcagtgagtgtgctgtggtggacctctgccatttgtagctcctcaaatcttcagcaccctcttcacagtttgatagttccccacagtgtacctcctgccttctaatgagtctccaaatattccatttcacagccatccttgtttttgaggtgcaaacatatgatttaggtccagggatcataggcacccactcaaggctttgatcccaaacagttcccatggctggggcagagtgcggtggaggggcaggggcaggggctgacagctgtggcagaggcttcctgattcagctgcctccagatggggccagagcggctgcccctcactgcattagatctatggtatggcactgggggtctctttcttcagcattcgatttggtatgttatcttttttttttctttgatcagcttttcattatctctattcacaagtcgttataatattgctatttatcagtttaatgtaacacatatgataaaaacagatgataaaaagtatcatattaacaatgagaacattattggctgggtgcagtggttcacgcctgtaatcccagcactttgggaggccgaggagggcggatcacctgaggtcaggagtttgagaccagcctgaccaacatggagaaaccctgtctctactaaaaatacaaaattagccaggtgtggtggcacatgcctgtaattccagctgctagggagggtgaaacaggagaatcgcttgaacctgggaggcggaggttgcggtgagctgagatcgcgccattgcactccagcctgggcaataagagtgaaactccgtctcaaaaaaaaaaaaaaaaaaaaagagaacattattttacacaacccatttactgaatatgcagcctcttgcaacaataacatagtggacccaactctaccctctgaatggaccacttttatgattctcctaaaaagttttgagttggatatagtttcttgttgcttctctctgtgatccgagacttaagaatgagtctctggaaacgcagcaattggaaccagacctccccaggatcaaagaggacaggagtgggagaaaggacgcaggacacgactcccaccgtctccagcgctgcgccgtatgcttgacctcagagcatgcaggcactcaatgtcaagtgtgcagccacgtctatatcctgcatctcaagtgctcacaactgtgacaattagcagatatgggagagaggaggcatatcatggaggaatgagtcagtcccaaaaattacatgaacatttctgaaatttcaataccaagggttaacttctaaagtactagtgtataaacagaagccatatagctagccatgaactgaaatgcatgtaccatacagtgaaggagctcctgtgcatacaaaaccacccacgtctcatttatctctaattttaaaataactcattcccttgctggatatgcaagtgagtggtggagaaagaggtctatctgcaaggctggcgggggttaaggatttcattgcttccaaaagacgtgagcaagagaactttattactcactgaaggggattcttccttctcagccaagatggtcccatttaaatcacttttgaatttcctttcaagcttcaattgtgcaaattctagttgtggttgaggatcgtccccaacagctttttgagttattccttggactcttcctttttctactatgttttcatgaataattctagaatccatatttatatccagcccaaggcttctttcctatagaggtgtcgttgagttgtgagcttcaaagatctgatcatactgtttaaaagcaataggcttgggagtccagatgtcagcttctcagatccattttcacagtctgatggtgtctgctagcaattatcagtgcctgacccagaagcggtctattgcacctcagcttggaggaaaaagtgaaggcacatgcagtctgggaaaaaaagagaaaggaaggaaaaggcaggcaggcaggcaggcaggcaggaaggaaggagagaaaaagaaaggtggtaggtttctatgtactgacttggatttgtgtactgtgttccccaggcaattctaatccggactgcattcccctcaatgtctctaaagctgtcacatttgtaaatgcttactgcagaattttcttttttttcttttctttctttttttttttttttttctgagacggagtctcactctgttgcccaggctggaatgcagtggtgtaatctcagctcactgcaacctccgcccgtgggttcaagtgattcttctgtctcagcctcccgagtagctgggattacaggtacctgccactgcacctggctaatttttgtatttttttaatagagacggggtttcaccatcttggccaggctggtcttgaactcatgacctcgtgatccacctgcctctgcctcctgaagtgttgggattataggcatgagccaccgcgcccggcctgaggaattttcttaaatgaatttttaagttgtttcatatcaaaaaggtcagcatcttcacctggtcctttactcatctgaaaagcatcccaaactttcttgtgctgatgaaattgagtataaactgtgtctcaaagggctgcgtcatagggatttgcatgcttctcacacagcagaaccaagtgctgaatgagagagtcctttctctgccggaaatttaaagtctgcagttgattttcagacaaaaaatcccaggctttaggattgttgtcatttccgtcatggggatcctctttctctcttttctttctttctttctttctttctttctttctttctttctttctttctttctttctttctttctttctttcctttctttctctctctctctcttttctttctctttctctctttatttctctctttctttcctttctctttctttctttctttctctctttcttttctttctctctttctctctttatttctctctctctctttctctctgtctctctctctttctgcctttcttgcctttcttgcctgcctgcctgcctgccagcttgcctgcttgcttgcttgcttgcttgcttgcttgcttgctttctttctttctttctttctttctttctttctttctttctttcttttcttttcttttcttttcttttcttttctttcgacagggtcttgttctgtcactcagcctggagtgcagtggtgtgtgatctcagctcactgcaacctcgaccttccgggctctatcgatcctctcacctcagcctcctgagtagttgggtctacagcatgtgccaccacgcctggctaattttattttttgtagagatggggtctcactatgttgcccagtctggccttgaactcctgggctcaaatgatcttcctgccttggcctcccaaagtgctgggattacaggagtgagccatcacacccagccatgaggatgtttgagatgatcctcttaataaactcaacaacagtctcatccatctctctgtcatggcccacgtcttcagctacctctctcctcctgcatgctatctttgtcctataataaatcgttcactcctgaaacctggtagaggggattctgttgtctataacccccaccagtgcatttctatctaacggttaggaaaacctccttggctgggcacagtagctctcacctataatctcagcactttggaaggccgaggcaggcagatcacctgaggccgggagttcgagacgagtctggccaacatggtgaaaccttgtctctactaaaaatacaaaaaaatttagttggctgtggtggtgtgtgtctgtagtcccagctacttgggaggctgaggcaggagaattgcttgaacctgggaggtggaggttgcagtgagccgagatcacaccattgcactccagcctgggtgacagagtgagactctgtctcaaaaaaaaaaaagaaaagaaaagaaaggaaagctcccaactaaacactcaatggcctgctcataacaggagacacaggggaggtagtccagggtgggcgagtcagccgttcagcagcatcgtgaagaagccagttccttccaccttctactcattgttgtgcggcttcttcccctttgcgatctggtgctgcattccatctctagtcttcgggcatcactacttttccctgtggtgctcaacaggccatacagggcagctctgatgttggccaagtggaactgatgtggtcaggagacacaaatccattgagaggaggcagcttctccttggaagcagaatctccctttttatatccatgagaaacagccaggagagcaggaagccaagggctttctccttttctgttgcatgccagcgccctctttggctatgagcagcaggtctctctcccttcaccactgcatttggatgagactcagaggctgcttttgctgtcatctgtttggcttacttggtaagtttctgtgatttgaggcttgtcaccacttgtagagtttttgcttgatcgtgtgttgtttgtccagctttggttaaggccgcttaaaaccctgacctttggagactttgtgtgcaggattcctatttcatcattgtcgtgttttgtcgcaaagtcaggtttgcatcttggagagctttctggtcccccttcctgagttttgtgcccagttttgtggatgagtccatcataaatcttgtggatgaaatcttccaggtgcttctggacttttctgttcttttgcttcgcctgtgtagtgagagggagaagtccaacattaaatgagccctatttttacccaacgtctctttctccctgaccactctgtgtaaaatgcaatcataactcctccttcctgaccagcacttctagtcctctttatcctattttttctttctccatagcgcttatcaccctttcctatgccatctctgcctccagatctggaatataaagtcctcagtaggaaatacctttatctcttttgttcaatgaggtattctaattgctcagaatggtacctgacacatattaggtgcccaataaatagtttgtgaataaatgagtgaataaatactcaggatttttaacaaaagccaccaaagaaaacatgcttaatttattcaggaggtggaaatcttgggtgggatgaattccttatgagacctgcgagaagcgcaggtgatagtttgtgtgtgtgttcgttgtgcatttttattgatataaaacagaagcactggaaagtgtgggaagtgcgcatgtcatgaggatgcaggcccttggctggcttgtttatttcaggggtggttaggcattgtcgccctgggtggaggggtcagcgacgagccctctgaggccatcctgtgacatcccctgggcacctcctagtgtttgtcattcccgacgccccagggccagtgtccttggccttggagatctcaggctctgctggtttccccacctccctggctgtccctttttagtcctttcccacctcctgaccagacactgaacatccttggggctggtctccttcatttcttgctatattctttttttttaaagacggaatctcgctctgtcacccaggctggagtgcagtggcatgatatcggctcactgcaacctccgcctcctgggttcaagtaagtctcctggctcagcctcccaagtaactgggactacaggcatgagccaccatgcccggcaaatttttgtattttttagtagagacagggtttcgccatattggccagggtggtctcgaactcctgatctcaagtgatcctcctggctcagcctcccaaagtgttgggattatagacgtgagccaccgcgcccggccactatattctctttctattcaatttcattcttccctgtgcctctgcttaccatggggcacccacttgcagaggatgcctgattccatgccctggctccctccttggtggcctcatgcatctcaaactcaatatacccaatgctgtgctcagaccttccagctcaaatgcgctctgtctcagacatgctgcaaccatcctcctgggagttgacacctccccaccgtatcccctcacatccagtccctcagcatgttcccttgatcctaacttctaaagtgtccttgaacctactcacttctacctcccatgtgcccaccagacccagccccaaccacttttcgctggggtaacctcagtagaatttacactggtctcccttcattctctcacgcacacgacaaaccattctgtaccctgaagctggtatggtttttgaaaagctcaaatttgattgtgtctttaatgagttcccattgctctgaggtcagtgtggcatctttcatggggaaggtcatggccagcccccttccccttctcttcctatgttccagccaccatgacctgctgtccagtggtcatgagctgagtccctcatacccaaggcttttccagatgctttttctctgctggaacactgttcttgccttgcgttgctagcaaagatccccatgttcattaagcgcctcttaaatgtgacctctccagggaagcctcctccactcccattgcccattgccctggctcagtcagaccactctgtgtcttccttgttggtgctctctcctcttgtcattaaatcgctccatgtttaatgtctgtatcctccacttgactgtatgctctacaagggcagggtctaggctggcttggatgttatgctgctgaatctacagggcgaagcataggaggtgctcaataaactgaatagattttgaatagatgttcactgagggtaatactgaggagtggggttgttctcaatccttactgtagactccaaatgccagtactgttgggcgttgcttcctctgaaacactccttgaagctctgagtctcctttggatggttttacccaactccactcgtgcctccatcccttgctgcctctccagacatttgccttccttgtcattttcaggccgtcagctacagtgactgggaatgtgtgccacttggctctcacactcgcctctcactgtcgtttttctctcacgggagtttatcatctattcttctcatttccttgcctttctctctgcagcaccgataaatcatcagtttcacctgaacttcagaaagaagccattccttaattttggcagaagcacgatggagtagaaagtgaccaagtagactgacttctgatcatgtctctattgtgacatgccttcatgagctcccattgttcttggggttaaggcctttaatatatgttacaaggttggaatcactctggggaaatggccgaaactccctgagctttgtttcctcaagaggaatgtgaggtggattggattaaattccacctacaaccatttccatctcttacatttccagaatttgtcccagaatcatagaagcaaaccttgttcagagaggccatatccagctttgcaaaataaaaaaaaaagtcactgtgctggtgagatgggcctcaatcctggtcacatttctctcttctctccagatatctatgcttcctccctctcctgcctccccagaatataaacagctccctgagggttgaggatgttccttcgtcccactcccaacctgtcacccccaacttccagatttctttaaaagtcaaagagaaaggaaattttcaggaaggagatcatgtctaagagctttttattagtctcatcttccaatttcctgtagactcaagcttctttctttctgtcgtgcggggtttaatatccagtggctgtttgacaacagcaccaggaaatggaatttccatcctgattctgcctggaaccttgggcaaagtgcccaaaccttctgcctcactctcctcctgggagtaacagtccccaccctacagccttctggggcaagcaacagagacctaatatgaaaatggaaccagagagttctgatggatgtaaagtcctcaataaatgcatgcaggtattatttgttaatttttgccataggcaggctgcagcccccaggcaaactctgagtagaaggagcctataaaaacaagcctcctgcttctctctctctctctcatttttttttttttaattttttttttagacggagtcttcctctgtcgcccaggctggagtgcagtggtgcgatctcggctcactgcaaactccgcctcccgggttcatgccattctcctgcctcagtctcctgagtagctgggactacaggcgcccgccaccatgcccgactaattttttgtatttttagtagagacggggtttcatcgtgttagccaggatggtctcgatctcctaacctcgtgatccgctctcctcagcctcccaaagtgctgggattacaggcatgagccaccacgcccagccgcctcctgcttctctcttgaagcctgggttctgctctggtgtctccccagctcattgccggttgacggcacattgggctccctgtcagtcaggttggccacgtgaggaggagtcaatgaggcactgcttcctgccaagctgaggctgcccttcttataataaggaggtgagcctgtctcagggaaggttcttttcctaaatttcaggtgggattctaaacaggacaccactgatttttttaaaaatgaacctatcaagacatgcattttcatgggtgtaatcctgtttgaagtggtcacatttggggtttttatgtacttgctcctattactggtgaaacttctgtgaatgggcttcagatcatgaacagcctcagtggtggcagagtctcatgatttcaagttaccttatagttgagaaatagccccgcagggtaggtgatggcgtactccccacttgccattctatctggaacccggaaggtggtcaatccatattcactgaaatgaaccaagaaatgagactgtggctataaggttgaggatgttcatttgcttgtgaagcttctaaacaagatcttccaaacagttaagagaacacttggatatctttatgatggtgtgtttgctttgaaaaataaacatgaaagagaaccattatgttatagctccgctttctagtgagtaccccgtcaaggcatcatatccctctgtgtagcaatggaaaggcatttaacccaatgattgaacctctctgtgcctcagtttcctcatctctaaaataataatagaacctagctcatataactgttaagggggatcaaaggaggtaaaatgttgtgacaaaagttgcataacacagtggagtgtatttcattcattcccaagtctgaacttatgtgtagaataatgccacaatctatggccctgtgtcctgaaatgcccttcctccaggcccttttggagcaagagctccaaggggctgttccctcagataataacctaggtgattggaaaccttgactagggagcacagacctggaggtcggttccagtgtgggacagttggtcatatttcccactcaccctctgccatgcaaagtgggtgaggcagtggctctggccagttcattggcaggtggcaaaaccttgtctagtctttggcattgggcatgtgataccatcgatggccagtaggtggcacaagttgtccatcactgccgccagctttgctccattgggtgctttctcagaaggggaagatctatttctaatccagtcctggctttatggcaatgcttaatcacatggaagggaacatgcaataactactggtatttctgtaaacatgcatgctaagaatcagctgccatttggaaatgaggatggagggaacactcagtgagaggtctcctgaggacaatctaaaaaaggaaaaccttgagggttttaaaattttagagccagttaacctttgtgactcatggagagaaacgtttagaacccagaaggacaatgagaatacatcctgtggattgtaacctggtccaaggtccaccttgccctctccaccttccttcagctgtgaagtttaggaaggagagacaagatccccttgcatggagtcagcttacccacttcatgacccccagcagggccgggctgcaccttctgggctgtttgcttaattttttattcttttgtcctggcaagttgcctgcttcttgggtttgtcgtttccctggaggaaagtttatttgaatctcattctacccttaataaaattggcaccagataaatacgaagcggatgaagagacacattgcagcaaaacaaaaagtggaacgtggtcaacaacagggcgatgaggactttaatacatgtgtacactttctaaataaaaaattttcattgtagtaaaatacacataacataaaatttaccatcttagccatttctaagtgtacagttcggtagtgtcaagtacgttcacactgttgggcagctaatctccaggactcttcatcttgtaaaacagaaactctctacccattacacaacagctccctgttcttctctcccccaacccctaacagccaccattctacttcctgtctctatgaacttgattactctagtgtcaaagaaaagaatcaaactctgtaagatatttgaagagatttattctgagccaaatatgagtgactgtggcccccgacacagccctcaggaggtcctgagaacatgtgcccaaggtggtcggggcgcagcttggttttatacattttagagaggcatgagacatcaatcaaatacatttaagaaatacagtggtttggttcagaaaggtgggacaactcaaaactgggtcggggggacttccagcttataggtaggttaaaaaatattctggtttacaattggctgagtttatctaaagacccgggaccaacggaaagaaatgtctgggttaagataaaggattatggagacccaagtttttattttgcagagaaagccttcaagtggtaggcttcagagggaacaggttttaaaatgtttcttatcagacttaaagtctgtgttgatgtcagtgctggagaggtatcatgaggcatgtctgacccctgctttccatcatggcctgaaacagtctctcaggttaaattttaaaagagccctggctgagaaggaagccctttcagatggttgcaggggcatggggggatgcttagaattttatttttggtttactctaggtacctcatataagtggaatcacactattttgtcttttagtgactgggatatttcagcataatgtccacaaagttcatccatgttgtagcatgtgtcagaatttccttcctgtttaagctgaataatattctattgcatgcgtgatggttaattttatgtgtcaacttgactaggttaaggggtgtccagatagctggtacaacattatctttgggtttgtccttgaggacgtttccagaagagatgagcatttgaattagtaggctgagtaaagaaggtccgccttcgccagtgggtgggcatcaacccatctgttgagggcccaagtagaataaaaaaggcagaggagggccgggcttggtggctcatgcctgtaatcccagcactttgggaggccaaggcaggcggatcacgaggtcaggagatcgagaccatcctggctaacacggtgaaaccctgtctctactaaaaatacaaaaaaaattatctgggcgtggtggcgggcgcctgtagtcccagctacttgagaggctgaggcaggagaatgacgtgaacccaggaggtggagcttgcagtgagctgagatcgcgtcactgtactccagcctgggcgacagagtaagactccgtctaaaaaaaaaaacgcagaggaggagcaaattctctctttctcttcttagctggagcatccatcttctcctgccctggggaattggagctcctggttctcgagctttctgacttggggactcatcacccttagccccgcaggttcccaggccttcagctgaacgttggtcactccaatggctcccctggttcccaggccttcagattcagcctgaacgacaccatggctttcctagttttccagcttgcagatggcatagggtgggcctctttggcccccttaattggatgagccaatgcctgtaataaatctcctcttatgtatctgtatatattctactggttttgtttttctggagaaccccgactaatagagtatgtacataccacattttgtttatccacccgttcaccaacagacactcaggctgctgccttctggccattgtgcataacactgccatgaacatggtgtaaaatgcctcttcaagaccctgcttccaactcctttgggtatatgcccagaagttgaattgcttgttcatgcagaatttatttttaattttttttgtgtggaacagccatactattttccatggtggttgcatcattttacatgtccatcaacagtgcacaagggttcccatttgtccacatccttgccaacatttgttattttctgtttttcttttttcttgatggtagccatcctaatgagtgtgagatggtgtgtggacacttcaagtttgctctttctagggctttttctggagtgggcaaggctccctgatcccttcctctgaaagtggtgttactgtaaaggtggcattttcctgctggtcatggtggcacgcgcctggaatcccagctactcgtgagactgaggtggaaggattgcttgagctgaggagtttgaggctgcagtgcactatgattgctcctggaaatagtcactgcactggagcctgggtgacatagtgagaccttgtctcaaaaccaaccaaccaaccaaccaacccacccagacatttccccttctgccctcccctcagagctctgcctagagagcctgctgagtgtgggtacttctgggttggtgtctccaccctaggaacccacttgagagtgactttatttggaacaatcttcagtcacaggaatcttctgggaagtcaccagaccattgctttgaagagtacacagcctcagaccctctggggacaggagcaaggcaggctgatttattaaccacgctgcgtcacccttttgccctagaggttagatggtcccaggagcccccctcgccaagacactcctcagagtgggggtaggagggtgggaagttctagatcctcagtctggccttcaaatattccattacattgccggggacatggcgcacccacatttatccaaaggacaggggtctccagaaatgtctgcccgcaatatcctttggttacctccaaaacattctcttgaagttgtttaactgccatacattgttgtgggccggccttttattcccagattcacttatttaaaaaaaaaaaaaaactctcgagcatctctgaagagagaggttatatggcagatgcaagtcagcagaaggcagagagctgagaatggtggggagagagacacagggctcacggtgtgacaagcttcttggtgagtggtcaagtgcgtaatggccaggtaggcggctggtgggatgtgctcaggcagaccagcgtctgagtcccaggctggtcactaatttgctctgcgtccttgggcaagctccttcctttctctgtgcctcagcttcctcatatactaaatgagggtagtgagagctagctcagagctgttgggaggtttaaatgagtggatgatgtaaatacaagtgtcaggaatagtgtaggtgctctttagtgttcacccactgctgtggtttgagtgtgtccaaagttcgtgtgttggaaacctaattcacaacaccaacagtgtttggatgggggaccttcaggaggtgattaggtcatgagggctctgccatcatcaatggattaatagtgttaccttaggagtgggttaatcattgagggagtggtttcttgattaatggataagttcagtcccctttctctattgctccctcctgctcttttgtccttctaccttcccccatgggatgacacagcaagaaagtccttgccagatgcagtctccttgaccttggacttcccagccttcagagctgtaagaaataattttttttgttttctttttaaaataaaccacctgtatgtggtattctgttacaggctaagatactttctttctccactagccacttgctcagtacaagttgagagaagagtgttgtgaagcccaagtttaggcagagaggagcaggttagggcaagtgagcaggcagggtttgtctctcacccacctgcatttagccaacagctaccagtggcagccactgggctggtggacatgttccctgccacggagagaggggagtggtccagctgcaaggctctagttctgggatctagtcttggtgacggaggatcctggaaccatctaacctctggggcaagagggtgacgccatgtggttaataaatcagcctgccttgctcctgtccccagagggtctgaggctgtctactcttcaaagcaatggtctggtgacatcccagaagattcctgtgactgaatattattccaaataaagtcactccctggcaaagggataagtccctacccaggagctgcccaaatttttttttgaaacggagtctcactctgtcacccaggctgcagtgcagtggtgcgatcttggctcactgcaacctctgcttcccaggttcaagtgattctcctgcttcagcctcccaagtagctgggactataggtgcccgccaccacacccagctaatttttgtatttttagtagagatggggtttccccatgttggccaggctggtctggaactcctgacctcaggtgatgtgcccacctcggcctcccaaagtcctgggattacaggcgtgagccactgtgcccgacctcctgcccagatttctattttattcttgcactcagctaacagcctggctgcccagaggcaggtacaacttattcaagagcaggagaattccaattttattatttaaaaaatcacataattaactgagtattacaagctttgagatgtttgttggttaataaagatgaatgggctatttgaggtaatggcttttaattaaatggaagctaataactttggtaagtttgtccgagtagtaatcttggctaacagtttgaagtttcgtacaataatcttggctaacaatttgtagcttgccttgcactgatttcatagcattcattgtttacaacacgcagaacacccactttacagatgggaaaacggaggctgaggctaagggcacaggaaggctgtggggggattgcagtccacagcagccccgggggtctcaagggcatattccttttaatcatggcttcccacacaacatgcatccctaattctgttcacctgacccctgactaaagctcagctttagggcaggagatttaaaatacaaactcattatatctgcaggtgtgggctgcagggagggcttggagatgtagaatcctcctttgctgccatgtagagagaggaaagactgcatgcaggcccagctctgctactcacggcctatacaaccctgcacactttatcccagagcttaaatcttttcccttcttgcagctcttcttctgttaagggacctagagcaggacataatcatctgttcttcttatggaggggctaaggaacaagaaaaatggtaaggagcaaaaaatggggccaggtcatttgacaaggaaccctgggaaatgcaaaagttgtatattctttgctgagttggagcattagtgacctttctctcttttcttgtgaatttacaggagttgcaaaggcccagcacctccctgtggcttttaaaaccaggtatgtgggcaatgctcagcagagactgaggaccatggccggggtgccctgcagccctttcatgccgggcagctgcagcctttaatttgggggctattgtggtattgttggtattattcagggtttgggcttcaagagaacctgtgatgatttctttgttatttcacagaaattggtctgaacggttggcatgtaatgcggtggcactggttctcctgtgtttgcccaaaaccttgccaggagaaccaggcagtggacgggtgtgtggtcagtgtggtgacctgcaaacaccactgtccacacctcatgctcttgctcaagaattttcccaggctccgtgcatgtgtaaatttgcaaaaataacaaagccaaccttcattgtttgttctctaaataagaagaagcttcgtggtttgtgttcgagtgaaacagcaagggagaattttgatcctgtggaatctggccagaccttacagggttgaggggtctctgcactcacatttgccgtgttcctgtccctctgcctctcacctttgaatgcctccctggggcagatgctcccggctcctactcctcggatcctttgtgtaatttctcacaaatttctagagctcacatggaccttcctttcatagtccaggaacacacagggttgatcctcgaggcctgtgcctctctccgggcacccgtaacaccctgctccatgtttgcttcaccttggagtaatcaccttgcactcaccccattgtctttgggggcttatgttttgtgggtgatagagtgcatcatctatgaggtaaaatcttttatgtgtgtttgcttattccgggatgcactggtggccaggctgtgctcattctggctcactgagggtgtgttatcatcctgccatggaccaccctcttctagaaggaacagaacatcagggtctccctcccagccccctgttccaggtaaccacagcgtactgcaggaacaaaggtgtagactgaaagtaagttaaaggacagggctgaggcctatagactgatttttcggagtaaggaggtgggcccttttgaaaatattgagatataatttatataagataaaatttacggctgggctaggtggctcacacctgtatttctagcactttgggaggtcgaggtgggtggatcacctgaggtcgggagtttgagaccagccccacacaaaaccctgtctctattaaaaatacaaaaattagccgggcgtggtggcacgtgcctgtaatcccagctacttgggaggctgaggcaggagaattgcttgaagccgggaggcagaggttgcagtgagccgagatagcgccattgcactccagcctgggtgacaagtgcgagcgaaactgcgtctccaaaaaaaaaaaaaaaaaaaaaaaaaagataaaatttacctattttaagtgcacacaatgaattttggtaactgtatgcatttgtataaccacccgacaatgagatacagaacacttcatcacccccaatagttccctcaagcctctttgcagtttctcccctccctttggcctcagcaaccagtctgtgagtctagttttgcctttctagtctttcatgttaatggaatcaagaagtgtgtactcttttatgtctggcttcttgcattcagcatattttggagccttgtccgtgtcactgtgtgatttctctttattactgagtagtaatgcattgtacagaggtagcacaatttggtttttcatttaccagttggtgaatattcgagttgtttccagttttgggcaattaggaataaagttgctataaacattaatgtacaggactttgtggggagttctattttcatttctctttggttcatattcaggagtgggtttgctaggtcacaggatagacatatgttaaaactttgtaagatactgcaaaactgttttccaaggtggctataccatttgtattcaaaatcaacacttttagcctagagcatataactggccttcctgaaatccatggatatctatctgtgcaatggttttagagacattttattgcctcccacatgtaattaagttacttggcttttaggcaaaagatgataccatgtctatggatgagatgactctagttttgaactctgggttttgcagaagagtttgcattatcctcctcctgaggaaagcagatacatccgccacgatgcatgtgagtcaggtcttctgcgtgtcctctgaatcaggttcgcatgtgtgcctctaatggcagtttcgagttcatcctgtgttgagataatgcctgaaggcgagaggaaaaaatatctgtggttgtcaaatcgggtggaaagtgattaatcatggagacatttacggcatgctgaactgtttcgtttcctgacctttgtcccacgtgcgttaggggcaggcggggtcaagtttaaatccaagatgacaagtgtctgaggctaaggaaggtttctgctgaatacttggcttagagtcaatggctccatgtttcacacctggtgaaaaccgactcgcaattgaaagaaacagcatgggagtgtcaaacacttgctgacttggccttgggctagagcttcttgcgagggttttagaactgacacaccctttggatgtgctgggggcatctggtttttggtgcctgagtcacaaatcctggaatacatttgcccacagtgtttccataccattggaagtgcattatggctgcttctcttagagtcctttaacctcttcctcaagagccagctttgtcaacttgatgtatctcatggcaggcatggactcatgcctgtgtgtcccattgtatccccagatcatgggatttgtgggattcagccagtgtcatttactaatcactaggtccagggccaagtttaggtgaggttcactccatctaagctgtgttttgggggagggagggtctctattttttcatttagagaagtgactagacactagaaaatgtcacagagtaaacgtatggactacagcttgttttctgaaaaggtttagggatcccgtgttagtattgaaagaccctttgaggcctcatcccctccacccagtgggcacacaggcctctgaccttcagcgccaagtctcccttgaggtcagcttctcttcatctttcacttcttttctcttcctttcacccctgctggttgcagcgacaaggtccctgccaactgcggtgtgcacactggcgggccttcacctcccttaaaatccagctctcgaaatgtctgcaagggagcagcctgcaatattacctaatttgtctttaatctggtattcctagaataatccagagaatagagtggcctactgtacacactggattactcaataaagaacatgatgggaaacggcagtatttttctgttttaaaataagtaggtttggagggagctgggaaactgcgggctttagttacaaaatgactataattgtgggagacgtattttctttgaatgttgaaacacattggacaggatatacaatttagaaataatttacagttagagaaaggccctttcatctgagagggggcacatcttctgattggaaaggatggtcccaggggatgagggatcgggccccaggtgagcttcatctttttctcttccaacttcagtgtggccaaacagagcggaaagtcatcacgtagaaggacaaagtctgtgtttttttgtttttgtttttgttttctctcatgagagaagcaggcaagtgctgcctgagaaggtgaaggctcacctgtggcaggcttgcttcaagctggctgcagactgaaggccacccagaggctttggtcaccaagggtggcatgatgggtggccttctccttgctcatgcagctctcaccagcaaatttctactgaatgcccactctgtgcagggtactgtgccaagcacgagggatgccaggacccggaagaaagaactctgttagagaaccacagctgatagctgccagtcagcagtaaaggttcaaagcttggcctggccaaggagctatcacggagggctctgtggaccagggtcttgtagtgggagtgtgtcagcagagtggaggggttggaggagtgagcccaggtatgcaggggtatggatgggccgagagccttgggcctggcctggctgaaggctgtcctgttgaggcactggcaagtgggcttgggaggcagacggatgaccagacacggccccacagagatcagcccaaagcgcttggacccagggcatctgggatggttcttgaggtgagcgcatgaagccttgttttagacacatacactagaggactccagcctccctgcaagccctcctcctctctctctcctcactgttgaggcgagtgctgtgtctgccttagattccttctgcaggcttctgtctgcctgccagcagatgcctctatgtctgtcagccctcagaatgtcaggcacatgcactacccactgtgtgtgtggggtgtgtgtgtgtgtgaacatgtcagatacccacacaggctctccactgttcagtgtgtctccagtctgggacctgggggtggaaatagtcaccgtctacatccatcttcttctgcttctctcttaggcatttccaattcaacatacaccagcctgaactctttatccacatccctttccagcatgctcttcctccagcccctactgaccccatcacaggaaaaagccattctgttcttccagttactcagggcgacagcctcggagtcatcatcgatgtctttttcctctcacacctgacacctgacctgtggccatcctgttgactctccccttgaaatacatccagaatccagccccttgtccccactccagcactcacagtcacattgcacctggtctggaccccagcaagtgctgccctgtgggactccctgcttctccccttgctccacactgtctattctctgtagcctttaagaacaactcaggtcatttcactgtcctgctcaaaaccatcaaatcgtttcccgtttccttcagaatgacattcacagtcctttccgtcacagctctgcgtggcctgtggtgcctctgtatcctcatctctgacttagtttactccaccccattctcctccttcaccagactcccaggcactccttcacgagcagcatgcacctgccccagagccttggcaccagctgctttccctacccagaacactctccttcccacatcttcacagccagctgtttcattccctccaagtcccttatcagagaggctttttcagtcactttgagtaaaacagaaacctaccttttcatcattcttgaccccttaactaaacttgcttgagtttttgttgttgttgtttgctcgttttttacttattaccacttgacatcacttttgtgggaatccccttgcttttatggaaatatgtaagagtaaagaacttcatcttattttccgattatccccaggtcctagaacagtgctggcatttggaagctgttcagtatttgctgaataaatgaaatgaattatgctgtgattcactgtgtgtttggaggtgtttggagggactggcatgggaggattggattctacggtggtaatagtgacatggcatgatgaaggcatggagtagaggggcggccacagaaatgcaaaggaaggatgactgagggagaggcctctagctcggttgttgcaggacagggatgcttgactggcagtgccttggatgactcgttataagagctgtactccagactcaggatatgctttaaccataggttttcagatttctcctggggtccagtcaactcccatgccagtcccttgttccatgatcccaggccctgctccaattccttaactcttattctgtaaccgtaacccaaatggctaagcctgaggttgcaggctgacctttagagaaaaagttgaactttctctttaaagctaagtgggaaaaaaacaatgacggataaaatgtaaagatgtacaaaggtaccagtttgtacctgggtgtttgaatttctttacattttgctgtcagttgtacatggccatttgaaatgagtaatttaatattctgctgatttttaaatacatagatcattttcatggcactacatagtaaatctgtgctttgcttgtctgctatctgtgtgtttaggttcacaccagttctggtcgtgaagctatagctcaggcattatcatggacttcctagaagctgccttgccagcaaggagcctaagaggtgttcagaaaaattatccaaaacttggaaataaggaaagaggatgactctatgtcctttaaagtccagatcagagcattgtctattagatccactcaaggattatttaaatctcaaggagaatgtaactttgcttcacatactgtttactagtaactggctgcctgtcaacttgtgggagataagctggatacaattttgtccagtacagatgcaaatgattcccttcccttcccttcccttcccttcccttcccttcccttcccttcccttcccttcccttcccttcccttcccttccctcccctcccctcccctcccctccccttcccctccctccctccctcattctctctttcttttcttttctctctttctttctttctttcttctttctttctttccttccttccttccttccttccttctttctttctttctttctttctttctttctttctttctttcttctttctttctttccttcctttctttctttctttctttctttctttctttctttctttctttctttctttctttcttctttccttccttccttccttccttccttctttctttctttctttctttctttctttctttctttctttctttctttctgtctttctttctgtctgtctgtctctctgtctctctctctctctctctcattctgtctctgtctcattctgtctctgtctctctctctctctcattctgtcacccaggctagagtgcagtggcatgatctcagctcattgcaacctctgccttccgggttcaagtgattctcctgcctcagcctcccaagtagctgggaccactggtgtgcaccaccacgcctggctaatttttgtatttttagtagaggtggggttctgttatgttgcccaggttggtcttgaattcctgagttcaagcaatccacccactttggcctcccaaagtgctgggattatagacatgagccaccgcatccagccagctcttttatgtttaaatcggccaagcgtgatcgatttccttcaggttcaaaagattacccaaacattacagttgtattgtgccatagaacattaaccagttttgtatgtaacttagcaaacttttttcagcattctttctgacatacgatacatctgtgttcctcaaatgctttgagaatcagcttttccatcctatgggttccctcagtaatgagttaaagaattgtgcttgctacctgtatgagggtatgagagccaagttcctaatattttgaaaatgatgttttgatggaggagataaaaagtctcctgtgttagctatataaacccaaacctacaaaatgatgtcaagtaccatagaatgtatacaaaagacataacctactcctcccaccaatttctattttattagcatgcatttctcaggaaagactgttcaaaaggtaaggagagaataccattctaccattctgccaattcaagttagaccagctatttctctttgcttattcacttcctgttttctcttaataaatttatttaaagacaatttattagagaaaaagttgtcttacaaatgcgaattgtaagttgtcttactgatgtgatccagcaatccgtcctggccggcaccctgccaggtctgtaattaagactgggggtttgctctgcaaggacacattctccacctttgtctggggggctctgtactcagtcttgcggtttgtctgtggagctgaggtgctggttgggaatcaggagacgtcagttccggtctcagcaaagctgctgcgaggtgcggggcagaggcctggtttacctggtataccacatgcccttgacttccctgtggtaggtgcccctgattccgctccagctcttgctttgcatgtaatttacactgaggttgcaaacaactgcttattcctgtgggacttagttttttccttagggccaatctgaaaaacttacctccttagttacatcctacggatttgcagacaaataggggaaagaaatggaagaaataagggaaaatgttatccaaagttggaaataatagaagattactctatgtgctttcgatgtcatactagaagaagccgctttaagtagcaccattattctgaatggagaaatctgtggttgctttagtcatggagactacatcacaactagggttttccttttatttttgagatgtgtgtgatgggggaggataggggtacagcattctagaaatggcctcattttgcatttccttaggtccaaagttaaaataactttctgttctaagaagctttaaaagtggttcatggaccaggcacggtggctcacgcctgtaatcccagcactttgggaggctgaggtgggcgtatcacctgaggtccagagattgagaccatcctggccaacatggtgaaaccccatctctactaaaaatacaaaaaaatttgctgggcatggtggcgtgtgcctgtagtccctgctacttgggaggctgaggcaggagaattgtttcaacccaggaggcagaggttgtagtgagccaagatcctgccacttcactccagcctggtgacagaactagactcagtctcaaaataaagtggttcatttctttctaaaatcattaattgaacattaaaaaacattggtaagaaaaattgaaccaagaaggttttgggttatactgtaggtcagtgagctttaagtttctgtgtctctgaagctacatggctggacgatagctgaagtcagtgccccgagtgaagcctgaagaggagctgatggatttttctggtggggaaggcctgtgactgcactcagagagagctgggccaggcggggtgaggcacggtcactctgagttcacagacccactctgatccttgaatgggtctgtcctgaaataatggggaatcctggaacatgctgctttgtgtagacgcctttctcctttgcaacttttaaaggtatttgtcccctgggtttcatttgaaatgcttttttcttcttcttcttttttttttttgccagatgctttcactaggagcagtatccagaaagctatgtttctaacctaccttgttgtttgcctcttgggcaaatgggtttgtttaccttattgactcagttcagtggaaaatattaccctgattgggatggagatggggctgctgttctgaaataactacgcaagtttacctgttcaggtgggacacagcttcttgtgttagtcacggatgaattttgaaaatttatacatagtgcaataaatgctggtttctttccccttcctcactccttcctggggcctatatgtgtgtatctctaacacacatacacacacacgcaggcacacacacactcatacacatgcacactcacacacaagaggatacgttgcatatacagctcaatgctacaaagaagcccttttaccagaagagcacacgggaactccgctgaagtttgacagggtgattgtcttgtggctactctaccctgaggccagagcacagtgagggcctccctcctgcccccagccacaccaaagagggggcaggggttcacagggagcaaaagaggagctttttgccatcaccatgagacggtgaccacaggggcctggctcgaaggtgagggtggggctggtgactggtgcctgtggattccagagtggttggcctacacagcctactgagaggtagagcacggtcctttgcgtccctgtggactccgagtgcctgccatggtttggaaggtccactgaaggctgagtgctcagcggcgttgccagccagctggatgcatgtaaacagcattgtgaatggagaacattctttcaccttattcttgcacattcttctcccctacttagcttcttatccttcctatctactcatctagctagcaatccctaaaattaaatcatttataaatgagtccgatgagggtctttttttgaaaactggatttagtgaataaggcagacccctgtttttggatagggctttgcctcttgttattaaggaggaataacttgttcccaacttggttggtgaccccagctgaggaggaacaagtggcagatgagtcccagggaagacccctagggggaatggctggaggtagctgtatcagggatgaaaagggtgggggtggtgatgaggggaacgcagcccttcatgcaaagaagtgggtgtttgaaatcagtgggtgactatttttttggcaatgtgggctccttaggtcatacacagtggccttagaaagccagccctgcctctcttccctcaactgatggtggatttgtgtaatgagatcaccgtcttcttgaaaaacacttccagggtagctcattacaaagcctcgcacagtgttcggagcagggcgagctgcaaggccccgggctttccattctgaaagagctgtgggtgtcggggtggctgccagctgtgagagctccgtgggtggggactctgtccctcaaagccacgcactcaggcttgcccattctagtgtctctgtgggagacaatcaatgtaatttactctattaatggaatgaaggattacaataataaaatctttttcaaggaatgcaaaaaagcatttatcaaaattcaatatccattcatggtaaaaactctcagcaaactaggaacagtaggaaacttccttaaaataataaaggcatttacaaaattcctgcaggttgcatcatgcttaatggtgaaagcctgaactatctcctaaacccatttactcctcctcagggaagacttccctgaccccatgtttaagtcaaacactcattatacattcccttaggaccagcctctcatccaaagaagtgatcataaatgcaatttaaaatgtatttgtggttgggcgcggtggctcatgcctgtaacccagcactttgggaggccgaggcaggtggatttcttgaggtcaggagttcaagaccagcctggacaacatggtgaaaccccatctctactaaaaatacaaaaatcagttgggtatagtggtgcgtgcctgtaatctcagctacctgggaggccaaggtggaaggatcacttgagtctgggaggtggaggctgcagttagccaagatcgtcccactgcactccagcctgggtgacagagtgagacttcgtctaaaaaaaaaaattatttctgccactatttgcttaatgtttgttttctggtgtaggcattcagctctgtgaataaaagcattctgctgatttctgctgccctgtatccagacggaaggaatgggtgagtgaatgacaggcacctgttctgtttacagtcagtaaagtaaacacaacactacacgtatgaactccaccggaaagatgaacacttatggtatatttggtgccactgtcccagggagagtagaagtacagggttttgttcttctgacttgagaaatttttgtgctagaagggccactgagggtcatccaggcctatcactgcccaccccaaatttataggtgaggtcactagggcctgagatctgaagcatgcatgacatcccgaatgaactacaaatcctaggtcagagttaacagtagtggtaactgcacaggatgagttggtgcagggtgacaagctcatgcgtggtagctattttgaatcaataccccgtaactaacctctgctgtttgaaacacctggcagagtgctgcaactcacccttgggcaaagccccactctctgaggctgtggtggggttcagggaatactaccccaaaatatggcagattggcattggagaaaacggcagaagcaggaaggcctctctcaccttctccttgcccttcttttcctgaagcaggccatgaaaccaagctgactttctcctggagcaaggcataaggtccttgtgtgagaggtgcccactctttacctggaggggaggaacatctttatctctgaagacacagggacgcagaagaaaagctgaacaaacaggccttgctgagttcccccttgtatataactaattagatcatactccctttgtccaatcacacttctccactactgtcgacttctccatcaaacttacaataaaaacacacaggtgtccctattccctatttctttatctttttctttctttctttctttctttttttttttttaagatggagtcttgttctgtcacccaggctggagtgcaatggcgtgatcttggctcgctgcaacctctgccttctgggctccagcaattctcccaccatagcctcccgagtagctgggattacaggtgcccgccatcatacccggctaatttttaaatttttgtagagacggtgtttcaccatgttggccaggctggtctcaaattcctgacctcacgtgatccacctgcctcagtctcctaaagtgctgggattgcatgcatgagccactgtgcccagcctctttggatcttttttcctgaggtgtcttatgttacataaaatttaaattaaataagtttgatgtttctcttgttaatctgtattttgccataggtgcctcagctatgaccctcgtaatgggtgaggaaaaaacacattttcttccctgcagctgcttggccacctgccttttgcttggattggcagaaatctggcttaatctggcttctccagtcctccatcacctggccaggaggtagcccttggtctaaccccttctcatgtttggaagcagactttccctttctttctaaggactggtaggcagctcctcatggatggagtgataactccagaatgtcttcgtgtgatggctgttggagtgggaagtgggctgggaggctgtgctggcatagactttgtgtaggattgagaagacaataactgccagtgtgaagatcaggcgggagttgggaagacagctgagagtggccaaggggaagccagagcctcttcaagtcatctctagatgggtgtgaaagggagagaagaggccaagaaaccatgagattaaaaggtggaggtgggggcatagagatcccagctgctctaggggaccctcccaggcaagtgctgtgtgtgtatgctcctccactgttccttctgcaatgcattccatctggctgctagatacggtaaagggaatgaaaggtgggaaaggcaaagggtgcatttaatccactcttcagctgtgaattctctagaggagagctagtccttgtgtttgttgatgcagctgcctctctcctgagacctgtaaaatgacttttttttttaaaggtaaaatcatgactcttacacaaatgtaaaatgaacacatgtcaaagattttatttagttcattaattaatgagggaaccagtaagatgctacaaccagcccaaaggagaattaaaaatgccacgcatagctaggacaataggaatgctgacatagaatttacaaatagatgcaaaattgatgatagccactggacagtctgtccacatgtccatggacaaggatagttggcattccatgggtcttttacaacttgcaaaccgaggaaagtttaggtcctcctttttccttgctgacctttcatgggtcagccctcatctggacatcaacactcctgagacatgtggtcactgcaataattgactgaaatcagtaaagacacaatttctccctctgctgctccgtgttcctgtctagagagttgttttcctctccaagtaaaagttgttaaagagcttaaagacaatgaagggcagagagagccaggatgtgaagacttttctgctgtactgtctttcacagatccatgttgcagctgggagcacggggaaacctggacacgcacttcaccaaaatgagacaactgtggcaggagacaggctaaggcgagtggggacaaatcaatgtgctggatgccctggtgtacctgtgacgaagaagcaggagctgggaagagagaggaaaaggaaatagacaagtgaataaataaataagagttcagaaaccccgtctccaccaaaaatacaagaaattaggtgggcatggtgctggcgcctgtagtcccagctattcgggaggctgaggcaggagaatgacgtgaacccaggaggtggagcttgcagtgagccgagattgtgccactgcactccagcctgggtgacagagcaagactccatctcaaaaaaaagagttcaaaggaagtgtagaagagttgagagaagaactctatttgcacattcactcttcagttcatttcctcattcattttctgaacagtgaatctggctctgtgctggatcctggagcataaagactaaattagctgcacaaagaccctgatcactaacatcctagtgggaaagacacactgtgtattaagctgagtaatcaccaccttcccaccatgtctgtatcctgatccctggaacatgtgaatattatcgtatatggcaaaatggactttgtagatgtgattaagttcaggatcttgagttggagagattactctgcattggcctaatgtaatcacaggggttttcataaggaggaggcaggtgatcagcataggagaaggcaatgtgattatggaagtaaatgtgggagtgatgcagctacaaactgaggaaagctggcagctctggaaactggaagaggcaagggacagattctctgctggagccttccaaaggagccaaccctctgacaccttgctttcagccttgaaagacacattttggacttctgaccaccaggactgtaagagaatagatttgtgttgtttgaagccactgagtttgtggtaattgctataggagtcataggaaactaacatatatgctgaacaattgcatggtcgcatgattgcaatgtagagtgttttgaggaaggaaattaaggcagctggggagctgatgacaggtgtcctggaggaggaggtttcctgtggagagctgagggctttgaaggaggccacccatggtggtggattggggacgtggcagtttcaaagcatacaccatgtgaaggaaggaccctgcagaagtcccaaatcaatgttttcttgcttatccctggtggatgatggaggctggtggcaggggcattaatgtgtggccatggtggtctgtgtgatacggtgaaaatgcaaaggagatgaactcccaagacttttgggagacatttataggaagatgggtgctaaataaatccaaggcagtcttttcagacagagggcttgataccactaattaggcagcttggatgagtggcaccatggaactggctggtggttttcttgtgaaaatagacacaaactcccttctctccatgttcttagaagatgtgaatttagaggtctccacattgcctgacaaagtctgttttaactgggtaaaataaaaaaaaaattaccattgtattgctcctgaaccttgcttaaaattccctttaaagatctacaaagggttttgctcatttgtacaatcttaaaggtcacaaaattagaagcttagcagccacatgccaactgcacacagcatttgaaatctttgacacagaccgttccagaagtcacaactggcaaagctgcacttcttgtgacactcagtagcctgcacacccatctcctggcttgtaagcatatgcctttttgtccagccagctgaggtacttggttcctgattgttttcttgtttgttttttaatgctcagatattctcatgtggtgaatatttgtgagccaaattacttggcaggagcgtttgatgccatggccaaatggggagcccagagtcagcatctttttaaagctaactcttacttgccagctcctctttctgcccacatactcgccccgtaccaggcccagtggctgttgcacagacaaacaccaagcagtcctgcaaaccccatttgcttccttctgggcttgatgctgcctgggagtgggcttctccctgggtggtatgtaggagttttccttacattttcatttcttatcagcttaccatttgcaactgatgcaggacaggcaagaccccaaactggggcttagcccaggaggattcttggctttgcccaggagagaattcaagcacaagtggtggtgttagacagcaacttttattgaggcagcagcagctgtactgctccctgtggagcagggctaccccacaggcagtgtgcccagagtagcagctcagggacagttcagcagtcatatttgtacccacttttaattacatgcaagttaaaaggcagttgatgcaggcatttctaggaaaaaggtggtaacttccgggtcattgggttactgccatagaaaggggtggtaactctcaggtgttgccacggcgatggtaaactgacatggcacactggtgggcatgtcttatggaaagctacttctgccctggccctgtttcagctagctctcaatttggtccagtgtctgagcccagcctctggagttgagtcccgccccctacctcactatcttggttctatttggagatgccctgaaaggctgtgtccagtcccacagtgagtgaggaatctatgctgaggttcctttggaggtgaattttgaatgacgtataacccagtacagaggaaaagtccagaactgagggatgcaggctaatattaaagactcatagttttgggggctgtctgtccaaaggctcatgcatgggcagaaagagttcacctgacctgtgctgtgggaagtttgctgtaaacattctgataaacatttaactttagtccctttcagtaccagtgccatgccctgcagtgttcactaagcgcccacaggcatctgctctctgtgacctgctcatatgacgagctaaagtcgagcatgcttcattcacagccaggcctcctccttctttgttggcctgagtgtgttgctgaccattcatgggtcagccccgacctggacatcaacactcctgagaaatgtggcaactgcaataattgactgaaatcagtctctccctgtttgctggtccatgttcttgtctagagagttgttttcttctccaagaataagaaggtggaatcgatttttccaccttttgttcccctcaccccagtgatgatgaggcaccaggagggaattttctgactttctgcaggcatttatgttctgcttcacatcatcatatttattcctttaatgtaggagaaccttaaatgaagcttgttggaaataggccatcctccataacctgggtttgttggagcccatgtatagaaatgatttcttggcaactctagttctcttgagcatgtgtgctatggttaaagaggcagaagggcacaagaattttagcaccctgaggactgaaaaccttccatagaaccagcatacatattgttttataaataaggagtattcttggggtatagttgtttgcaaagaaagggagctccttaagatttatgacccagctcacaataaccagatgacctgaatcaagggtgtatgtcaggaacaggatcctggaggggtcaatgacagtgtccatctgtggcctcaaagagcccgttcccaactctcctgccttttgacagaaggtctgtctggttatggctttaggaagatagatgacttctgtatagtcacaggaagagtctgcgtgcctggagctgtgggctggaaaggaggtgagagatgctggcctctccaaggcctcgtccacgtgccccatctccagacaggagcagccagggctccgttaggctgcaaacaatggaaaacctgaatagcagaggcttaaaaaacatgtggtttgcttgtctcacctgaaagaagtctgaaattgggaagtccagggctgggtcagaggttcagagatgctggggttgaggcctagatggctttttggccttttccccaggaaaaaacagaatcaatcagaaggtggctgatgtaggtcaggtgggctggggctggaggggatggtaggctgtgagtctggcgctccctcttgctggtgtggggatgggtaccaggagggcttctctcctccaccttgctctgttgctctgttgctctgttgcccaggcacccattgccaagaagccagactggaattcccaatgggatggggcagtcccaaggcacatggaatctttggtgggacttatacaccctgtactcctgtgagctcctcagtcactctggtcaaaaactctaatattgttccttttaacacagtcatcacccaaaaccctgttaaacacccaaatgcacctggggcaacccttgaccttatggagcccactttctttgcaaacaacacagatgttgagatgaagcaggaaggagtggttacataggaggatccagaatccccaaccccagggagttcgatatgggaaaaatgcctctgagtagggcggagggatgctcagagggctgcagggtcctgggaagtggctgtgtctcaaagtgtgctccatattcatacccgtctttccccactgcttttatttgcttcgcttttgaatctgtgattcaccttctttggtctcacctcttcctcgggccctttggttaagggcaggctgattactgcatatggctgtgccccagccctctgctttacccagcgattaaggagaagcccacaccaattcaacaaggcttgcattttaggagcagacaaaaatcttagacccagaagccaggtgtgcagaaaatgcatgttggcttccctttagcgttatctaatttcccaggctcaattctgtctgggtaaaggaacattattcttggttagctgaagtcccctgcttttcctgcagatgtgtctgatgctgggggctggcattgctccccttgggggctgggagatgctctcctttctggtctttggttgtcagagcctgctgttcactgctgttgtctcttgttctgactccaccccagctctgcttcaatcctactctctccaggccacagccacccactgggacctcccatgaagctcttgggagctctcacccatcctggagggagcccatgtaaatttgggcctggcttgttgattctgaatcaccaaataggcatttgcgcagcctgcctctccaagggaacttcagggttttgctgccactctggactttgtctgaggctatctttctgcacaaactgcacaaagtggggatgaagcccacttcatgggcacaggcccttcccaggacactgcagcctctccatacccctcccccctactcaggaggcctctgtgctgctgaggccaaagatttgctttgaaaggccaaatattcttcctgagccctggtcttaacccggggctgaagctttgctctcaaaggtaaaggtgaagacctccattttcctctgctctctgcaaattgcctttggctgaagcagggaacaggaaatgaatgaccaagttatgtggcctgggagagggagaagagcccagtcaacagctcaagaaatcccgccatgtctacttaaggggaagaagagagaaaggaggataaagagagattttttttccttttaatataatgcacattaaattttaggttgtttttttttttttctacatttaggtcccttatgtggcagaaaattccaaaatatattagtaaaaatgaacccaccttacatactcttggggtttcgttgaaatgttgagaagttaagaaactttgttagattattttacttaatttttaaaaaatagcctatcaaggagttttcaaaactttttaggtgtataaacaccctatttcggaaaccaccgtattttacactttcacttcccacctacaccagctcagtgacaagaaagtgtctgaaacaaggtgcaaaatcaaggttctcagaaacacgcttgggacgtcttgttccgcagcttggctgctctttccgcccggagtgtccttagcctgtgcccctttcgaactccggcactttgtctgcggagtagctccagcgcagtctcccagcgttacctggcagcctcctccttcctggagcaggagaagcggctctgtctcctgtgttccatcatcgattatggctgctctcacactgggttaggaaggtttggtcacctgagtgcctccctcctctgtgctgttggactctatggtttacatactcctagatgctattttttacatactcctaagttttcaacctgagaaatctgaaaccatcccctaaccttacctggttacctgttgaaaaatgtgttatcccagaggtagattctttgggtcctaggcatctggacttgcaagagtctcatgtcagtttcatgtgcttacaaaggtgataacagagagggacatagctgtgagtttttcccaacggccagtgagtgcttcgttccctgtatcatgttttatttatttatctatccccagggctagtgcagtttggacatagggtgctatgggttgaattacatacttgtcaaatccatatgttgaaatcttaacccctagtacctcagaatgtgacattatttggagagagggtatttatagaggtaattaggggaaaaggaggtctttagggtgggtcctaattcaatatgaccgatgtccttatatagagggaaaatctggacacagagctgtatacatccagggagaacgtcatctggagatgaaagcagagatcagagtgatgcagctccaagacatggaatgctgaagatggtgagcaacccaccagaagccaggagagaggtataaaaggtttctccctcacagcccttagaagccaccaaccctgctgatgccttgatctctgatcctcaaggatgtggagtagctgtgtgagaggctgtctgagggctcttcaaaaagttcataggaaatgcatattatgaaaaaactatgctggatttcaaattttttgcaccaaaattgatttgtactacctttttataacatgttcatgcacaatctagtttgaggcactaagaaggataatacatcagtttgaaaagagcctctatcagagcaatgtgaatttctgctaaaattgaagtaagaacaaacatcaaatttatagtgaagcttgaggggaagtatagtgaactcattgatgctttgtgaaaagcttatggagacaatacccccttcccccaaatcagcagtttacaaatagataacttcttttaagaagggagaagttgaggctgggcacagtggctaatgcctgtaatcccaacactttgggagcctggggcaggtgaatcacttgaggtcgggaattcaagaccagcctggttaacatgtgaaaccccatctctactaaaaatacaaaaaaaaaaaaaaaatagccaggtgtggtgacaggcacctgtaatcccagctactcgggaggctgaggcaggagaatcacttgaacccaggaggcagaggttgcagtgagccgagatcatgccactgcactgcagcctgggtgacagagcaagactctgtctcaaaaaaaaaaaaaaaaagggagaagttgatgttgaagatgaagcctgtggtggcagaccattcatgtcaatttgcaaggaaaaaattaaccatgccctaattgaaaagacctgatgattaacagacatttcagttggttcagtttatgcaattctgactgaaaaattaaagttaagttttccactcaatgggtgtcaaaaccattgcacccagatcagctgcagacaagaacagatctttcaatgaaaattaaacaagtaggatgaagatcctgaaggatttcttcaaataattgtaataggagacgaaacatagctttaccagtacaatcctgaagacaaagcacaatcaaagcaatggataccaagaggtggacattttccagtcaaagcagaagcagaccagtcaggagcacaggtcacagcaagagttttttgggatactccaggcattttgctgttgactgtctgtagagccaaagaatgataacatctgtttattatgagagtgttttgagaaagttagccaaagctttagcagaaaaatgccactgaagaattcagcagagagtccttctccaccctgacaatgcttctgctcattcctctcattaagtaagggcaattttgtgaatttcaatagaaaatcattgggtatccaacttgcagttctgattttgcttcttctgacttctttttgtttcctaattaaaacaaaataattaaaaggcatccattttcttcagttaataatgtaaaaagactgtattgatatggttaaattctcaggaccctcaatattttaagaatggactaaatgggtggtatcatcacttacaaaattgttttgaacttgatggagcttatattgagtaatacagtttataaagttgatatttttcatttttatcttttgattccattttccatgaacttcctaaagtcctcttgtatttctaggagggtcttggattaaaaaaaacaggaggaaggaacaagtgagaaattactctcatagtttatggcgtgtcttaacatcaagttacttttaagtcttttattcttttaggaagatattttctctttcagggaaaattaagaaacatcagggcctgagttatgttggaaaatctctcccctactctgactgtctggctttattctgagctcccaagctataacagtggcacttgggtgggatgagagtggggtggggctcacatctacatggctgaagaccaaggcagaatctcacacccaagtcttgattctttgtgctgcttagctgttgttcacaccacttttcctgcttgtgtccagatctgaatgaaactgatggctgttggagaggcctttgtcatctgactctatctgttcctctgtcaagtaataccatcaatgatgctattcatagaaacatttcatgtttgagaggtgttaggagttgaattgtcttctagaagctgttgaattcctaaccctttatatctgtgaatgtgactttatttggatataggtagggtctttgcagatgatcaaattaagatgaggtcagtagggtgggccttaatccgtattactactggtcattctaaaaagggaaaatgccgatacagacagatgcattcaggagaattctgtgtgaaaatgaaggtggagatcagtgtgatgcatctccacaccaaggaacactaaaggtcaccagcaaaccaccagaagtgagatgcgaggcattgaataggttttcctcgcagcttcggaaggaaccaaccctgttggcactttgttcctggacttccagcctgcaggtggttgtgtaagcatttctgtggtcgaagccacctggtttgcagtactttgttagggcagccctagcagactaacacaagaggtcattgaaagtgtcatatccagaacagtgtgccttttgggggaggaaagtccagttggccctttcacatacacgaacatctcacatttaaagacacaattccaggctgtctgtggacactcataggtgcccgtgaaagccgcctcagccataaacttcttggagtcacattgtgaagtatttatttttaattacagattttctttgatgatcctcttctcttctctttttgtttccttggcttgtcactcattcgttgtggtaaatagactgcctgctgtttacgatgagaagtagcctgtgctttggtctggtctcctgacgcccggttgccagcagtccttgctgtctctgggttggaagccgtgatgcctgctcatgggctcgctgtctcctcaggcatgaaagtggaggcatccttctggctctattttcaacttaccttggtgaggccacaagaccctattgacacatgaaggggaagcacagagggaaagggggttttacttttcctcttcaacagggctagccctcggggactgagcagagagagttgtgaatgctgggttttgaaactggccccaaacgattgtctcctggaatcagagaaggaacaaccgactgcacctaaaagaaacagagtgtttaccagtcttgctggatggctttaaaaacgcaaatacatacgcattctcattagcccatagcactcagccatcttcacccccattagagaaagccagtctgctgcctgcccccctcaagtcactgctgaactcatagcatgtgtcgggcttctggaacctcacagatgtattgccgcagacaccctttagatgagaggtgtaggttaggggcacaggcaagggagcggtcactcctagacctgaagcatctcttccatagacgtcacagtatatatcttcccagccagctcctccccagcccttcagggaaggtgaacacaattccacactagagtggcttttaaagaaaaataacatgtatgaactcttcccagaattctatgaaatgaatgagtttgcattactttttctagcttatgacctgagtcttttattttttcagatacatttagttgtgtctttcaaaatctatttttgcagaacctaccctttgttagcattgggctggaaccccggaaggataattatgtgtgggacttggtagctgcccttaggtgtacaatcccataaaggagagatgccatatgcagaatgatgaaatgcagcatgaggctaagtgtccagcatgggttatggagggtagatgagagagaggttggtgcccagaagacagccgtcctgcctcgggcctatatgtctgcagaggcccacaggagtggggcagtcctgttcagggagggctgaggggttctccgaatcttatcaggtaggacagggagactttagaaaggattgggcattcagtttgtgggtgtgttataagcaaagtctggagcagctgtgagttggatttcactgggtttcatggagcagatgtctcttgctggggaatgatgggatgtaagactagagacagacacagtcagaggcgatgtctgccttgaggcagacaaacagatttcaacttggtcttctgggcctaggcagtgagaagcctggaaggtgtctgagcttggagatgacctcatagagccaactttttggaagattggttgggtggcagagtacactgtatgaaggcacaggagagagaaaggacaaatgcacaaaggaaggatccagaattccagggcaggctggacatgtgggcctgaaggaaggggaggggtgaagggagacctgaccatggcttctgcctgcttgaccaagcttggcatgtacattagaatatacagagtttgaggcctgaggacccttgttctttttcaataagtaatggtattttaaaaaccatctctgggttttatcatgagcagaggcgaattccatgcacagtgaggactgttttatttatttatacttgttgaatagtaaacagcattgaagaatgtttttaaagaaacccaaacttccttttccatttctcagtattaactttctttttagcaactagggacacaattgaatgctattgtcttaaacctgcctgacagagcagaggtacacgctggggggcgtgggaacctctatttggcaaagggaacttctcctgttattcccatatggaaagagacataaatttggggagagcttgctccttccctacatttctgtgatccatggttaacagtctcctcaagtgaatttcaaattctctttccaataagctgcaaaagtacttaaatcatttatttgttctgctcctgaaatgagagttactcactaaagtcccaaagtgtcccgaaccatgaggtgtccacagtgaaatgacatgtttaaaagttgccataaatgctggtaactggacatgataataaatctgagtcatttcacatggccagttgggtcggtaataacaagacatgcacttaaaatatatatctttttgcctttcgggctataaagattaataaattgtgtaaatttccaagataaagtgtgagacattctgaattttatgtgaatgacttgcatggtgacagtaaccatgttctggcccttggaacaggaggtaatttactgttgatggtttcttggcataatatatatacgtatttggggggtaataatttaaaatcatccagcacatggtctctgataaggtgcataactcaggtactcagagttgttttataggaaaagagatacaggcacaccgtgcgactgcaatcccggcacgttctccttcctcaggaatgacaagggatggaaacctggctccccacggggaataataaagcatgcctgtgaaaaatgaatcctggacctgagctcagggccagagtgctccaaaatttggggctttcccaggacttagtccagatttgcttctgtccaggccagtgaccgcttgaagctgtagagggcaggggagggagggtccccttcctgaaagggaagtgctgtgagacgtggctgtcactgataccagtggggacctctctgcccccagcctctaatcatgcttgaaggtttactctctgagcatggcttgagaagacaagggaaagcaatggagattggccatcacagccaaattctgcctgatatggaggcctgagtccttttgtgcaggtggtgactcactgccctgttgaatgggaggaaggaacagtgatcagacccaaacactctggttttcttcccacctgtttctcagaagtaataagtgcagggctcatgctctgcctgtgtgtgtgtgtgtgtgtgtgtgtgtgtgtctctgtgtgtcctgtgtgtgtgtctctgtgtgtgtgtgtgcctgtgcgtgtatgtctctttgtgtgtctatgtgtgtgcgtgtgtgcctctgtgtgtctctgtgtgtgtctctctgtgtctctttctctgtgtgtgttgtctctgtgtgcacgtgcatacatgtatgtccctctgtgtgcctatgtgtgtgcatgtgtgcctctgtgtgtttctgtatgtgtgtgttgcagaggagctgctaatgtgttctcatgctggttgtactgccccgccttggaacaactttatccttgggtgcaggggctgggtgagcctggaagctgccagatgcagcacatgatggaggagaagggcctggaaacttttgcagttgtcactcaacaaacactcatgcagctcctcctgtgtgccaggccaggtgccaggagctggagggaatacagagagtgagcctgccgctttgggatctcatctcctggaggaggaataagttatctacttaggtattcaattttaactggtatttaattacagccatacaagtggttccattattagtcaagctgaactaagttttgctgcaataacaaattttcccagaatctcagtagcttaacggagcaaaggttggttgcttgtgaatgctgtctgtcctacaaggtggtgctctgctctgtacagtcactcaggattcaaggctgacaggctaccttcttctttaggctgtgcattctggaacatggggtttctttagcctctgtagtggggaagagagacaagagactcactcacaagcttctctatcatactaccttatgatggaggtggtgttattagcctttttacatctgaggaaactgaggcacagaggagttaagtaacatgtccaaagtttcacagcaagtgagtagcagaaccaggattgtgagctccagccatctggctccagaatccctgttcttgtcatgctctgccatctaattaaacagtttcttgggaagggaatgaagagatgtcagacaggccaggagctcaggggactagaaaaagaatttatcagaagaaggaaagtatgtcggggaatgacagggaaggataaatgagcaaggctagaatcccagaaaaatagagagacttcatcttggctggcagaatagcttttgcaaattcgggattagaagcctggtttcatgagtttgggacgaaagctacagaaaatgcagacacagggtggatcttacggattgtgaagtcagggaggtctgaaatgaaatagaaatggcccaaggaaacctttcatattcctttttgtttccacatacatctggccacaaaagctctttggtggtttatcccatctcactgcttccttagggctctttcaaactccttgcatctatgtaagcatggataaggagcacagcagacatgggacacacctgtgttgctttctgggcatgctgtaggatgccactttttggctgtgcacctggagcaagaggcagcagggcagcagcacccagccccctgcagttgaagctaaagactgcagctgcagcgcaggaattccccagtaggacaggaaagcaaacacaggcaagataaggtcagagacagccaactgtttacagcgtccaagctcttcctgggtttggtccaccctattaaaagataataacctcttaaaacatttcaaaggatgtgttggcagtgtttaagaggaaacataattgtcaccacagcctgggtagtgtgcaattgagtaggagaccatcttcaggataggatgggtgatgggcaagattgtgctgggagaggagttcgtttgaactgcagactccagaagctacagtggctgcccaacccatgaaaacacccacagatgctgtaactgctgggtatctgtcatctttggaataaaccactcatgctggggtctcactttctaagccattaccagctgcaagggttggctttgtgaaggcaaagggaagtttactttataacgatgtaggctatgtggagatatagaattataggagcacaaagtgcattactgactcactgttctgctgcccatagagcagctcatcctgctttgtgaggcattgctgtgagttgccttcaggcaacttgggaggaagagctgcctgaaaccctttcttgaatcttctttaaggttgctgatcaggacccatctaccatgggaggactgtggggattcctccatgacctcagtgctgagctgatctggctcattaagagatggttcttacgaccgggttcggtggctcacgcctgtaatcccagcactttgggaggctgaggtgggcagatcacctaaggctgggagtttgagaccagcctgaccaacatggagaaaccctgtctctaccaaaaaaatacaaaattagctgggcgtggtggcacatgcctgtaatcccagctactcgggaggctgaggcaggagaatcacttgaacctgggaagtggaggctgtggtgagccgagattgcgccattgcactccagcctgggcaacaagagcgaaactccatctcaaaaaaaaaaaaaaaaagaaaaaaaaaaaaagaaaaaaaaaagaaagaaagatgcttcttacaaagaactctttctttgcatctcatggataatctgaattgtacatctcactgaactaccttctttgccatggctgctggggtgcccagagcaagtgaccatggcatgcatgctgtcacctaagtggctttctcttatttttcttttccttctctgttatttattctgttgtattgtttatattttgataaactcacttaaattcattttgggacaagatgggatctaaaccaagaagtagataaatatgtgtgctttagagggtagttattgcagagtctatcctgggaagagtggctcctttgttcaggatgcctttctgggtatgaggggtgggttcaattccttccatccctttctagaagtatgtagtctttgatggattcattgagtcactgatttgttctgtggacacttattatgtgccaggccctgtgctaggcctgaggaaagtgacgatgacctcagagttatgttccagtggtgggagataggcaaagactatgtaagtgggcagagacactaattacatgtaagaaccactgccttgaagggagaatgaggatgagggtgtgtcttaggtgggctgccatagcaaaataccatctactgggaggctaaaacaacagacactgatttcacatgctcttggtggctggaggtcagagatcaaggtgtcagcaagttttattctgaagcctcttcttttagcttgtaggcagccacatctcactgtatgctcacatgacctcttctcagtgtttgagcagatagagagagagagagtgctttgatatctcttcttacaaggatgttaatcttattggaccccatccttatgacctcatttgaccttaattatctccacgaaggcttcatctccaaatcacatcacactgaggcttggggcttcaacatatgcattttggggtgggcacagacattcagtcatgacagagagggagaagatctacttcctatggggtgacgcaggaagcccactctgcagagggcaacatgcatgctggaatggaaaggataagaatgaggtggctgtgggagaggagggtggggaggcatgtgagggcgcgaggtggagagaacagccagggcagaggccctgaggctccctgagcagctggtgtggtcgcagcttactcaggagtggagagtagcacaggggaggatgtgagatgagtggggcacgagtgtgcagagccttgtaaaccagctatggtgagggttttgggtttcctactacatccagtgcaacgttactgaaagattgtaagcagagggatgtcatgatctggcttaggcttaaggagctgtgtggacagtgggctggagggattgggaatggaggcaggagactgcttgtcagttttggtaagaggctgggaccatggtgatggccacgttctagaagagagagtggaatctgttgatggaggaaatgtgagagacagggagagggagcacttaagggcaactcctaggctctaggcagaacatttaggtgcatggcgatgctgtttactgagctgaggggatgcggaagggagcagaggcaacgtgtatgtaatgggtaattgcatgtgtcaatttgactgggctaagggatgcccagatagctggtaaacattgctttggggtgtgtctgtgaaggcatttccagaagagactagcatgtgaatcagtagactgagtaaagaagattaccctcaccagtgtgggtgggcattatccaactgagggcctgaatagaacaaaacggcagagacagggcaaattcactctccctgcttgattgcacatcttctcctgccctcggacattggtgctcctggttctctggcctttgggctcagacaaggtgatatggtttggctgtgtccccacccaaatctcatcttgaattatggctcccaagatccccatgtgtcatgggagggacacagtggcaggtaattaaatcatgggggctggttttcccatgctgttctagtgatagtgagtaagtcccacgagatttgatagttttataaaaggcagttccgctgcacatgctctcttgcccgccactgtgtaagacatgcctttcctcctcctttgccttcctccatgactgtgaggcctcctcagccatgtggagctgtgagtccattaaacctctttttctttataagttacccagtctcaggtatttcttcatagcagtatgaaaatggactaacacaacagggcttatacatcacctcccctttagacttgaactgagttacatcagttcactgtctgcaagctggaggttttcctgggcctccagcttgcagacagaagattatggaacttctcagcctgggtaattgggtgaatgaagtcccataataaatctcttatatttctctacatgtcctgttgtttctgtttctctggagaaccctgactaatgtagtatgtaaggcacccagtcataagggcaggctatccttccattaatgacctcattccgggtgtatctgtagcctagaccactcttctaggaaaatcctattcccttcttgtctcttccatgtggaaatctcacagacattgcaacccaacccatccaaatcagatgggaaccaggggtttaatgttaacaggtgatatctgctgctgccggtctgccattgtcctaaagcattttatacacattttcttatcttagaaagtccctgtaagataggtgtgctaacaagaatcattttgcagctgaagaaatggaggtgctactggctcaaggaacctggattcatttagagagtgtgcccaggatgagacgtgtggagagcctggcctgaaccaacactaacagtctcctggacaggaggtgagtaaggaagaagcggcagggaaggagggacaccgggtgaaaggaggtgggtgtaggaggaaggagatcacaactgtgttgaaagtcctagcagcctgagaaagacgggggaagaaggccctgcaatgaaccctgtgaccttgggaaggacaagtcctcttgcccctggggcccactgtctgagtccctaggaagtatatatacaaagggtttcggaatgcagagtttgcagatgtgggctgcagctgcaccctgtgtgtgactggatggaattcacagctagaagtggttttgtccctggctgctgaatgtatcagctgttggtgccgctttagttttattgagtgggaaggatgtagaccctgagtctggagaatgggactgggctggccatggagcctggagaagagaatgagaccatgcaaaacctttattccttgttcttggtttcttgttaaacaggcccagtgccaccagattaaggaggtgagggggcggttgtaagaaagtaagagatcagtctgaagattataaatatgggccagtgcaacaaagggaaattcttgtgtcaatatttttctgagccagcacttgggagatcctgatttccttaacaaaatgataacaaacattttttcatgttaataatgtaagatgaacatttccttcatgtttaagccactgaatgtgcagtgaacaaaagacatttacatacaggcatatttgaggatatggaaggttcaattccacaccactgcaataaagcaaatatcaccatagagcaatttatacaatttctttggttttccagtgcatgtaaaagttatgtacattatactgtagtctattaagtgtgcaataaccactccttatctgtctaagaaacatacataccttaattaaaagataccttattgctaaaagatgctaaaggtcatctgagcctttagtgagtaataatctttttgcttgaaggagagtcctgcctccgtgttaatggctgctgactgaccacggtggcggttactgaagcttggggtggctgtggcaatttcttaaaatgagacaacaatgaagtttgacacatcagttgacttttactgtcaggaaagatttatttgtagcatgcaatgctgtttgggatagcattttacctacagtagaacttctctcaaaaaaatggaatcaagcctctcaaaccctgctgctgctttatcaactaaatttatggaatattctaaatccttttttgtcatttcaacgatgttcacagcatcttcaccaggaggaaattccatcttaagaaaccactttctttgctcactcataagaggctactcctcgtctgttcaagttttaatatgagattgcagcaattcagtcacatcttcaggctccacttctcattctagttctcttgctatttccaacacatctgcagttactacctccaccaaagtcacaaaccccgcaaagccacctatgaaggttggaatcgatttcttccaatcttatgttaatgttgatactttgacctcctcccatgaatcaatgtttttaatgacatatagcatggtgaatcctttccagaaggttttcaattgactttgcccacatccattagaggaatcactatttttggcgctataaccttacaaaatgtattttttaaataataaaactgggaagtcaaaattatgccttgattcatgggctgcagaatggatgttttattagcaggcataaaaacaacattcatctccttgtacatctccctcagagctgatgggtgaccaggcatattatcagtgatgagtgctattttgaaaggaatcttttcttctgagcaacaggtctcaacagtgggcttaaaatattccacaaaccatgctgtaaatagatgctatcatccaggctttgttattccatttttagaacacagccagagtatgtaactcatttatttatttatttaatttatttattttattatactttaagttttagggtacatgtgcacaatgtgcaggttagttacatatgtatacatgtgccatgttggtgtgctgcacccattaactgatcatttaacattaggtatatctcctaatgctatccctcccccctccccccaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatcccgtctattattgttggacatttgggttggttccaagtctttgctattgtgaacagtgccacaataaacatacgtgtgcatgtatctttatagcagcatgatttataatcctttgggtatatacccagtaatgggatggctgggtcaaatggtatttctagttctagttccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcgtgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtcctttcccatgcctatgccctgaatggtattgcctaggttttcttctagggtttttatggtttcaggtctaacatttaagtctttaatccatcttgaattgatttttgtataaggtgtaaggaagggatccagtttcagctttctacatatggctagccagttttcccagcaccatttattaaatagggaatcgtttccccatttcttgttttgtcaggtttgtcaaagatcagatggttgtagatatgcagcattatttctgagggctctgttctgttccattggtctatatctctgttttggtaccagtaccatgctgttttggttactgtagccttgtagtataatgtgaagtcaggtagcgtgatgcctccggctttgttcttttggcttaggattgacttggcaatgtgggctcttttttggttccatatgaactttaaagtagttttttccaattctgtgaagaaagtcattggcagcttgatggggatggcattgaatctataaattaccttgggcagtatggccattttcatgatattgattcttcctacccatgagcatggagtgttcttccatttgtttgtatcctcttttatttcactgagcagtggtttgtagttctccttgaagaggtccttcatatcccttgtaagttggattcctaggtattttattctctttgaagcaattgtgaatgggagttcactcatgatttggctctctgtttgtataagaatgcttgtgatttttgcacattgattttgtatcctgagactttgctgaagttgcctatcagcttaaggagattttgggctgagacgatggggttttctagatatacaatcatgtcatctgcacacagggacaatttgacttccacttttcctaattgaataccctttatttccttgtcctgcctgatttccctggccagaacttccaacactatgttgaataggagtggtgagagagggcatccctgtcttgtgccagttttcaaaggaaatgcttccagtttttgcccattcagtacgatattggctgtgggtttgccatagatagctgttattattttgagatacgtcccatcaatacctaatttactgagagtttttagcatgaagggttgttgaattttgtcaaaggccttttctgcatctattgagataatcatgtggtttttgtcgttggttctgtttatatgctggattacatttattgatttgtgtatgttgaaccagccttgcatcccagggatgaagcccacttgatcatggtggataagctttttgatgtgccgctggatttagtttgtcagtattttattgaggaattttgcatcgatgttcatcagggatattggtctaaaattctctttttgttgtgtctctgccaggctttggtatgctggcctcatagaatgagttagggaggattccctctttttctgttgattggaatagtttcagaaggaatggtaccagctcctccttgtacctctggtagaattcggctgtgaatccatctggtcctggactttttttggttggtaagctattattgcctcaatttcagagcctgttattggtctattcagagattcaacttcttcctggtttagtcttgggagggtgtatgtgttgaggaatttatccatttcttccagattttctagtttatttgcatagaggtgtacagtgcaatcaaactagacctcaggattaagaaactcactcaaaaccgctcaactacacggaaacggaacaacctgctcctgaatgactactgggtacataacgaaatgaaggcagaagaaataaagatgttctttgaaaccaatgagaccaaagacacaacataccagaatctctgggacacattcaaagcagtgtgtagagggaaatttatagcactaaatgcccacaagagaaagcaggaaagatctaaaattgacaccctaacttcacaattaaaagaactagagaagcaagagcaaacacattcaaaagctagcagaaagcaagaaataactaagatcagagcagaactgaagtaaatagagacacaaaaatcccttcaaaaaatcaatgaatccaggagctggttttttgaaaagatcaacaaaattgatagactgctagcaaggctaataaagaagaacagagagaagaatcaaatagacacaataaaaaatgataaaggggatatcaccaccgatcccacagaaatacaaactaccatcagagaatacaataaacagagtatgtaattcttaaaagccctaggagttttggaatgagcgttggcttcaatttaaagtcaccaggtgcattcgccctaataaaagagtcagcttgtcctttggaaacaggcattgacttctcctctccagctatgaaagtcctagatggcatcttcttccaatagaaggctgttttgcttgcattgaaaatctgttgtttagtgtggtcaccttcatcaatgatcttagcaagatcttctggataacttgctgcagcttctatgtcatcacttgctgcttcaccttttttttaattttttttttgacgtttcactcttgttgcctaggctggagtgcaatgctgtgatctcagctcactgcaacctctgcctcccaggttcaagcaattctcctgtctcagccttctaagtagctgggatcataggcgtccaccactacttctggctaatttttggtattttcagtagagacggggtttcaccatgcctggtggccaggctggtttcaaactcctgacctcaggtgatctgcccgcctcggcctcccaaagcgctggaattacaggcatgagccaccacaccaggcccaccttgcatttttatgtgatggggacagctttttttccataagcctcatgaaccatcctctgctagcttcaaccttttcttctgcagcttcttcacctctttcagccttcattgtattgaagagagttagtgtcttgctctggattaggatttggcttaaggcagcatggctggtttgatcttctatccagaccacttacgctttctccatatcagcgataagcctatttcactttcctgttcatgtgttcactggaggagcacttttaactactttcaagaacttttcctttgcattcacaagttggctgtttggtgcaataggcctagctttcagcctgtcttggcttttgacatgccttctactaagcttgatcattttcagcttttgatttaaagtgacagatgtgtgactcctttcacttgaacacttagaggccattgtagggttattatggacctaattttaatattgttgtgtctcaaagaacagtgaggcttgagaagagggagagagatgggagaacagctggtcagtggagcagtcagaacatacgaaacctttatcaattaaatttgccatcttatatgggcatggtaccccaaacagttataatagtaacatcaaagatcaccgatcatatgtcatatgtcaccatacagacataacgatgaaaaagttgaaaatattgtgagaattaccaaaatttaacagagacaggaagcgagcacatgctcttgatacaattgcttgacacagggttatcacaaactttcaatttgtaaaaaatgcaatgtctgggaagtgcgataaaatgaggtatgcctttactgactttaattttagtaaatgacttcataaggaaaaggaaaaaatgtcattgtgagggcactgtgtttgttatagactagctaggtcatcaactgggtggttttgatactagcagagtcctccatgtgctaggacactgtttgaaattcttgttatagctttaaaagtcatggttttatcaactaactccctattagttactgtaattgaatttttatgttagcttccactagtagcaagtttttgagtcaagatggcccttgggttttattgccaaccctgacagcagaatcctagacagggtcgctttgctcttaaagcctctgatgtccagttgcaaagtgagtataattgcttctctctcagatctgtgttgaggagctcaagaaataacgaatgtggaagcactcagatcaattactttttttgtttgtttctaccttatctagtttcctaggtcaaaagtttgcttggctaatggaagaaaggagtcccaacctttccaagtgggacagattccctagctgtgctctgtatattgaatctgcttcttatcatttggctgtggtctgtgtgagtgctgaaaaggaggagataatttcacgcactagggaaatggaaaagactcctgcttggcaggcaccagggtggcaagagaatccaggatgtggccacgcacagcttaaagactacatttcccagctgcctttgcaggtgaatgccatcagtgagacctaattgagagtatagtctggggagtctgggaatgttgcctaagaaaggctgatttagttggtggtgcaactccctttttacctcccctctttctctctttctggaatgtggatatgatggcagaaccacagatgatcttgaatgaggaggtcacttgctgaggatggtgcaacagaaagatggaaggagctcaatccctgatgagcttgtggacctactgtatcagtcctggattactcactttctgtcttttatggagagaataaaccatcctctttttaagttgctcttccccctttgtttgtgatccctcttaccatagaccaaacttaattcctaatgaatagatctgccaaattgtttatatcagagatgacaacaggaacacatctgtttacattttcctttctcctgaagccccacctagtcccagagggtggtgtgtttcttcactgctattttgggcagaagctacccggctgtggtggttaaagtcagcactgctgttagcccttgtggggcctttgtgcaaattgaaaaaaggcattcatatcctaagacaccttcctgttctttgccagaaaaatgtctcaatgcaaattgacaatgtgtggacaggaatggaacatgcccttgagaagcagcccctgcacaggatgccactgctcagctttgggtcaatgtccaggccagtatctgacctcgaacttctctctaggtcttccacctttacttagcacaggcctcagaacagtccagccaggggtctaggagagaaagtggctgagactgtgtgagatggggatggggcagaggacggatagggtagagggtggattacagtgagtttctggctattgactgctttcacatgagcagctcatttctgtgccaaccatttgactagtaagttggcagaagccctgcctgttggtcacattctggcccatgctacaaggccacctggcaggctcaggctgcagcacggcaggctgtgtgcacacggctatctcccctagtctgtccccagagctgtctgtgcagtcctgagctcccatgtaagccaatgctacttttgtgtgaagaaggtggacgaaatcatcagcaactcttgcttatatagaatgtgacccaagcaatggaaagagaaaatccaggtcttggttttgtactggcttgcgagaagtccttcttttcctctctagcaatttccctacatccatccctgcctacccacattggattaaagggaagagagaaaaatgccctaagccccagagagaaaggtggcagaaccatgatattgctgctcttgactttgtaagatggccaacatcagcccagagaaatctgatctgaaatagaatgagctcacctgacttcgaaatttaccacatttgtcatgaggcagtcacttaacctaaaaagtaaacaggctcttactctgtcatagtttacatttgtgtgtgtgtgtccttttctgttttctttctttctttctctttctttctttcttttctttctttcttctttctttctttttagtagctttaacttgttctgcaaacaaagaatatgacagaacaatgtacgttcctttgaaatggcaccattaatcttgatagcaagtttctaattatgaaggatagagagctttggctgcttcatggaactgtgtcctggtgacttttttcagtccctttttcttgctttccctgtctccggtagcttccttgagagctgtggtttctcagtgttagatattcaaaagcacagcagcctacaggccatggctaaatcttctttacaaccagatgcatatgagatcttagcaggaagtaagaaaagtaaacgcattattaataaacacacttaaatgcatacaataaaatgaatgctgtttccttcaaagtaaccctcctttgcagatatagtctaaccaagcctctattgccctgcccagcatggatctgaaactctcctccgtaaattctctagaactctaggaccgccccttctaaatgcccaaaagaatcccaactgactgagggcaaagatgcaccttatttctggctccctttcgcttcaccacttgacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagtgctttgtaaatactttgattggtagaggaaaaaggaattgcatattgaaagaactgtatttccattaaaatgcatgtgtgtaaagtaaagaagggcaggaaacattgagcccaagactttctgagtttgagtgaaccaacctgctggagtggtttctggccatcactttgtgctgccatgtctcagcctgtgctaagtccagaggatctggggttccgatatttgcaagaaaaagcaaggacaacaggtttgaagtcaagcaatgggagggtctcccagagacctggagcagggaggatgagtgccttagctgcttctgtctatccatcttccatctgtctggcaatcaggatattttctggggcccattcaatgcttctctgttggctgggggctcccatcagctgccaggggttccacctgttttcagtggtccatgtgcagtactcagagaaatgcctcctgagggaatgagtccagcgggtgagcgccttttaagaaatgcggtggctcacacctgtaatccagcactttgggaggccaaggcaggcagatcaccagaggtcaggagtttcaaaccagcctggtcaacatggtgaaaccccatctctactaaaaatacaaaaaatagctgggtgtggtggtgggcacctgtaatcccagctaatcaggaggctgaggtaggagaatcgcttgaacctgggaggcggaggctgcagtgacccaagattgtgccactgcacttcagcctgggcgacagagcgagactccatttcaaaaaacaaggagtatgaaaatgctttccagctctttgcagtagggcctgtctcatggggtgcagcctggaacttgcgcaggcccctacacagaaggacctgtgcttggcccaatgctctgctcctgctgtcttgtcatacttaatactttttttagcaagaggccctgaatgccatttgcattaggcaaattctatagctgatcctgatgaggctcttctgtatggggacctgcacaactgcaggactgcaccctatgacgcaggccctattgcaaatggctggaaagcgtttttgtatttcttaaagggtgttcactccctggattcagtcgcccccaaaataacgtcttgggtgtcttatttaggtggcacctgcttggtctgaaagagctcatgtgacttcaggaaatactgaatttgttctgagaaagcctcttgccctaaaaaaaagtgtatggggggagtgctcctagtctgtcatagttaaagttcaaaggttatttacagtgtgttgcatccactgtggtgactcctggcagatcctgaacttaagcagacgtgtgttacagatcttaatgagtgtgttgatgccgatgggagttgccctggatcacaccaagtgggtgatgggtgggtgagaggagagacattctttttgttaacccctcatttccacggtcagtctcagatggtcattacaaacctcttctaaatctggacctcaacaagcccccctcacaccagggacaaagtaagggtcatgcgatggcctctgagctgaccttcgagttcagagtggccgtgtgctggtgctgtgatcattaaactgactgctttgcaaggtcagcactcaaggctatagatttatatctctcttttattctaaaactagactatgccacaaccaggtgactgtggtgcctcactcaggtggtctgtcttctgcagttgaaggcaggtctttttcctccatccattcagattgaatccagggggtcctccctggaagacctgtgttccacagaagactcccctggagcttctcctctctgcacctcagctttcttgtgggtgcagcaggccacccaggcccagtccctgctcacgacaatgacttcagctttccagggtctttctcatgcattcccaaccattagactccccagtcctctctctattttttccccttatttagtaaatatttattgaagatccattacttgcacaaaagacagcaggccgcagggaaaggggtttatagtgggagatacgatgaaaagatgattaagattgcaagttctcaaaagtttagatgttgaagtattattttccaaagtgagttacacagggtattaatgggtaccgctcaaagaaagggttctagagtgaatatgaaacattggcttaaacaaagttaaacattttaaattactgcacagcttctcaaaagttttaatatgctaatgtgtcatctaacttcccaaaaggagaaacataatatattggacttcttaaaagtatttatgacattttttcttgcattgaactagtcccagatagaagacttagccttaaagggcaaaataaaaagatgagttctttttctttttaactgacaaataaaaattgtatacatttatggcttataatatgatgttttgcaatatgtatactttgtaggatggctaaactgagctactaacatgtgcatcacctcctatttttttgtgtggtgagaacacttaaaatctactctcagtgattctcaaaatacaatacattattaactatagtcagcatgttgtacaatagatctcttgaatttattcctcctgtctaactgaacttctgtatcctttcaccaatatctccccaaccttccccatacccctgactccagcgcctgctatcaccactctacgttctacttctgagtttgactttttataatagattccacatatgaatgagatcatgcagtatttgtcttccgtgcctggctcatttcacttagcataatgtcttcaaatgtcctcagggtctgcccctctttctgcctctgtgggggctccaagtgggaattcgtggttactgtaattggcagggggcggagatttggagctggaacctctagagtctgagctctaccatggaaaggccgtataatgctcagcaagtcatttaactctttggtgtctctgttttctcattgataaatgcaaagataatagtgcaccttcactgagcttcactgggttagccaggtaaaaagccttatggggcaatgcctggctctggcaggcttgaatgctggccgctggctctggttctcccatgtggaaacaaagcctacgtctcacacccagcagcaggagcagcggggtctcggcccagccagtgtgtcctgagtggcacagggtcagacataaccaggtccatgaacatttgtgtctttgtataaggtcagacttttattgatgcaatttcaatcataaaagccactagctgcatggagttcccaaggaggtgattttctttagtgctacctgtttacttggtagttaaagcctcaggcgcactttacaaatcagtcagtattgcaaacaagacatagtagtacacttaatcaatatacaattgctatagattaaaccttctacatcagtaaacattcataaagtaatatttaacattaagagaaagggggataggataaacgggttaatgaaccagtccaagagggtaacatgaacaaggagaatgtcctggtctgatctggatggacatcaacattttgtaagaaagagactatcgtggcagatgctgggtgctggtcatgagtaacagcaggatggggtctatgaagacggccatctggagctggtgaattcttcctctttttatagcccccgagtcctctggtgaggactgataaagtgaaccttatctgattgggtatagtcactgttgattagacaaacatctggctcctgttggcatgatgtcttttaaaaatgtaagatggagtctttttctaagatggagtcacttaggtcaaaggtcctgtgtccacaggggctgcccacatttcaccacaagttgccatgagactgcccaggaggacccgaatgcctggagtgctccagccatgctcatgccacggcttttgtccctctgcctgtctttggacacctctggtgtggagttggagatgaggaggagaggcttgcattcctatcagcagtgtggaatgagcagaggtgcgggtagactgaagctctgtgtttaacctctgtttacagaatatggacgctgagagagagtctggggtacttaaggaaaggcttgattggattgcagaaaacagtttctgaaacagactatttctgaagactcaaattttaattcttttgaatttatacagcaactcatctcacaaataattattaaatgataataacaataataatgatactcttcctcctcctattatcaccaaatagcatttactgggtgttggcaaaatgctgggcattggtcaggaatgctggacttgtatttccacttgacccttcaaaaatccttgtgatcaataaattactatgttatataattaaaatattaaaattattggaaattttatttaataatagcaataatatattagtgtaaatacttttctgaataatgaaatatacaataatatattatgcacaaacacaaatgtgttaagtaaacacatcagagcttgttgccagccatgatataatgtgtattatcatatgctataccgacatccccatttgacattggaggatatgagctctgggttgctaagtgacatttcccaggttacagctctctggaggaggcagctggactccaggaccccgtgtttcctgagacctccatagcctgcctcccgctttgctgtgctgcttctatgagaagataaagtaatttaatagcagctgtcgatatgcagggccacctctcaagtgcttgaaaatagttctcttaagcgggaaatactttttttttttcccaaaataatttattatgtttcaaaagtatttcctctaattgcagggaatccaaatcaagcgcttgcatttcttataaacaaacacctctgtatactttcccctgaccatggctgacttcaaaaccaggccggcctgcaccagagcctcagagccagagaccgccccaggcagaaccacagactatgcagggcacctctgttcacctctgcacccatctccctgaagtgccgggcttggcttcccggcaacatccttcatttcaacagctaaatacgcggtcaacaatgggttggtgaaaatgggggcgcccaggagccattccatgccttcagatggggtccgggctcactgtgcaatgcatcatttcacacaggttaaaaggaaaagcagttgccagtgcctgttgttcatttaaggagattaaaatgatagaaaaagaggattttgcatttagacagtgagcagtggaatttaaaaagcagtgccagaaatcatttagtatgtgttacattctattcttttttttttttttccagacagagtctcactctgtcatccaggctggagtgcagtggcatcatcttggctcactgcaacctctgcctccctcaagttcaagtgattctcctgcctaagcctcccgagtagctgggattacaggcacccgtcaccaagcccagctaatttttgtatttttactagagacgaggtttcgccgtttggccaggctggtcttgaactcctgacctcaggtgatccgcctgcctcggcctcccaaagtgctgggattataggcgtgagccactgtgcctggccttagtatgtgttacattaaaaaaatcactccataaagatgtacaattattatgtattaataaaaaatgaaaataaaaagaccgtgtaaactgccacgtattcccactggagagctggtgagtctctccgtggatcgtaccattaccacaagagtcctctggcccacgcacaccctgctctgcccatcagcagtgctccccctcctctccgccattggcttctcatatcctcctgggctgatgtgcccatgctgtgtactcaacactgcctctggctggtgcaagcctggaagggaggtagacggtatggatggctaagcaggcgagctgggctggctgtggcctcggctgtctatcacgctgctacccagcctcggattcaggtcgaacttgcctgcactttctgaacacctagaaagatgcagcccgggcccagacagttcacttctcactcagcaaatgggaaaaaaaaatggagaaggcgctgcgtcctttgaggctcctgccctccagccaccttatctactgtgtctctctgggctcaaatggcgctttcctccagggctctcttggcgtctcatccctctacctccacagggtgtggtaccttcctttgttcctgtggttcccactgcacagctggatctctgttctcactgcctgaaattaacattcctgttcccgtttctcttgccttcctgacttccaggaggtggtggcagttactcagctctgcttccacaccctcgccatgtcttcctcaatagactcaaccctttgtcctgctagttgctagtactcaggtcacaggcagtggaactcgtcttcggcatttagtaagagatggcctttctgactttgtgccccagccacggtgcagtcttctggatctttcccagcagcgtcgacaccgtgagtgctgcctgtgcacgcattcgttgcattcttgctccagatggcagtctgaccagcacgactcaactcccctcccctcctgtccctttctagtaaaattgcctgtatgttaccccaacctctgctgactcacaggtgactgctgtcctgatttttaaccccgcagaataattttgtctgtttttgagattcacataaatggaattgtatagtacacactatttggtgcctagtggcttgaatttagtacagtgttttagaaacacatccctgctgttttgtctgtcagtagtttatttgtttgctgggtgatgttccattgtataattatcctataatttctttattcattctcctgttgttgtgcccttgtttatttccagtttttggctactgtgggagacagcatgtgtagcagtggcgctagctaggcttggacattagtctctctccagaacttgggacaggccattaaggacaggactggtgaatgtgacccagagcttgctgaccctcagctgcctgggacagcagtggcagtctgaccctgggggagtcagaggagggccacgtggtgaccgttacaccccaggagatacggactcaatgagcaaacccctgtggacaggggtcaaggaatctccctcctaaggaaatacagggttttgtgattttctttggttcaatgtcaagagaatcaagttgtgggaaatgctggaaccctcctcaactcagtgcactgagtccctgaatgctcactaaaggagacaggaaaggtggagtgcaggcctgcacagcagctactgggctctggatcagggagggcatcgtacaatatccaaggagagagcaacggaaggaaacaccagttaattcatttaaatctcacaataacatgtcatctctatttcatagatttgaaagctgaggttcagatatgttaaataatttgtccaggggtagcagctagtgtcagagccgcttcttaataactggccacagaactagataattctccaaagataaaatgcaaactaagtgactagtagaaaacattgattatatattagttttatgccaaatgctattcttgccagggtattacagttaaaaagacagacagaaattcttgccttgatggtgccccaggatgagatgaatgatgaacaaagtgaacacatagagtattctagaaggtggtctatggagaaaaataaaacagagaagaaacaggggttgtggtttcaggggtatttgcaagagtaaatatcttgaccaggaaaagcctatgagaaagtggcatttgaggacagacttgaaagagatgagagcatgaccctggggtgggattgagcattaaaggtgaggaaatggccgtgcaaaggccctgtgacagcagtgtgccaaggctgagaaaatgcagagagggcagggtgacttaagtgactgagtgagggggagtcataggagctggcgtcagaggggggtttctggggatgagctcaggtggacctcacaggccatggtgaggaatgactctttgctgagtaaggtgggaaaccatggagggtttggaacaggggagtcacatgccctgagttgcgtttaacaggatcgctctggctgcccagttgacaacagataattgtgggacagaaacatgaagacccttaggacattattgcaataattcaagcaataattcagatggtgactttgaccagagtggctgttccacacgtggtgaaaagtggtcacaataaggttcaattgggaaagtgggacccaaagatttgctcacggataggatgagggatgtgaaagaattgattctgactccaaggatggtgacattgctattcaccgaggtggggcaggtgacaggaaagcagctttgcagggaagaacaggaactcatttttggatacttcacactgggaaatgccaaggaaagctgttagacagctggatatctgcatgtggagttgagggaggggtccagctcggaaatataagcatgggcgtcatcagcgtacagactgtatttcaaacatgagagtggatggggttatctagggagtgcctctgacattctgaggttgggctagacccaggggaggagacagtagaggggcatccagtgaggggagaggaaagcaggaaagcagcggtggactggagggggtgtctggctgtgtcacagcagctcttaggtcaggtgatctgggggcttggcaatttggagctcatttgagggagattttgcagcaaaagcctgagtgggttgggttcaagagaattggggactgtggacacagacaactgcaaagggttgggtggagaggatgtaggccaaaagaggctctgtccagcctgaccaacatggagaaaccccatctctactaaaaatacaaaattagccgggagtggatgtgcatgcatgtaatcccagctactcaggtggctgaggcaggagaatcttttgaacccgggggtgcggaggttgcagtgagccgagattgtgccattgcactccagcctgggcaacaagaacgaaactccgtctcaaaaaaaaaaaaaaaaaaaaagggaaagaaaagaggcttcttctaactctttttcatggcagatttcaaacatatacaaacacaggatgaaagaacaaaatgcttgtgtctccaccacccacttcaacaatgatcttgaccaatcctgctccatctataccattccttcccttgcaaaccccaaacatgtatattaaattaattgatattgccccacctgcaaaccccaaacatgtatattaaattaattgatattgctccacagctcactgaggccccacagctcactgagaccctgtaaaagttttttgtttttttttttttttgagttcttctcccctctatgcttcatttgggataggtgccatggggctgccttctagtttgctgatcttttcttctccagcatctaatgtaccattcatcttatccagtgaactttccatttctgatattttacttttcatttctagaatttcatttgtttggtttttgtatcttccatttctttgcttgtcatgtttatgccttcctttttggtggctcacgcctgtaatcccagcactttgggaggccgaagcgggtgaatcatctgtggtcaggagttcgagaccagcctggccaacatggtgaaaccccttttctaccaaaaatacaaaaaattagctgggcgtggtagtgcatgcctgtaatcccagctacttgggaggctgaggcaggagaatgacttgaacctggtaggcagaggttgcagtgagctgagatcgtaccattgcactctggcttggacaacaagagcaaagctccacctcaaaaaagaaaaaaaaaaaggaaaaagaaaatatttgtaagattaaaaataactgttttaagattcttatcagatagtttcatcatcattgtaatttctattgactatcttttttaaaaatccagtttatgggttatggttttcttgcttctttgtatgcctggcagttttttattagatgctctatatagcgcacttttcattgttgagggctagattttgttgcatttccataaagagtgttggattttcttttggaacacacttaagttgcttgggatcaggttgaccacttcaaagcttacttttatgttttatggcaggcccagagcagcatttagtttgggactaatttagccctactgcagcaatgtccacaactagggcatggcatggatggagtggcccatgcagagtagggaggggcaaggcacgttcaagagctgagaggccattataggaaagatcatcttgtgactattaaagtggccaaggtactaaatctgtttgtccttccttccttccttccttccttcgtccttccttctttccttccctccctccttccctccttcctttcttccctccttccctccttcctccctcccttccttccctccctccctccttccctccttccttcattccttccctcccttcctttctttcctccctccttccctccctccattcttccctccttccctccctccctccctctctccttccctccctccctcccttccttccttccttccctccttcctatctccttccctccctccttctttccttccttcctttctgaaagttgggaaaataaagaactaaattccgtgcatgatcctagattggatcctgaattgggggtgaggtcctataaaagatattattagaacaatttgatgaaatttaaatttgtacagtatattaaataataatacataaataataaatttcctgaattgggccaggtgtggtcgctcatgcctgtaatctcagcactttgggaagctgaggcaagtggatcacttgaggccaggagtttgagaccaggctggccaacatggtgaaccccatctctactaaaaatacaacaattagccaggcatggtggcgggtgcctgtaatcccagctatttgggaggctgaggcactaagaattgcttgaacccaggagacagaggttgcagtgagcagagatcatgccactgcactccagcctgaatgacagagtgagactctgtctcaaaaataaaaaaaaaaaccataaaaatgaataaattttccaaatttgatcagtgtattgtgattatataagcgaattccttgttcttaggaagtacatatgctgaagtattgagatgcaaagggtcaatttactctcaaatggttcaacgacataaagagagaaaaaagaaaaaagagaaagagcacaaatgtgataaaatgtgaacaaagaatgaatcattgttgtactataattcccgggatcccaggaatatgtactcactaggacagtcatttgtcacgttgcttaggaagcaggtttggagtcttgtgtggggaattcgtcgacaccaccagtcccgagtttatgtgcagtggaaaatggagcagtgtggtcagcagtaggagagccagcttccaccctccacctgctgttccacgtggtgggtctgcacagcctggcttgtgagcaaatccatttttccttctctttgggaccaacatgggcttagagatgacatagccttgggcatccaataaattcaaatttgagaatctcaatgattcaaaattgctgctgtcaattaatacatgatgaattcatgttgttttgaaaaaagaatgattgaggtgaccaacagaagacttcaatgtttgtccccaagtaggtaggccaccccagatttccaaccctgggtgcattgcattggcaatctaaatcccaaggactgtgaactctgtggtcattctgcagtttcctctgagagtattcatgggttggggaatctcctgctgaaaaggatattgggtaaaattgctttatgtgagcactagtaaacatttagcatatattaccaagaaaagcaacactgtaagcccaggaagcttagagcttctcaaacagaaggggatgatggagaaaaaaggtgaaaagtctggcaggcaggatgaaggtcaatcaaaaaagggcagctggccacagggaaatatcatttcacccctactagcgtgactgaaaaaaatgtatgttggtgaggatatagagacattgctgatgtcattttaaaatggcatagctactttggaaaacagtctagcaattccttgaaaagttaaatgtagagtttccatatgacccagcaattccactcctaggtatatactcaagtgaaataaaaacacatgcccccgcaaaaacaaaacttgtacacgaatgttcattgcagcatttttcatgatagcccaaagtggaaacaacccaagtgtctacaaactgatgaacgaataaataaaatgcggcatattcataccaagaactatcctttggcaagacaaagaaatgaaatactgataaatgggacaattggggtaagctttgaaaatgtgctgagtgaaaaaaagccagacacaaaaggccacatattgtatgactctgtttatctgaaacatccagaacaggcaaatctgtagagacagaaagtagattagttgtggcagggctagaaggagagggatttagggagtgatgacttatgggtgtggtgttttctttttggggtggtgaaaatgttctgaaattagatagtagtgatggttgtacaactctgtgaatatactgaaactaactgaattgtacgttctagaaggatgaattttatggcatatgcatggcacctaaaaaaaccaaaagagggcagctgtgtatcctgggtttttccttgcttcttgtatgtgtgtttctgcagtccggttgagcagctatgcctcaaccctcgggtctatcctggtcttgaatgttcctgactgttgtcttcagtcttggaaccacacagcaccacagcacagcctgcaagccttcctgggaagatttacacctctaggctgagtctctgctactgcactttctcctccctctcaaatgaaaccgcagtgcctctctgtgtgaccttctcagtcatgcaatgacttctctttcatttcctataagcctctgagctctgccttctccttgccaattccccttagctccatcttcctttggccgtccgccgttgtgtaaatctgtagggaaatgtcattcaaagacaaaacccactgcttattcttctttcttaattgctccttgggaaatgtttgcttctgtgttcttggtgaaggaaagcttaattttgtctgcttttatatcactagtcttttcagattacacattcccaatcaatcacctcttgaatcaagtaattagttttattgtatcagtctatccttcagaatttcattatgcaaatataaacatgcataaatacattcatgtttccccgccttttacacaaaaggaggcacactgttttgtgccttgctttcgtttcacttactatgtctgagaacttttcacatcattatatggagagcttcccctttctttatcagctgtgtgagagtccagtgtcaagatggactgtgtttggtttcatcagtctctgtggaaggatcctggctgacctgtgtcttttgcttttacaaaccttgctggatgatctcacaatcaccttgttgcatgcacacgtaggcagagctgtagaatagactcccagtggggcagttgctgggcaaagggtaaatctctttataattttggcacatattgccagagtgccttctacagggttctatcaactgctgggcactcctgtcagcagtaagagtggctgcttctcccagcctttccagtaaaatatgttaccaacatttgaagccaggtgcagttgctcatgcctgtaatcccagcaactttgttactaacatttgggatttccgcaatggtgtgtgctaataaatgtttaacaaccacttctccaaacaaaacgaaacaaaacaaaacccaaaaccaaaaaaacaagaagccctaattgtagtatctgctgatttccatagcataaatacttctacccaggccaattgcaagctatcaacatgatgtccctgaacacggagttgggaagagatgggccgtagcacccactgtatagtatttctaccacacagatgcaagagatgcaagtagcatggataattgtgaaatgtggtaaaataataaggaatttaagagtttttatttcctttgtatttgtatgatttatttagttataaatttatataattaaatcttagcaacaatctgcatttaacaacctactcataaaaccagctcctaaaaatctggtaattattcatggtcaactgtcaagagtcagctccagcacactactgcaatgctgccaatttgaaaggtagcgaatgccatcccaatgtagttgtcatttttattgttattgttttacttgtttaaggacgatttgcatttccttttctgtgaaatatgtttctgtccttcgcacatttatctactgagttttattctcttgttgatttctaggagatccttatacatgaagctccttctgcatatcttttgtctgtgttataaactgcagtgttttttcccggtttgttatttatcttttgtgcttgcccatggcatttttctttttttctttttctttttttgccatgaagttgttgttgttattgtttcaaaatatagttgaattatttttttcattttttctggtttttttttttttttttttgacacggagtctcattctgtcacccagactggagtgcagtggcatgctatctcggcttaccacaacctccacctcccaggttcaagcgattctcctgcctcagcctcccgagtagctgggattacaggtgtgtgccaccatgcccagcttattttttttttgttttgtatttttagtagagatgggggtttcaccatgttggccaggctggtctcgaactcctgacctcaagtgattttcctgccttgacctcccaaagtgctgggattacaggtgtgagccactgtgcccagcccattttttcttttatggcgtccaaatgttgaataactaggaacaacaggattaaatacattttttttctaatcacaatcaagtttcacatacttaagcaagtttcttatactctaagcagtctgtacaattcctgtatctccttggagttcattatattcaattttgtctttttcttttgagtcagattattatttaaaaaccctctctacttaatggtatcacaaatatgcataatatgttagagacaggcctggcacacttcagctaaaaagaagtatgcatagaggttataaaatatttatcaagataccatcactagttcagtggtggctaaccccaccacttttctgtgactagtattatttcctactggggagtttcttcacttgtgtttgacttcccatgtgggcattgtcttagtaattttgtgttgctgtaacagaatagcacagactaggtaatttataatgaatagatatttgtttgacttatggttctggaggctgggaagtccaatattgaggtactgcatcagataagggaagctctcatatggcaagaaagtttacaggggagagaaagagagggctgaccttgcttttataacaaatccactctcaaggtaaagaatccactccctcaacaatgacattaatccattcccgatggcagagccctcatgaaataataattgcttaaagatcctatttctcaacacagttgcactgggaaacaagttcccaatgcatgaactttggggaacacattcaaagcatagtaggcatgtactggcttagtcctgcattgctctctccatcagacttcaaggcccaaagctctaagaatgatgctggagtgtggtttgtgttcaagaaatattagttgagacaccacattcaaaggtatgaacccctcagatagactttcatctgcatctccaccatccctgacaatgcccattaacatttagtcagcagccacacatttccagcattacttgagaagctgtgcatgtggtctatgtggtgtagcctcagaatacggtcatgcagaaagttctaactcagtgtatctaaaagccacttgaccacttagagtgagcttttatttctagcatctcatttttggttctgactttagaaatgtgaaaaccagatctcaggtatgatatgtaatttacccaaagttacctcattgctactttggcttttagtagtgcgtctggcacatagtaagtcctcaataaaatgaagagcatttgagatgacatgattttcccatttcccagtccagggctcatgtcactgtcctattacaggtatgacccaagatggtggtggctggatagtttccttccaaggtactctttaaggggtagacatgaaaggcagtgatcactcatgccaacaccctatgcttgtaacctgatctccccctggctggtaggccttattctgtcaagatttacccttagaaaagcatatgataagtataacaactacaaaatattgagggcatattatataccagttaatgtgctatgtgtccaatcctcatccaaccctgtctggtgttaatattattactgtcattttataggggtgcagagaggttataggactagtccaagaccagacagaggcaacagtagagccaggtggaaattcaggtctgtcatggtcacaatgctctttgtccgtggggcatggagttgcccaatatattattgttttacagtctttagacacagtgtcttcgcttgacaggaggcacgttcctttatgttgtaggaaatgcactgaacctgaataactctacaggagagctctcatccccccttccaggtcgtccctgctctcagcctgcacctcccattttttgatcaagacagccttgaagttctttatgtctgtggaaggaaggagacggagcttgtttttcacttttgctgccatgattaattatttttaggaaagcattgtgtcttttgagagaggattgtaagtgctgggagaataaatggatcttagagtgagccttgtgtgctccagacttccccagcttgataaacagcttcctgaccagtggctgccagtccctggtctcactggacggacattggctgggggccaatgtctgagttgaatggcgaggactggacagtgcttcttcccagccagtgtggcaatgagcccactcttaagaaggcgccttggcttgggaaaacacattgcacattagatgttggtatccgcggcagggacctgaggctggagtcactgccaggcaccttctgggaggcctggctttccagcaaggcctgcttcacattctcaggagaaccagacccagcataggaaatgccctattgcccaagaggaaaccccatgtcgaggaactgatataattaggatactgataaaaattagaatgagaaggggagggcctaaatgaagggtcatggggtgtactttttaaaaaaaacaaacaaacaaacaaaaaaaacaaaccttcctgcccttctctgcatatgaatatactacatgcttatccaagaaaactttgaaaagtaaataaaaatttcttccaataatttcacccagaaatttaacttctactatttttaaaggagtgtcttttgtatgccaaacttctcctatttttaaataatatatcatgaaaatcattttattttgtaaattggacctcaggtgtatgaaactgggttaattgtgacctatgattcatagtgcatgtattagtccattttcatgctgctgataaagtcatacctgagactgggaagaaaaagaggtttaattggacttacagttccacatggctgggaaggcctcagaatcatggggggaggcaaaaggcacttcttacatggtggcagcaaaagaaaatgaggaaaaagcaaaagtggaagcccctgataaacccatcagatctcatgagacttattaactatcacgagaatagcatgggaaagaccggctcccatgattcaaatacctccctgctaggtccctccctcagcatgtgggaattctagaagatacaattcaagttgagatttgggtggggacacagccaaactgtatcattctgcccctggcccctcccaaatctcatgtcctcacatttcaaaatgaatcatgccttcccaacagctccccaaagtcttaactcatttcagcattaacccaaaggccacagatcaaagtctcatctgagacaaggcaagtcccttctgcctataagcctgtaaaatcaaaagcaagctagttacttcctagatacaatgggggtacaggtatctatgaaatgggagaaattggccaaaacaaaggggttacagggcccatgcaagcctgaaatccagttgggcagtcaaattctaaagctccaaaatgatcttctttgactccaggtctcacatccaggttatgctgatgcaagaggtgggttcccatggttttgggcagctccgccctgtgattttgcaaggtacagcctccctccaggctactttcacaggcttccattgagtatctgcagcttttccaggtgcatggtgccagctgtcagtggatctaccattctggggtctggaggacggtgaccctcttctcagagctccactaggcagtgctccagtaaagactctgtgtgggggatccagtcccacatttcccttctgcactgccctagcagaggttctccatgagcgccctgccactgcagcaaacttttgcctgaggatgcaggcatttccatacatcttaaagatctaggtggaggttcccaaacctcaattcttgacttctgtgcacccacaggctaaacaccacatggaaactgccaaggtttgggacttccaccctctgaagtcacagcccgagctgtatcttggcccctttcagccatggctggagtggctaggacacagtgcaccaagtccttaggctgcacacagcacagggaccctgggcccagcccaagaaaccactttttcctcctgggcctccaggcctgtgatggcaagaggggctgccatgaaggtgtctgacatggcctggagacattttccccaaggtcttggggattaacattaggcttcttgccgcttatgcaaatttctgcaggtggcttgaatttctccccagaaaatggatttttcttttctattgcacagtcaggctgcaaattttccaaacttttatgctgtgcttcgtttataaagctgaatgcctttaacagcaccaaagtcacctgctgaatgctttgctgcttaaaaatttcttctgccagataccctaaatcatctttgtcaggttcaaagttccacaaatctctaaggcggggcaaaatgccaccagtttctttgctaaaacacaacaagaatcacatttactccagttcccaaaaagttcctcatctctacctgagaccacctcagtctggaccttattgtccatatcactatcagcattttgggcaaagccattcaacaagctctaggaagttccaaactttcccacacattcctgtcttcttctgagccctccaaactattccaacctctgcctgttacccagttctaaagttgctcccacattttggggtgccttttcagcaatgccccactctactggtaccaatttactgtattagtccattttcacactgctgataaagacatacctgagactgggaagaaaaaaaggtttaattggacttacaattccacatggcttgggaggcctcagaatcaaggcaaaatgcacttcttacatggcagcggcaagagaaaatgaggaagatacaaaagcagaagctcctgagaaacctgtcagatcttgtgagacttactatcatgagaatagcatgggaaagaccagcccccatgattcaattacctccccctggggtccctcccacaacaagtgggaattctgggagagagaattcaagttgagatttgggtggggacacagccaaaccatatcagtgcactctcttcatttgaccatgcaatgcatgtttttaataataaacatctccatccaatatgaaaactcatactgtaactgtgatttataaaacctttggcccaatctttttcctacaactacacttctctttatctaccttttatttttactttttgcttacttgagcacatgctatacatgcccctttttatgcctctcaggaggtttacagtggtggaatttcatcactcagatagctttccactccacgccctttggatcccaaaatggactgcccatttatctctttctgtgtgaaggaagtcagggttaggagagtcatctgtatatgcctcctcgtttatctctgattctttagcaaaaccaccctgaaacccaggcagatgtcaagtcagcttgtccttgagggtctctgctaaaggagaggccccagtggccactgcagcctccataaatcgctgtggtcaagcatgcatcttgccatcagaccaaccaccacctgatatgtgaaattcacatttgttaattatttgctagaaatctaagaagctgttatttattgtcatgtagttgaaagcctctttccgcctcctccagaattcacttttctttctatctttcctctgatcattgtttttatcctttgactgttcttttgtagttcttttctttattcctgaatttatttaagttgcagatgaggattttggctatgtccacaccccagacttcaccaggaaggtaacttagggttccccaaaatccaaccaaactgttctcaaatgcaggaggagaactctccccttcccctctacccctgccccctcatttcttctcttacaggctttcctagctcttttccaccccatgccccttctgtctctccttccatcctggggtttgtggtagaggattacccagttgcggacgagtcacatgccttatccagtgaaaatattattgtcttatggatgccaagaacaactcctgaatgtacaaactatttttaatgctcatttgagattgatagatatcaggcaaataataaaagtttcacaagattgctacaaataaataattttgaaaacaaaaccaaccaaagcaaaaaacaaacaaacaaaaacaaccttttctgttgtgattagcatttttgctaaactcaccttgggcttttgactttccagacactctcattgcaggtgtttggagctcagttctgttcctccaggcttgtgcgctctccttgaccccaccttttgtgcgtgtgctgtccttgtctgaaaccagcctggagctccctatacagatgtgtcaaggtcaggccaggtcaaggctgagcacagagaaaggagctgctgtaggaggcccacaaggaattttgttggatctgtgagatcagtgtatgctccagcccctctgacatatccagaggagacagccttgagtttgggcccagtactgccacttattagctgtgtaaacttgaaaaagtcaattaattttgcataagtctagtgcaataagtaagagtcttcaagtcatcaccctgttgtgatggattacatgagatcaagcatgtaatgtgtcaccatgataactggcaaaaataagtgcttagtaaatgctgaccattcttcttcttaacaacatcatcatcatcatcatcatcatcatcatcatcaacaacaacaacactaggtgcaagcgccagccccggccaaggccaataggccctgtgtaggttgcgggctacctactcagtctggatgctggtttcctgttctcctgctcctgtctttgctcttgacctgttttcttcttgcctctgcaatggactctgctgctggttgtgccatctcctcaaggttggacccttggaagctgacgtatagctggtaccttccagctacctcttcaacacccctgcatagcttgaactcaggtgacctgctctgctccaggctccgagtcccccaggtgcattttcctgtccttgttcccaccatgggctcagacagtgagtgccttgaaggcaggaatagggggtcctcaacccattccctggcccctgacaagcagctggctgcaggatgtcctccactacttgttagtcaaatgcatgaaacattggatgaaggcaagaaggtgagatagccaggtgtggtggctcactcgtgtaatctcaacactttgtgaggctgaggcaggtggattgcttgagcccaggagtttgagaccagcctcggcaatgtggcaaaaccctgtctctacaaaaaaaatttaaaaattagccaggcatagtggtgtatgcctatagtcccagctacttgggaggctgaggttgggggattgcttgagcctgggaagcagaggttacggtgagctgagatctcaccactgctcttcagcctgggcgacaaaaaagagaatgtctcaataaataaataaataaataaataaattagttaattaattaataaaggagagataggaaccttctcctttgttgaatccaagtttagtaggatgttcctttcttttctctctctttctttttctctctttctctctctctctttctttcctttctttctttctttctccttccttccttccttccttccttccttccttccttccttccttccttttttctttctttcttgacaagatctcaccctatcatccaggctggagtacagtggtacaatcatagctcactgcagccttcagctcttgagcttaaactatcctcccacctcagctttccaagtacctgggactctaggagcaagtcaccatgcctggtggatgttcttttctattgaaagtctagagtaattcatggccaatacttaattttagcagctttgttccttttgaatgagccctcaagccaaaaacatatccatcttttaacagtttcatttatttcctttgaaatcacttcaactggattcaatgcaatgcatttgaacagatgtttacacagtgtgttgggcattgttatgggcacatgactgagaagagaatggtcaagtttcctgccctggacagaactaaaattttaccaggaagagagatgctgagcacctaactaataaatacacagggtaatttcatttttataagagtttccaaagcaattaccatcaccaccaaagaatcagggtagattactgggtctcgacaagtgtgtgtgtgtgtgcgcacacgtgcgtgcgcatgcatgtgtgtgtcttggggaagagataaggcctgaataaggagggacagctgtcctgtggagatctggagaagattattgtagtagaggaatggcaagttcaaaggcctggaagtggtagcagagtcattgtgtttcaggggcagaaaggaggccagcgtgcctgggtgccaagggaaggaggtgagggtgaggaggcggacaggcatctcaagtgcatggagagccacctcttcttgggtccccagtccagggcactttctttggacccaggatgtaggtactgacagctgccatgaatctcggagttgtcagcattcacagcaaagggcatttccaggctaaaatctaagtaaacaagctccagaacaaagaagacaccatgttcaaagtgtgtgaaaatggataacaaataggaaacatttaaaaacaagcactttgtggaaaaccatgtttccttgatgtgctttctgtcatggtatctgaaacactgcaaaaggacattgaagatctgggagggagagttgacaatcttcccaaataagatacagttatcttatttcaaataaaaaggaagcaaaattggcacaagtttgggtcaaatttctcctgtgccaagtctagaatcagcaggtagtgctgaaatcactgtcccacatcccagacatagtgagcattcttttaaggctccaggctcaagtgtgtgcaaacagagggaaattacacttgaaaaaaaagatcaaggaccgtgaattagatacaaccttggacaacaaaagcagcaaccatgaaaggttgtatgtacttaagaagtcaaacacttctgggaaagctgtggggaagagagttggtatatgggaaaaaagtggtaaactcaaaacgccttttgtatggagaaaggcattggccagctttaaaggcactgcagcatcagttgagcaagtgcttttaataaattactctcttttgtagctctgtactttttctgatatggataagctatctagcatccaaagcaaactcatcttaaaccaagaattcaaacaaatgataataaagatggtagaatgcctattccactccatttgaaagagatgcacaaaagaaaatggtaggtgttgcttgcaggagtgtgataatagtgttgctcttctaaactggcaactttatgagtagatcatcaaagccaaggtattttactttgtggaataagaaacgatcacaccgaaaataataaaattcagcactgcaggttttctgccctttataaatgtttttcaaagacggaaccgaaagaatagcttgagtgataacaagcttttcagaaggagctctggaaattaatatgggacaggtgatggagcaagactttcagcatgaagaagcccaggaactgggaaaacacaagtctttacttcagaatcaccccatagcctccaagtagtgtgttgcaggttgaatctagctgaaaatggcataaaacagaatattaatagctatatccacatatcactaaactaggtacattcttgatgttcctgaatataaggagattataaattaaaatgattctgaaaaactacagacattgatgcaagtttctagtttcaaccaggataatatcacatctcacctcaaacaaaaggcattttcttcagaaaggaactaaaaaaaaatggcctttattctatacttgcttatggttctggtttaaaaacaaaaacaggttccagaagactacttattcaaagaccctgccccacattcctcttgaggatcccagtgaatgtggcactgataatatgaatggtttaccttccgtgagattgcattgaggggggaaatattcttagaaataaaatttttaaaaagaaaatatgatgtaaattgaccaaggggtttaaaaaatctgtcaatctcatatcctatacctagcaaaaatatccttcagaaatgaatggaaaattaagacattctcagatagaagaaaaataagaaatttgtcaccagcattaaagaatgactaaagggatgtctctaaacagaaagtgaataataacaaagggaggctggaacttcaggaaggaaacaaaacaatgcaatggttaaaaattctcctcaagtgtttaaaaaattgtgttgaagcaaaaaaatataacatcatctggtgagatgttcagtgtctgtagtggaaatatttatttaacatatttgtattttaagggggagggtaaacagacctaaataaaagtcagatttctatacttcacttgaagaggtaaaatgctgatacagttagctatgacatattatgtatatatattgtaatatctagggaaattagtaaaaaactatatgatgaagagatatattaaaaatgtactatagatatgaatatatgtgtgggttagtatacatacatagttttccttactctgtcacctgagagaacaaagaagcaatgacaaccctctagcaattagcacaccggacacacagatcttggtttctaacaccattcaccaataaaacaaatcagggctccttggagaaatggctgattccaggccttgggggaaaaatatatgagatgaacctggagcattttgtagcaccagaatgtaaggaaatgtgtgtgtgtgtgtgtgtgtgtgtgtgtgtgtgtgtgtgaagagacacaggagccaaccaaaagagctctcaatggccaaacttggaataattggagcaagaaaataataaagtagtaatgtattatcacccaaaataaatatccatgagtccatagtgatataagtaaatacttgaataaataaatggggggaaaaaagacaactctctcttatgaagaactggaaatagttaatacagatactacaacctgaaggaggagaagtgtaagttcctggtccttaggtatgggcctacatagtgattttcttccaaagagtgtagaatagatagggggtgggggaaagtagatttacactggagacacctgccaagcactacttcagccaggtgatcatggtcaacacctgctgtgataaatcgtggtgtgagtatgtaccctggatatgatgtgatgaaaatgacacttcactgctttacccattacccttgtcgaatcatgaaaaaagcctcaggtgaatttcaataagggggtatcatagaatacattgaatataggataatacctaaccaggactcttcaaaattgtcaaggtcctaaaaatcaggaaaagtttgagaaactgtcacaaccaagaggagcctgaggagatgtgatgactaaacacagtaagtatcctggatgggaccctggaccataggaagatgttaggtaaaactaaggaaatctaaataagatatagactttggttaataataatgtatcaatattggctcattaattgaaacagtcgtgctaattaatataagatgttaataagatgggacactgagtgaggatgtatatgggaactttctgttctaccatctcattttttttaaacttataaaaaataaagtctattaaaacattatagcactttgggaggctgaggtgggtggatcatctgaggtcaagagtttgagatcagcctagccaacatggcgaaatgctgtctctactaaaaaaacaaaaattagctgggcatggtggcaagtgcctataatcacagctactcgggaggctgaggcaggagaatcacttgaatttggcgggatggaggttgcagtgaggtgagatcatgccacttcactccggcatgggggaaagagcgaaactccgttaaaaaaaaatcatgagtttaaacataaaacataaaaatatataatgtttagaaagaattcacaggagaaaatctttgggacctaaggctagacagaattcttagacatggcaccagcagcactatccataaagagagaagaaaaagtcaatatactatacttcgttgtaattaaaaacttttgtggtgtaaaagactcggtgaagaggatgaaaagacaaactgcagactgggagaaattattttcaaatccatatcttttttttgtttttttgagatggagtcttgctctgttgccaggctggagtgcattggcgcgatctcagctcactgcaacctccagctcccgggttcaagcgattctcctgccttagcctccagagtagctgggactccaggcccagctaatttttgtatttttagtagagacagggttttaccatgttggccaggatggtctcgatctcttgacctcgtgatccacctgcctcggcctcccaaagtactgggattccaggcgtaagccaccgtgcccggcctcaaatccatgtcttacaaagaccttatatctacaatacacaaaaatgtatcaaattcaacagtaaaaagacaagaagaaaaatgaagaatcccatcagaaaatgaggggaaaatatgcccatgaatttcaccaaaaagactatacagatggtaaagaagtgcaggaaaggatgttcgatatcactagcctttagggaaatgcacattaaaaccaccgtgagatattactacacacctatcagagttgctaaaattgaaaacaaattataacacaaaatgctggcaagtatgtggagaaactggatcacacctacattgctgggtagaacaaaaaatattatagtcattcagataacagtttggcagtttctttaaaaactaaatatgaaattgctgtttgacctggaaattgcattcctgtgcatttattgcggagaaatgaaaatgtatgttcacacaaaaacctgtacaagaatgtttatagcagctctattcataatagctaaaaactgaaaagatgcaagatgtcctttagtgggttaaaccatccacatcatggaatactactcagcaataaaaaggaaccaactattgatacacacaaaaccctggttaatcttgagaattacattaagtgaaaaaaagccagtcctcaaaagttacatactatgttactctatttatacaacattttaaaaaggacaaagttacaggaatgaagaacagattagtggttggtgggacagcagtgaagtggggtggttgcaaaagggccacatgagggatgcttgtggggatggaattgtttcatagcttgactttctttttgtttgtttgtttgttttttttagacggacggagtcttgctctgtcacccaggctggagtgcagtagtgcaatctcagctcactgcaacctccacctcccaggttcaagtgattctcctgccttaggcctcccgagtagctgggattacaggtgccactaccacgcctggctaatttgttgtatttttagtagagacggagttttaccatgttggccaggctggtctcaaactcctgacctccgttgatccacctgcctcagcctcccaaagtgcaaggattacaggcctgagccactgcacctggccaatagcttgtctttcaataatagtgttcttgctgtgatatcatactacagttttgtaagatattaccagtaggggaaatttggttaagagcatgtgatgtttctattatttcttacaactgcttatgaatctacagttacctcaaattaagtgtaatttaaaaaatactggaaaacaacaacccccttaccccatgcagatattttcatctattttggttgtatttatttggtattgacttccacaatgtatatagtatgttttgattgctaatctatgatttattaattgaagacgattttagatagatctgtatctttatggtagagtttatttattgtagctgcattttaatttaaaacttaattactgttgctttgtttccttctggtttctgcatgatttccactgcgtctcttgtgttctgtttgtttgttttggagtttctcacattgagagatttttctcattgttgggtaaccatgactctatcttcctgtttaagaattaggggctgggcaccatcgctcaggcctgtaatcccagcactttgggaggctgaggcaggcagatcatctgaggtcaggagtttgcgccagcctggagggttggagaaactggctgttgcattagtccgttctcacactgctataaagaattaactgagactgggtaatttatgcagaaaagaggtttaattgactcagagttctggaggctgtacaggaagcatggctggtaggcctcaggaagcttacactcatggcagaagggcaaagggaaagcaagcacatcttcacgtggtggcaggagacagtgaaagaagaagcactacacacttttaaacaaccagatctcgtgaggactcactcactatcatgagaacagcaagggagaattctgcccccatgatccagtcacctcccaccaggtccctccctcagtgttggggattgcaattcaacatgagatttgggtggggacacacagccaaaccatagcagctgttacctcatgctcctaattttgtggaagatcagataacaacttagtttcagtttggtggaattgtagcatagataactctgttttgatttttagtctggttgttggggcgtagtgagggggcttagtgggggccctgtgtgttttatctggtgaccctccagtttctcagcgccatgcatttgcttgtcctggcctctgcagtcacctttgctggctgtggcattgtgagggtgtgaaggctgcagattcttagagggggcctattccaggctctcctgtgttcatgactgtcacatcccatcttgggcgaggccaggctagagtccacaggctccactcaggctctctttcccagaccccgacacctctgtcagcctcgttgtaggtcctcttttgattgctattgccttggacctggacagtttataaaccaagcttgccaagaggcaagagtgaagaggtctgttaaatagggaaagagcttggagtctcctgggccatgtgctcagtacacaagttcttacaggtgggtagtcctgtttgggatagttcagacacaccagagtagggagtgagggtcccatgctggccacctttcttcttcacctccctcttctcatgcctccctgccaccacccaacattttcagccttgagaaattccaagtaagccccttgctcagggctgggaatccagttggcagttcgggaggcggtggggtcagagttaccgcttctttccgggcctttccagaggttctgctgctcccccaatacgccttccattgtgctccagtgcgtccctccagcacattcccacagttagattcttctggggactgttgtaggcacatccctgaaattcccgagggatctccccctggctagtgtacttccttttctcaaggtatgtgggaacaggagctgtctgccgggattagcagcccacatgatttcccagtctcaggacctgtttcctgttgggagcccctgagctctgagacatgtggttgccaagtgcttgcagcgctgggtgtggtggagccccaggctgactctcctaggtggcagactcttgggggcgagctctccccagggcggggacaggctgggggtggcgggctcttgggggtgggcaggatctccttgggtgaggggtgtctctgggggtttggctctggggaaggggttctgaggagggggcagattctcctggggaggtgggctctgggggtggggagcaggttttcctgggtgggcctctcctgggaccaactctccctggccgcagtctctcttggccacgattctttcctccacagcaacatccatgtgcagaggtgctagagctgccagtactagcttaccagcgctggctacaagatcttcaggaactttttggcctggttgttaaccagagcaactattaaaaattatagaacctcaggtaagcaaattaaatcgcaaacaaaagtaatggatacacaaaacttatactaccttttttatgacattttaccatttcctgtgcccttgaggctctttacgttatggtacctgtgtggtggaaatactgtactgggcgacggggcagctgtgcttctctccccagttcctgcttgtgtgggagtatttcaccatggaaatcagcaaatcatgcttagttatttggacagctggttattaaacatttaccagcacacaccattacctgagttctatcagcttattaaattaaaaaataaatggagccctttaatcacattgttcttattttattttattttttattattttttagaggtaggctcttgctgtgttgccccggctggaatgcagtggtacaatcatagctcaccatagcctggaactactgggctcaagtgatcctcttgtcttagccttctaagtagaaaggaccactggtgcttgcaccatgtctgactaactttttttaaaaaatgcttttttgtagagatgggtccttgctttattgcctaggctggtcttgaactcctggcaagagatgcaagtgacccttgcgtctcagcctcccaaagtgctgggatataagcatgagtcatcgtgcctggcctaatcacattgttcaagcattgtgcaaatcaatggaagcctagctcacaacacttctggtttaaatgcaggcacacttcccctctgcctggccctgactcctgctgccctctcctactcagttctctggcagctcatccccctcacccactctactccattccctgcctgctttccagtctctcgacctggacaggttttctgtccctttccccattgtttctttgaagtatttattatgtaccttcctttatcctctcagctaaagggtttcccttttcttgccaaggtttgtgatccatctctctcttctcattctcctgattctgaatttatcataacatttcctgggcacaatttaaatatgcttatttgaccttcccaggctgtgctaacagcaccaccaccactgctgctgccgaaaagagttagtgatatttatctacacctgtacctgtgccacctgtgtcccatgccagagaccccggagcactccatgggcaggtcccatttaatgctgatacctccatgagaaatgagtgtttggttgaatttaagtactgtaagggaactttttagactgccctaggtggtatgtgaaacctgagggctttgtggttgtgccaaggggcttctgagtagagaagaagaagggataccagagaagatgagactcacccacagcccttctaaccccagacctagcagagcatttcactgtccagaaataggagttgaaactgtggccttcagagcaatgttttaacctggctttagtattcttactagctgagtgaccttgggcactctgtgcctcaatttcctcatctgaaaaatggggataatactattaccttataaggttttttgtgaggtttaaatgagttaatgcacataaagctcttcaaaaagtgttcaactaataaatattagccattgtcattactgaggctatgtgcaaaattgtacttaataaaataatgcttctggtaagaggttgaagaccacatatgtagctctatggcctttattttatagttgagaaaactgaagctcagagctaagaactggacacagccagtgagcagcagagtcaggactaaatccctttctgctctgaatttttcaacaaatggtattaatcctcttctttgacctggaaggggcatgacacctacaacatttgatacccatggcatttgacacccacaccactcaacacccttgtgcctttattttgattaaaggtgtgcctttaaagtgatgagaatagtgtccaaataaatatgacagaacccttctatccattttctctgggaagaaatgaatattaatatctctggtaagatttgaatattaaacaaagagaaagaactagcccctttagtggatatagcatgatctggggaacaaagagacagcccagatgggagcatgttattggagagggataaggagcgtgcaaggtaaggtgtcggtgaacaaaagttctctgtaaaagaattggaagggaagagactttattccactaagcagtttgcaaaatggggagatgtgacctgtggtctaaaatgaaggttccttccagggagcaaaaggaggtttcagttttgacagcaaaagttcctgtccgggttcccactcaagtccatttatgcaaatgaaggattcaaacttgcttagttctaattacttgatgaagctaagttctgattggttggttcaggtgagttctgaaagtcccaaagttgaacagaggtatgggttttctgttgacacagagtacatctgtgatgtctagtcaataaatgaccactaggctcaatgttaaatttaggcccagttagccactagggatccatcttgaaggactggctctttcggtttcatattcattcccatgaccgaggcaggacccatcctgcagcttttgcccagcgggtaggagaccaggcttgggaggccattaagtcaacttcagacactgttttactgcccagggtggaggaagatctctaaactaaatgcctacagcatccacagctgaatctggctggcatgtaaagaaccagcagtaagcgatgtgcctggtgtgctggggtacacgaacggaggcgagccgggccctgtagtgatagtcagtttcactgggactaccctactccagacaggaagtcctcattgctgacagcacttaggagcagtgcctctccaccagaagtgtattctcagcaggggtggatctgagagcagaatacctagtggagaagaggggtttccacttgtggggtagagctctttcaagcacccgggccacattcagagaagttcccctgcactgggctaaatgagtcaggtggcctcacttctctcagacacatctggcaacctgggcagcttttggggtgacactgcaggaccacaggagggactccttctctctggcattctgagaggtgaagggcttcacattccagtgatggaaatcttggcaacactagagaaaggagtgcagctcctacctaaccagtgagagaatattatacatgattttgtataatctgatttgaaacttgaaataatgcaacattttcttagttgaaaaacaacaaaaaatacataatttcaaagctgttcttgggggcgaggtgcggagcgtgaactgtctcccacttcagggggtaagcaggtagacaggaatgtcaccatccattgtctcgtgggtgtgaatcactgcttctagactcctgtgcttttgataattattgcaaagtcatttcaacttttgctgtgttatgatctttaaaacaaatagtgtattctactgcaggataggttaattgtcattaagaggtgattccagtggtattgttaaaaaaagtacacccacaatcagtaaatttagaaagaaagttaggtgagataaaatatcatgaagatttaaaaacaccaggaaataaataccagtctgctaattttatgacaagcatcccaagaaatattggagatgatgctgagaaaataaaaatagcattaaagatcctcaaacagcccctgttcctctgactttgcagcatttggaggggaaagcactcttacattatgagggcctctggagccccacctaaatccttaagtgaaaactcccagggagcatcattttctgacagttgcagctggattagcaccacgtgggccagtagcctcagagaagggagtgtgcaatatcagcttcctccagagagatgccgatgggtccattctgggcccccgtttccatacctgtagcctcttaggggacacagaatgactgggaggtgctgcctattcacctgtggaatgtgggcacttctggggtctgactttctcctatatagctctgtagcttttgaatacctataataattatgtacttgtattaatttttaaaaatctattaaaaagaaaaaaaataaaggaagaggggctgagctctgctgtggaaatcagatctatttagaaagcaagaaggtctgtggacaatccaatacaaggtggcccagcctccataccacctccagctgtccccaggctgctttgcagtaacaacctatgggcaaatggcagcgtgcgcctccgtctttctgccctatatgcctgaagtcacagcggtccttcaggagtgttatgactcattcccatggggaggtgggggcgtgctaggtgtcttagtccattgtgtttgctctcataaaataccatagactggggggctttaacaataggcatttatttcttacagttctggaggctggaagtccaagatcaaggtgcagcagatctggtgtctggtgagggctccctttctggtttgcagatggccgccttctctctgtttccacacatggtggagacagggagagctctgatcccttccttttcttataagggcactaatccatcatgagaaccccacccccatgacctcatttaaacctaatgatctccaaaggtaattacatagggggttagagcttcaacatgcaaatttggcagggacagggggtggggaacatgaacatccagtccattaccatagagatattcaaatgggggtaaatgcttctgtggaaaatccccccgtgggaggctgctctgggctgtgtgtccaccccaacttggtgctcccacgagactgtgggaaagggtggcagtcctctatccccagtatggccttcagcatgtgcagtccctggcctggctacctgcagaagcccacaggaaaggggcagccaggggttgaaggagaaaagaggagagaggggtggggatgagacactccattctgaggagaggtccccaggaagaggctacgcagattctttggaactggaattgcctgagaaggcttaggacagcgctgctcattagaccactgcctgggaaatggccatcagctgagaatgtgggaccttagtgtccctgtgtctgggggagtccaagagagagagatggatactgaagattttgcaaagtggcatggctgggtgagtgggccctccaccaggagacactgactacaggtgcttgctgggcataaccgaaggagggcccggcagaatccagaccctccccattgccgtgagaggctcagggggctagcttatgaggaagagaactaaaaactaggggacacattctgaggatacaaaatgcacaatgagccctcatttagatgaggggtagggtcttaaccaaactccagcattacaccccagcctttccttgtggttctatgttgtcatgcaccatgtgcttagctacagctctcctgggtgctgccttccagagatgggaccacctcagtgacagtgaagagattaagtgtgcaagctggggacagcgggcaagtgattaacatttcctgactctgactcgtcctttggagggtgatgctacatacagcccatcatacgcactatcatggcccaatctctctgaaagtgaaatcacttctccccactgagctgcatctggaattttagcagcttggagcaatgcaaaataatggtgcttaaactcagaccagcctcctcaattttgagctgggcaatccattacacatacattttaggcagaatgggatcctggtaaatttgctgtctgtgtatgtggcccacaaatttccattcattgaacagttgtcatttttaagagctgcagggcaaaaaggttatttgttgactttttgttttttgcaaatgatattaccttgcaaaagagcttaccctgaaactgaaaagaatgattctgtgttaccatatgcttttataggcttagctcttgtctgtgggaagtttgcaagcattccctcctctgctccccattcatttataaagaaacctcccacatggtgctattaaaataaaaacttactcatatgcttagtcaatgccgagcagaatttctttcataggttccgtatgaatgagttctgaagtaacaggtttagaaaatgaaactgctcaaaaagaatatgaaaatgacttgaaaaggtgccagaaaatactttgactgtgtgtgcatgtgtgtgcacgggggtgggggaaatatcagatcatgggaaggttccaagaccttcaggttataatggcatgtgaacaacctcaggagttggtgtgggaataaacgattcaggcttaaaatgagaaactcctgttatggacaccacgggatgttctagtcaacagatctaaacacgtggccccatgactacctgtttatgtgggtgtaatcaatgcccagctctgctattcaccagctgtgtggcctggggcaagttgctccaccaacctgatcctcagttcccttgcctgtaacatgctgataataacagcatttattccataggacataggatccccacaaccccaattccttggagctcaaaaattagatgaatcttgatccttgttcacagtactttccaccacggatccatccatgactttgtcatttatttagttatgtaactagttatttccaatattgtaatgagcacccatgaatctaccaccaaacaaaagctaagtctaggacaataacctacatcttatcagctagtccccagtatcttattaacctcttctccccacttctaaggtctacaccatcatgaatcttgtgttcctgatacccctgcttcccattttatttggttttatgcttccatatgtatttctagaaagtaggtatatttttatcttaattgttttttaactttataaaacttttagggacttacttttttccatttaatgttatattgctaagagtcattcacagtattgtgtgtcattgtaatttctttgttctgactgctgcatagtagtgtatacaaataaaccatagtgtaatcatccatactcccattgaggggtacttgggaaaggagagggtccagacttttgctagttagaacagggctgttatagtcctactggtacatgtcagcctttgtacaagtataagagtttctcttgggtatggaccttcaaggagaatcatgtcagagaacatgtgaaagttcaactttaggagacaatgccaaaacattctctaaagactctgtgctaatctacaatgccacaggcttcatcctctccagcacttaattgtgttaggctttttactttttgctaattgaatgagtataacatgttatttcattgtgattttaattttcactttttttctttaacaaatttttttatttttagtttttgtgggtacataataggtacatatatttatggggtacatgagatgttttgatataggcacacaatgcataataatcacatcatgggaaatggggtatccatcccctcaagcatttatgttttgtgttataaacaatccaattatactcttttaggtatttttaaatgtacagttaaattattttgactatagtcacccttttgtgctatcatatactaggtattcataatttttttcacttttctttttgaatcttttcataagtttattgggcatatatgtttcctcttctgtgaaatgccattggtgctttttttccccattattatactggttatttgtgctttgttaacaaaattgatttgtagcagttctacatatattcttggtactaaacctttgtggttgatattatgaatatcttgtcccagtttttactttgtctttttactttttaaaggtatctcttggtgaacaaatgttctttattttgacatagttaaatttatcattttatagtcaacaatttaagtgcttaagaaaaactttagctgcgtgtattagtccattcttgcattgctataaagaactccctgagaatgggtaatttataaagaaaagaggttaaatgactcacagttctgcaggctgtacaggaaacatggttgggaaggcctcaggaaacacaattatggtggaaggtgaaggggaagcaggaatatctgcatatggccagtaggacagagagagaaggggatggtactacacactttaaatacagaactagggggatggtgccaaaccactagaaaccacctctatgatccaagcacctcccaccaggcctcacctccaacatttggaattacaattcaaaatgagatttgggtggggacacagagccaaaccatatcactactccaaggtataaaatagttacctgtattttactataaattataaagtttcttttttgacatttaattcctgaatctatctagggttatttttcggatatagtttgagagagatattcaagttcattttttcccatatgaataactacttttttccacctccatttgtttatcagcctcctctcctcactgacctcctgtatcctctgtaataaaccaacattctttatttgcatccatctttttctgggatcttattcataccccatggtctgtttttctgtctctgcaccaaaactacagggttttaattgctccagcctcataaaagtccagacatcaataagggaaacccctgatcactaccttttcagaaacatcctatttttggtcttttatgctttcacataagtttagaatcattttttcaggttctatttttaaaaaaattattaggaatttgacaagaattgcactgaatatatagatcaaattacactattaaattatataatccatgaacacaatatctctctccaattacttagccctttttaatatctcttaaagttttacacttttccttctagaggtcttgaaaatgtgtccattgttaggtttattctaggagacttgatattttaatttttttttttttttttgaggaagggtcttattttgtcatccgggctggagtgcagtggtacgatcatagctcaccacagcttcgaactcctaggtccaagtgatcctcctacctcaccctcctgagtagctgggactataggcacatgccactgtgccccactagatacctgatgttttctgatgctgttgtaaagaatattgtcttttagcctgggcacagtggctcatgcctgtaatcccagcaccttgggaggctgaggtgggcggatcacttgagatcaggagttctagaccagcctggccaacatggtgaaaccccgtccctactaaaaaaaaaaaaaaaatacaaaaattagccatgtgtggtggtttacacctgtaatcctagctactcagggggctgaggcacgagaattgcttgaacccggaaggcagaggaggttgcagtgagctgagatagcgccactgcactccagcctgggtgacagagtgagactctatctcagaattaaaaaaaaaaaatattgtcttttaattaaactttctagctgtttgatgtatgtaaattttatatcttcactaaatttaattgttcttaatcatttgtttatggattttgggcattttctatataagcagtcataccttatgtgggtgataatggtttctttccctcataagatgattttaaaagtgaatggggttatataaacaaagcaaacaacacagtggttggcagctagtcagtgctcagtaaatgcttgtgactactgatattatcgtcattactcattaacagaagaattttagaaatttctttaacaaattccttcatgttgaagaaagaaacagaggcccagaacaagtccatgatttgcctgggatgacatgacaactcaatgccaggactgcacctggaaaacctgggtctttgggctacaaagtcaagtgccctttcttttaatccccaacaaatgcaggcttctgtctggcataaacttttgcaattgtagtgtttacatgaatggggctttctggcacatccatgaaaaaaaatctattaaatcagcagcatgaattaagctctttctgtgtgctgggcttcccacattgcacacgcttctagcagaggaagaatttacaccctgcaactcagaggggcagaaaatgataatttatttccttttaaatattctctatatggatctcatcatttcctgttgatggcagaggaaggagggagaaccttaaacttgcccattgaaagcaacttagactcttttggtctaactcactttcttttgggtaaatacacagttaaataaaaattaagatttccttctcaaaggatgtctcttcactctctatgtcccaggttggcagctggaagagggaaacaattatggattctcacagtgtggagtggtgcctctgaactcatcctgcctttgagacatagcaggtgctgattgagctgggcctggcctgatcatgtctttgagcatccaattctggggccactaggtctagctgtctctgctggtgctttgggacctccactgctcagatcttcctggccccaaagatctctaaatctcagctttgtctgtcatctgtctctaggctctgcaaaggtgacctctcagcagtctggctcgcagctacaccctctgggggcacgtagaacactgagacccctttctggccacagtgtagcagaggaagaggcaggctgtggggcacatgtgaggtattctcagatactagctcagccttaacttctctcatcttctcttctctctgcatccctccctccccaacttgcctcttggccagaagagtgtctccttcctgttgggtggggtttccctaacttgatgtcctctgtcttctctttattcaggcttatagcaagctccacagtcacactggcaaggcctagctctttgaagatgaagggaactttcagaatctagaataatgtgtgtcctctttcaacaaaacttgacattggaaacctgtttctccatggcctctaaaaatgtcagttttggcatgcaaatattttctaaatattatcccaattacccatggttatggctgcctttgggattatgatgaagactgtagttgtgtagaacatgtcatgctcctgactcccctctcgggatatggaggccactgtctttgtgagtggatggagctccttcctctgtccatctcttaactaatgaaagccaggtctgtctgttctcagcagtctttctctgcctagccactgtacaggacactgtcactaacacgtcctcaaggaatgacctctgacttctggcctgaagatctctgtggcctctattcaacctttattgagagcttattatggttacagctctgtgctcgtgagaacccagagagagcgagacagaattgtcttcaagctgctcaaagagtaaaatccatgcataaagacctggctgtatcacagctgtgcttatgatattagcaaaatccagtacaactaggaagaacatgtacagagaaggaaggaaaggcaaaactgttgggtctagttttcttggttcctacatgaaagaaggctgggcaatatttaccctcgataaagttcattatgccttgggtatagtaaaaatctgaagttttgcctctgtagaccactattctgccagggctgggtgccagagtgtattttacaatgctgacgcctgtccgagacagtgggttgtggtttctgttccactctccaatgcacttttgggaaggcaggtgactgggatggacctgctctagtcatcaaatgtggcaggcccactttccattgccaacaaaagttaagtaaattaaatagggccccaaaggagctctctaggagttggtgtatcatgaaatgtgaagtgggcttgcccctatgcaagaactaaaagaaacacaatttagttatctttggcttctgaggcatcggcagagttttctgctgccaatatgagatttcagtggagagtagggtttcccaaatcatgttgaaacgtgacattgttttccttaggcccacagggccttggcctgacactgagcatgtattcgtgtgtgcacacacgactgaccactttctgcacgcttcttacacatccgccatgtgtccgcctcagccagtggaagccctgtgccactcttgagatgcaggtggctgtttcttgctgctgtcactgttactgctgctgccgcttgcagcctaattcctcgctggtttcaaaatgtgtctcagagatttccccaaatccatttctccaaattctgagttgttcatccatggataacaacaggatggcatggatgtaggcactggtaaagaagcacagaagcatgtactgagggtgttaattctgaacatggagagactgcatgttctgaaacacatcttagcatttctgtgtccacatatgtgtattgcatttcaagcatttttattattattattattatttttgctgggtcgtgtcaatagaactgacagcatcctgtgaccatatcttcacctttagtgctttctaagtaaaactcagtgtcttaatatagccaaagggaagaaaatcctagtgagagaatgaactttttctgacattcctggttggtgaaatgcaatcctcttttcctggcatttggtgaggataattgaatttatgtctggtaactaaggggatgctcgggagcctcaggaaccatgagcaggaatgaggatggtcagaaagcacattgggttatgtggattcagtgacacaaaccccaagaaacctggtggcttttggcactgcatgtgattagagacaaatgatctattttcatcttctggaaaaatcaataaatacatatataaaagagtgccttcaagtcctttgagctattaagaatagctaacgttttgattgcttattgcatgtctattgctgttctaaaggctacatatgtattcactcatttcttcttataacgtccctgtgtggcccacggtcatgttattttcattcccattttacagataagaaaatggaggtcacgagctggagaactccttgctcaagttgcatagctaataagggacttagctgggattcctggccagcaatgtggctccaggcctggtttctaacttccccttcttggcaaccaccttcacagaggaatgcaagaggtgagtggatttgatgtgatattttatatcatgcctatttctatccactttctctggagtccactaagattaaagaaggagagaaattctctagttctacaggaagtgcgggctgtttccagtgggtccttgaagtcctttgtctgtttccagtttttccttcaggtcttttgagcccagcttccctctggccagctcaggctcagggagacgggcatacaccggtggcctgggtgacagtgtgcagctgatgagccacaggacttgggcaggccatagtgggtcaggagagactggacgcttcgtcttttatgcttctgggatttctgttgtggcttctgttttcaccgcatttcaaatcctttaagttaggtcatatggggaaaatgcttgtgcttctcatttatctccctggaggctagcctggatctctgatgaggaggagcaccaggccactccataaccaccgggctgcaggatctccagggccacccaggaagccaaaatcagaacagagctccttgctgtgggggctttgctcaccctagttctgggagccagccagctctatcttggggatataactttccagggacaagagatgcctgattttgtgcagacacctgtgtcatggagagtatttcttatgttccaagcagagaagttcaaatttaccagtcttcctgtcactccacccccaaaatctggcgaccccactcagctgtttttcagggcccaccctcatggcaccttctggggactccctctttgctactgaggttgagacctagcactaggttttgtgctagaagcgccttgggggcagaaacccccatatgccagctgcccaggtcaggactgcatgttttcctactcaccgccaccttgccttgtatagaagaggtgtggccacgtgcggaatccgcgggcacaggcagcgaggccaatgaatggtatcttgcctgcggtctgctcttgggaagggtcctctagtcccggtgtccagggacccacaggctacgtcacatagtctccatgtcttcttgtgggaaggtaccgtgtgagtctttttaaaaagtaatcttaaaagagaacatctttgactgggcgcagtggctcacgcctgtaataccagcactttgggaggccgaagcaggcagatcacacggtcaagagatcgagaccatcctggccaacacagtgaaaccccgtccctgtcgcttggaatccctggaagaaagcagaaccgagaagagaagcccgggtttaacgctgtggtttcttttttgcaagataaaaccatgtgatttagatatatgcaaacaaatcttgagttaaaggaaactgagtttcaaattagataattgtctctgagaaaggcattcatatatctcatatttcatttctaactttttatcatagaacatcttaaacatacaccaaaatagagaaaattataatgagctcccatctgtcacttgccttcaacaatgatcaacttatggccaattatgtttcagctacaacccaatctcgccccattctaatttttttaaagcatatcctaaacattgtatcattttatctgtaaatattttagtatatatctctaaatatatatgaactcttatttttaatagacataatcgtaatcatcatgattttaggaaatgattttaataaaaatcacacccaattcacgaagttaaaaaaccctcccaatattcacacccttctcattactcttggttttaaatgacttttcctgttgtttgaagcctgcgttgcagtctgactctgatccttccaaaaactgctcctagagaagctagaggtacactctgagattaagctacctcaacttcaagcctctggattctgggaggagttgagtccaccctctgatctagagtttccaggcatggctttgtgaatgcacctaccttcttcccagatttttgcccgtctgaccctcttacatgagaacatccccatacatggctgtggaaaatcctcaagtgcaatgaaggcaagactgaaaacagagccgctgccaaacagagcagcaagttgaagggcaagtgcctgtcaacacaatccccttgaaagactataaagagctgccaaaacatgagatgcatctgacatccagatagtattagctgactgcttcccaaatgggttagctgtctacagaaacgccctaggtagctgatatgaatcgcaaatgtgctgtgacttgattaatttgtaacagtcagaaattaggtagttcagtgctagtcatgctcaagcttagtagtagctggtttagttgttttttgttttttgtttttttctgtgggtaattggatctaggatgatagtgtaccatcccccagcagtcatagaagacatggtaaaaactagctttacacgggtcctggacttgaggtcacgggtgtggaaggtgattcactagggagttggctcttagcttagtgggtcatgtatttctgagaagcttctttcctgaggtttacagtcagtttcagaggtgaatgaactgcttcagatgatcagaaagatacactctgtcattattcccccaagaataatctttgcttctgtagttacattaaagctaaattttgctgccagagtaggagccatccattatattataatcgatgacatgaatgttttgctcaagttcagatgtctaataagagtcattttctttccgagggagtgttatcagtttcatgaatatgcgctctgtatttcattagcattcttctagcaaaacatgattctgagtcatttctgaaatatctgctctcgcctgcaacttgtttctcagtttttacaaaaattgccttttctacttactggcagaaaagtttgataccacacgagcctaaaatgggtatgctgagaaaaaacacagcacacctatggaaccgtgaccacaacagtgcatcggtctctgtcccaccgtctcattcgaggttaatccctctccacagggcggcacctcagcagggaagggcgagtctgaggactgagggtaaacagtcatgacatgggtattcactatcatggctttcttagatttttaagccagaatgaagttcagagagcttgtcagaggatgttgaatgaacagaaaaggaaatttggaacccatatgaaaagagctgctttatgaatcacagagagcttttgagttccagcttacagtaattcaaataccactcacttatattcaactgagagcagctctggcccagccttgtcccctgaccccggggacactttctctaggatgaacaagagaaggtgttctccactgtactagctgccagtgtgtttctttcaaccaaggaagtatccatgtctcttattctatgtcattattgtaagaatggtctaccttgatccttagaagccaaccaggatggagtcccattttgcagagtctgctgtgactgccagccacccctgtaccatggacttccacagcaatgatgctgtgctgcatctccatccaaagggattgcatctgttttaattgcttgactttcaaggacactcagggacaggtactcttccataattctacgtcatcccagtttcacaggggcgtgaattccccatcccctgcaaggtctactgctctccaaagtgtgtgtctttgagatggaggctcttcacagggttcaccacctctgcaagtagggctgtgacaactcagccttgtgcactgccacaaaaggcccttcaagagcttctagaaatttctggctcacagaagccactggaatactgtaaatggagttggttttggtggctctgtcctttgatgggaggctctgtctcctgaggccaagattgaaggcaggatctgaagattgtgcgcctggatcaactctaatcctttccagcccaagagagttgttcttgcttcttcttggactgttgtgagaaacttccacactgactgcttggaagtgtcacatgttggacctcttggtaccagtgtctctgacagactcataccactgggagctcagagcgagtggctgaggccagcagagctgaacacttagtgccctgtccctgcattctgtgggatcaagaatgaactggaagtaggatgccgccctagaggaggcacaggtgctacagaggcagctcagctcaggaagcggacgtgaaccccttcctaccccccattagtgctgtggccatgaggccccctcacctgagggggaacacctctgtcagcctggctatctgccaccaacaaacacttttcctgggaaggggcctggattcctccagttgagcctccttagatgcacaggttgcaccagggtggaggccacagccaaaaccaaacagtgtagcatgaacaggccaggctcccagagtgggaagggaggactggctggaggcagcaggaggctggagccacatttgcctgcaaaaagtcttttcagacgcacatctcaggccagttacgcaactggctcctggatccctctgcccaggcccagtccctcccattgcctctcagtgtaaagcagggaatgctgcaggatggagagtcctaagccttaatcgtggatcttgggattcagagtccagagaggataaagaagcaaattcacagtcaacacttcctttttttggatgtttaccatagtgaagttttgtgcaaagtgctatgcggacatgatctgacacatcatgttcccccaccctcccggcccaggatctgaaggtccagcaggagaggcaagccaatgctaaccaaggctcaatctgatacagggacacagactgctctggacttccgtatatgcctttaaaaatatatatatatctttaggctgggcgtggcggctcacgcctgtaatcccagcactctgggaagccgaggtgggtggatcacttgaagtcaggagttggagaccaacatggtgaaaccgcatttatttattttatatatatataattttattaataaataccctggaaggaccttgttcctttaacgtgctggcacctatagcagggaccaaatttgtacttttacaaactgtctgtactggtctaaggaggagcagaggcgcacatacaatagctgcttatgcagaatcactggaaaacaggtgattcctgaacgttgctagatgaatataactcagaaataacccacagcctagattagtaatctgtgaaagttggagaccaaatgaaatttgtttagcaataaaatgcttttgaagagaatttctctttctttgatgttcttgctcattactgtacactctaatggtgttgggctcagaactattgctcaatagaggtttgataaatgaatgctccagaagacacacagaggctatcagtgtggtcgttgtcaatgagtgtcccagacattaaataagagcctgcaatgcctgagagccatgcgcagagatcatgggactgacacctggggagaggttctgaagggacctaagcacacagacaggagggaggtgtcatcagcagattcatccagccccatgttttgtagatgaatagttccaagacactttttaatagttatccaatcctgtatctcctgagcatgctcagtgccatagagcctcagtttccacatttccaagcagacttttctgttctctcataagcacatttgagaaaggacttgtttccccttgctgtcataaatgcccttgctttcaagttcaagccaaaaagaagcagtgcaattgttcttcaagctgatccggtgcagaggaaccgcaaatgccagctccagctatggtttctaattgaatatgactttctttgtaaatgcctgtccttgcccccagcagcaaactgacaactaggacttgcctttgtgagctgaaatgatgtcgctgataaccaacagcttgtattaatttttcctgataatctcatagtacttttaatgagattggtggcaaacatgccattctggggcaaattaatttgtccttgcaaaacagagtgtcagcgatttttatttcctttgtctgacgtgtaaatgggttgtttccaatggcaattgatacaacctagtattttcggctgcactgaagggagaacaagattttgccaagagcaacaaaatcagcacaaccacaattaaagcagatgatcgacatttggaaaatggtctgctgatgtttcttccttcgttttccatgctgaaataggttgtgatttagacaagggccaaagagatgaacaaggcagccagcggctgctcagcctccatgtagcctggtcatggagaagcaaaatcgacatgaaatgtgaccctctctcttttatgtgctttcacatgctgtggtcaggaaccaagtactgtatttgcattcactgctcaggcactgtgcggtgacctgcttttatgccactttgcattgctgaagtgatgtgggtgaaaactggaatcctagttagaaggaaacatggcatccgactcttccattctctcatttccaatgtattgtgttgcctctctcacccgccaaagaaatgaaatgtgattttctaccagagttggaagagttttggccacaatataagtcattatggcagtttccattttctttgctatacattttgaacaaggaaccacagttcatggaattgcattgaaaattaacagcttttttttttctttttttttttttggccaagctagccagaaaggaacttgcatgagaaattcactaatgctaatgcagtttttcaagtggtaatatttctagaattttaattaggactttttttttgctttgaagggtcccatcacagaagagaaaggaatgctaatatttgtctttgatggccagcagggtcctggaggacattaacgttttgcaagctgaatgaggtcttcccactgacacgagcataaagagcaggtggatttaacagctttcattccattttctatttagtttaatcaagataccagttaagaacaaggggaggctgctcccagagcttctctgtccttttaggggttgaccctactggctcggctggctgtggattagaccacacctgctacaaatcaacaaataatgaacttcggatgctgagaacctgaaacactacataaaagagggcataaacaaactcttctttttcaacatatgatgggcgattgaagcggtcagtggaagatagctgtgcacaagaatgtgggcctcctcccttgagccaaggtctcagttttatgattcctaacttagagttaaaagaagcaagccatacaggtaaatgattatcaggcagagaggcctagaatgcattacagttatgcaaaacctgggtttttcataggtgtttttaatgttggtgtgaacagtggagccaaatagcatcttgtagcccctacgtgggcacgattctttcctgggcgacaccgtctgcatgccccatggtgacattcctgtgcgcttgctacagttggctagtaatcctggctttgaagaaggttttccagtgccaatcaccatgttcaagacaatgtgtgggccagtattctgggtcatgcgtcttccccaggagctttggttaaagtgagtttgaggaaaatatgggtgctctcagatgctcacagaccacgtggatgtgaaatttagacttttatttggatgataataaagacagactttaaatgttttcagagtaactggacagctctatctgtctcaataactgcaggcagttcaaattcagcaggaaactactcaggttcctcctagccctgccccattctttataacatggaaaccctgattccccccgccgaacactttccttcaggtagcaggatttttgcttcaccgtaaacacaccaggatcacggatgatgatagcatttattgcttggaataaaaagtgatttgcggccctgtaaataggacagcaaatagttttgcttttgacctaaggctcccatgtcacttcatgatttcattcatcttcatattcaaaagaaggataaataaactgctttcctgcttagtagcttggtcatctgaaatccagtatctgacatcaattcccagtgggagaaattgtgctttgctgcgtgtgtcttaactcagtctctgatgttctggttctgactcaggatgttggtgacagctgcaccacatatgccacgtctttcatgctagactaagaccagacatcttttctggtgcgcatggagtcacactgtgacctagaagacagtgctttgaaataatgacaaagcacagaggcaaggaatgaagttgacattgcataccaacggcatcatcaaatttgtcctcaaatgtcactgtgtaatgctgagtgatttttggaatctccctagtttcccccaagcaaattacatatcttcataggcacatcgatatcaatgttttgaatgtaatatattttaatgaatatgtaaacatgtacaaataaatataatgaatataacaagtatgactgtcctatatgagacatagatattttcaataaatgtatatttattatgaatatatatttataatataaatatcaatacaatgttgttgaatgggtgaataaatcctttaaagcagcctcaatgttataagtagtcactgtgattcattcatctcatacaagcattctctttctatggatgtaattaatacttatggcaaattgacttttcttgagtctcatgaaatagaaaaattcctttctgacattttgactattctaatatggcacaatattataattttagtgcatgtaatcttttccacccagaaaattggcactttctaaattcctggtttcttatttgaaaacaaaaaagacaaaaattatgacaaatactaccaaattaatatttaaattatatttgaatggcaaattaatacttaaaattacattgctaaaaactaattccagatacggagcaaacttaaatgagaaagataaaacaatttaaattttagaagaaaatataggagggcaacttcatgattttggccaaggcaaagatttcttaattaggatgccaaaagcaccattaaaaaagtgggtaaaataaggcattgaaataatattgggggctgggcacggtggctcatgcctgtaatcccagcactttgagaggccaaggtaggtggatcacctgaagtcaagagttcgaggccagcctggccaacatggagaaaccctgtctctactaaaaatagaaaaatcagtcaggcatggtggtgcatgcctgtaatcccagctactcgggaggctaaggcaggagaatcacttgagtctgggaggcggaggttgcagtgagcagagattgtgccactgcaccccagcctgggacagagggagactctctcgaaataataataataataataatattgggtacagataataatttcctccacatgtgtgaaaaagaaggttatgagaatcagaaagcaggaatttagacaatatgtaggggcagcagatttcccttgttttgtaaaacaggcctcagagaggagtatcaacttgcaaataggtcaaaaaccctttgagggaaggaagtttctgggcagcagaagctttaccaccatccactgtcacatggatagggattgcaacatactggcccttcactaataacatctcgtcccatttggatggcaaccctgtgaagtacatatgatcatgctagggaaactgaggttgagtgaggcctggtgccatgcccgaagttgggctgctgtccagtggtaaggcacgggctagctgtgtcagccctaaagggcaccccactacatatccccaagatacaggccacggggctgcaccctcagccacggcccagcgtccccaaggctcagcatgagtttgcatctgctccttccctaggaagtcatttatttacataaatgactaatgatcctgggcaagggctcctgttgggccacatgttctgctttttaaaattcagagcctaggtcaactgtttgatagaaaaatgaaaacataatgtaaattctaaataaagctgatatgcaaagaaactgccctgttaacttaccttacttgtagatcatattttcggtggaagtctgttcagtttaaagataaacatgacatgattagaggagaaagaggatagcccctccctttaagctccaagataattcaagacatcagttaactattgagcgattagagaaggtgttttgggagctgaccttgacctagtattctcaaatctccttcccctccataaggcctggtatacttcatgttgctggcagtcaacatctgtctggcttatgaagaacgagataatcacactcattttggggcctcaggctatgagcacctgagtgtgttaatatcaattaaaaaccccagtacccatctgttgaggtcaggactattaaaagtcaggcgtggctgggcgcaatggctcatgcctgtaattccagcactttgggaggctgaggccggtggatctcttgagcttaggagttcaagatcagcctgggcaacatgatgaaaccctctctactaaaaatacaaaaaattagccaggtgtagtggtgggcacctgtagtcccagctacccaggaggctgaggtgagagaatcacccgagccccagaggatgaggttgcagtaagccatgatcgtgccactccacttcagccttggtgatgggagtgagaccttgtctcaaaaaaaaaaaaaaaagaaaaagagtcacgagtcaggagtcaggtgtaaatgcctgtatatcagactgtattttagaaatttgcttttaaaagttacccttgtgactgagactcaaaaagaaacttccaggatgaatgttcaagctttttttttacttaataaaaatacagctttaaggctgggcatggtggcccatgcctataatcccagcactttgggaggccaaggtgggaggatcatttgaggtcaggagttcaagaccagcctggcaaacgtagtaaaacctcgtctctactaaaaatacaaaaattagccaggcacagtggcatgtacctgtaaccctagcgactcaggaggctgaggcaggagaatggctgaaacccgggaggtggaggttgcagtgagccaagatcacgctattgcactccagcctgggtgacaaagccagactctatctaaaaaaaaaaaaaacaaaaaaaaacaagtaaaacaaaaaattttgcctgtgatacgataatgagtttcttttaaaacttctgagattagtgtcttagagatttaactgttgtgttttgctgctttcagcttgttctccctttaaaaaggcctgggatcattgctgtctccttttcctttttcatcagctcctgtgacgttttcatctcaacactttgggaggctgagatgggcggatcacttaggccaggagttcgaaatcagccttgccaacatagcaaaaccatatctttactaatattacaaaattagctgggcatggtggtacatgcctgtaatcccagccactcaggaggctgaggcatgaaaatagcttgaaaactggaggcagaggttccagtgagcccagccaagattgtgccactgcactctagcctgggcaacagagcgagactccatctcaaagaaaaaacaacaacaacaacaacaacaacaacaaaatgatcccccaagaatcaataataaccagaataaggagccattatcagatattctttattactcttaattactgttaggcttcaggaagccactagttgggtacagctgcccaggactaaacctgtttcttacaaggtcctacagccacaaaaggtggacaccacaacctccatttataaaacagaaaacttaaggctgttgttttgcaaacacatagattaataacatggttctgtaggtggacctaggagcattaatttttccctctcttccaattataattttcttgtttaacatcctagtaaagtttatgtcttctaaatttcatgtaaagatgatacggtctgtcataagtcttccaacccattctgtcttctgaccccacaaatgaatgcatcgtgccattgggccccttagttcaggtaccaaagatttttactcctcaaaggctagggaaggcctgcccccataaagtcagcaggaagcacttacagaaaagggactctgctcttctgcagtccccttaagattaaggaggagtatcgaatctctgagggagcaatgagataggaggtaggtgggactcaacccaggaccagattgaagactggctgacacaaggaagagacactggaagcacctgtccataacacatgcccaccagtgccatatcagtttaccattgccatggcaacacctgaaagttattgcccattttctagctatttctgaataacccactcctttattagcatgtcattaaaactggggataaatatgagtgcaaaactgcccctacgctactgctcttggcacaatgcctatgtggtagctctgtttcacaagaacagtcacaaagctgtaacactgccacctcagtaaagctgttttcttctaccaccagcttacgctgcattccttcctgagtgaagccaagaacctgccctgcaccacttttgtcaagtcagttgacataaaattactcataatatcctctctttattttttgactcctgtaggctgtgtaatgacttcttcctttccatttatgatattgtgttttgtgtcatttttctttccctcttctttttttttgagacagattcttgttctgtcacccaggctggagtgcagtggtgcaatgttggctcactgcaacctccgactccccagttcatgccattctcctgcctcagcctcccgagtagctgggactccaccacgcccagctaacttttttgtatttttaatggaaatggggtttcaccatgttagccaggatggttttgatctcctgacctcgtggtccgcccgccttggcctcccaaatctttccctcttctttatacacccttcatcaagtagtcacaggtttcaattcagttctttcttggtggtagtatggctcatgaaaaaagctgattcttctgtgtttgaggccattcaccatgtttatatgtaatactgtaaaaagtcctgtgacataagcctctgcttcacaaactgaccgctgtcaaacatcatctccccaccaatagataatttttttgttcctcaccagtataattcacataggagtagaaatctcaagtttaaagtgtggatttgcactttaccacttggtgtattcaagaagatgaataatattaatacatcagtagggccaggcgcagtggctcaatcctacaattccagcactttgggaggccgaggcaggcagatcacctgaggtcaggagtttgagaccagccgggccaacatggcaaaaccccgtctctactaaaaatatgaaaattagctgggtatgttggcacacacctgtaatcccagctacttgggaggctgaggcaggagaattgctttaaattgagagatggaggttgcagtgagccaagattgtgccactgcactccagcctgggtgacagagtgagattctatctccaaaaaaaaaaaaaaaaaaatcagtagctttgaattttaaacatctatttgacaagaaattcacagttctttctctcttaaataacgtaataattctttcagtaatgagcctggtttgatgcctctctccccaacatgataaaagtatcacataaatctatgaaaaattcaatttccctgttcctacaactgtctgggatggaaaacttcttcccttgctctagtcctttcttctacacctagtttcacctaatctgtgactcaaaacaatacttgtcaggaaacattctggaaagagcaaaaggcttctaagaggtgtcagagattcctggaccaacatctgtccatctctagagggggttgtgagtatgaggaagagcagagcttgtaaatcttctccttgctttcactcccactgtatttcctaacaacaacaaccacaaccacataatatcatagaacaagcatctactacttccaaggctttggtctcagtaaatcttctctacctctatcacagcatctagaaggtttgatactcatacaaatagtgctgtagctttcttttcataactggaaaagtgggcaagactcagtgtaatgcaggcattccttaagctacttagcattcagtttttagattatcattgcacacatatacccagcatatgtctaatatacatgtaaaaatccatgaagcaagtgttatattagcttgtgttttctattgtattaaatttttctcttatatcgtcttctcctttttgtcattaaaaatctgttcaagtcagtcaattaattattggatcataagtagataaagtcttttatttcataacacattgactcaatgaatatgtttctttgcaagacacagtcctcatttccaagaaaacaagcctgaaaagattatactggagcaagtctacaagtaatgatggtagtttttccttattgtcagtcctggggcaagaataacataaaagataacaaggtagaataaagattacataagaaagaaggacagcaacaggacatgggaactatttatagggtaacatttaaataatggatgatgagaagtaatgcgttagacagggatggatgggaatgattgaaggtctgagtactttagcacagattaagatcaaatcattaggattttaagagttgtgtacagttactgaagaaaatgccttagaatttaatttgactgtggataaaacattcttggattagatttaagactattttccatggtaagtatatttataatgatgatgactgtagtgctgaacatttaaacaatgaaaacaaaattaattgccacacacataatgtcctgaatactactgtaaatgttttatcttattttctttaaactgtctacagcactgtaaggcaggtaccactattgtcacagttacacagatatggaaaccgagacacagggaagttaagttacttgattaatttcaagcaatcgggaagccatggagcatctatgtcagggctgccaggacatgtgactgtaaacagaagtttttaactcaaagagggtatgtgtctgggttaatggaaagcttcaggaccctcagaaaacattactaataagcaaatgaaaggtgtatctgggccgggcgcggtggctcatgcctgtaatcccagcactttgggaggccgaggtgggtggatcaccaggtcaggagatcgagaccaccctggctaacacggtgaaaccccgtctctactaaaaatacaaaaaattagctgggcgtggtggcaggcgcctgtagtcccaggcactcgggaggctgaggcaggagaatggcgtgaacccgggaggcagagcttgcagtgagtggagatcgcaccactgccctctagcctggaagacagagcgagactccgtctcaaaaaaaaaaaaaaaaaatgtgtatctggaagattaagttctaacagactcttcatttccatagatccaataatgcacttagggagatgactgggcatattgaggacaggaagagagaaatgaaaacacagccttttatattgttcttaacagacttgtgccaaacattatacgggtgtatttaggtgattgaagagaagaaaggcacaggagtgaaattctgtgagcacaagggaggagttctacactcagactgagccaacagacttttctgacctgacaaccaaggcggcgcaggatgctcagtgcagagaggaagaagcaggtggtatctgcagctggaagcccagctcccaccccagctgctttgcatgtccctcccagctgccctaccttccagggcccatatcaatgcctgggtcagagccctggggaggaactgctcagttaggacccagacggaaccatggaagccccagcacagcttctcttcctcctgctactctggctcccaggtgaggggaatatgaggtggttttgcacatcagtgaaaactccatcaggagttttctctgatcagcaagaaatataattaaaattcaaagtagatcaacaattttggctctactcaaagacagctggtttgatctagattacatgagtgcatttctgttttatttccaatctcagataccaccggagaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctcccacagtgattcaacatgaaacaaaaacctcaacaagaccatcagtgtttactagattttaccagctgcttcctttacagacagctaatgtggccactcagttttagcgtctctgctctatttggacattttgcagttctaaaaaaaaatcattgaataatttggactttgattcttggactctcttcaactgaggcaccagaatcccaggtttccagaaatagtgactcactgtatgaatccttatatagcctcagtggttcttaactttcccagtagaggtagctcagtgcatgctacactgctccatttgaattttgcaacattctaagtagtagaaaattctatttatttatccaaatagttgactcagtaaaagctgttcatgtgaagatactaccatggctgaataaatcccattctttttctttcttcaggctatcaacatttcagtggcaaatggttattatggaaacatttgccatttaaaagtgaactaaattatttcttcaattttctctgtgatgcagtagactgtaaaaagattaaagtttgttaaaataaagtacatattcgataaggaagaaatagattattcctaatgacgtctgcaatgacctagtagaaggagtgatagaagcagttgttttcattatttttgtccaaaacttccttccaaatgggatttcattgatcatattcatttattaccacctataagacatgttgacattatgtaacatctgatgtgaagcgctgaggatacatctgtctgtattattcttgccaaaaattaatggtgtgaattgaatcagtagtaaacatcatatacaaacccaactaggaggacattcttcaacatacctggacagtaaacttcaaatgtttgaaggccatgaaagagaaacaaaagtgaaaaactatcacagatttaaagatattaaggacaggataaccaaataaaatacagaaacctgaattttatcttgtaacataaaaaaagtcatcaacgggaaaaatcagtgaaatccatatggtattttaaatgagttaacaaataacattatatctatgttcatttcatggttgtgatacttatgctgtggttatttatgatgctgacattagagcaagctgaaagaggcacatatgggaatcatttttactatatttttcaaattttaggtctaaaagtatttcacctctctcctgcatcctgggattgcctccaattaactacctgcttacaagacttttctttattttctttttgccttttattctttacatgtaaaagatgagtccatctggagcttattttaaagcacagtatgaggactgacattgacctgtttttttaaatgaaataactagctgtcccaaccctgcttgttggataacactgctctgtttcaggagtacccccactgtcatacacccgtgggtccatacccctgggctctccatctgggcactcccctgcctgtggcacctccttcctgagggccggcctcacccagggcccagctgccctctccatggcctgtgtcttcctttcctgatgcctcagatttcccccattctctggcactctttccatcctcctggcctcactctgcacctcccctgaggtgcaggactgccctgccccagcccccagcttcctcactcccaaagccttgtgccactgaagcacgagctccagagtgcacctggatggcagcttctctcctggccaacaaacgcctggtgctggctgccctcccagcatctcccctcaactcctcagctccaccccagggccttaacacacacatgcatagcacacacacatacaaacatatgcacacacagacatgcacacaaatgtacatacggacttacacagacacatacaaatgtgcacacactcgtgcatacacagatgtgttcatgcaaacacacacgtgcacgctcacaggcacgtacacatgtgtaggttatgctaagaaatccattttgtgtggaagacactcaggctcaaatatgtgtccaaagtcacacagctatggagcggcagaactcaggtctctagtgcacacagccccgacttaccgcagttccacttaacagttttcaactttatagtgatgcaaaagccatccacagtcagcagaaaccctcgtgtgagtcccacacggccagtttttcgctttcagtacagcagtcaatgattacatgaggtatccgacacttgactacaaaacaggcttcgtgttgatgcttctgcccaccgcaggctcagggcagtgttctcagcaggccaaggtgggcccccccacgctgtgctattcggtagtcaggtggactcagtcattttccactcgcagcggccttatcgggccgcagccaggggtaagttgagcagtgtctgtacttttagctccaccctgggtatttttaagtggcagatttacaacaaaaaataaaaataaaaatgaaaaaatacagcgttccaaatagtaggggcataaaaggagagaatgcacgttgcggtcagcccatgcctgggagcataagcacttcagaggcatcaccaggcgtgactggctgttgttcctgctcttcctggcagcagcggcctgggcctgagagggatcgccctggccacagctgtaggcaaggctgctgggagccaggagccgccgcgctccgcggtagcgagtctgcggcgccacctcgtgggtgctgcgtggaactccccgtggtgcgggccgggaaggccgggtccccacaaagccggagcccgagcacagcggtgcgagctcgccccaggacatcccacagcacccggagacgggggctggtcccccaaaaccctcaggggtgagaggaaggaggtccccagcctgctgagagctgtcctctgagcacgcactcgcgcacactcacacgtgcatgtgtgcatcctcaggcaccctgacgcgttcacatgcacgtacacgcgtgtgcacacgcacagtctttcacaagagtatgacgcattcacacaagagtgtgacgcgttcacacgcacgcacactccctctccctcgagcctggaaggtgcactgggctcataggggtggaaacctctaccgcggcagaggcacagcaccagggccaggatgctcgcttttatttcagacgtgaaaaccgaggcccgaaagagacagccagtgtccaaccctgtccaacgtctctgctgattgcgcctcctgtgtgtggccggggccggtgtgagggcagcgggcccaccgcatgcctggcccgccccagggcctcgagccacttcctcaggagctgctggcagctgcagcgacggcgcacccagagcccgagggtcccatggagccaggcttcccagcacacaggcacggtggagcctcggggtgggcatacaccccgcgagctcgcgggggctgggcactgcgggtcctcgggtggggactctggagttcagtcttgaaggacacagtcactgagggtcagggaaccaggagggtagggagggtagggaggggtgcctaggcctagtgggagaagcatgtgaaagttccctaagagggctgggggtgaacaagctctcggcccggcctctccgggtagactgctctggtgccctggagcctcccttctccaaggccccatggacgcccccagaggggtgacgccctcgcccacgctgagctctgagtgctgcacgagaactcccagagccgtgtgcacacgcactccccttgttataaccggcattaagtgcactcacattgtcgcatatcccctaccaccgtccatctccagaacttcttcatcttcccaaaaggaaaccatacccactgaacaccaactccctccttttgttaaccattgctctttctgtatttgaatttgcccattctgggcccctcatgtaagtgaaatcgcaatgtatttgtccttttgtggctggcttattccatctagcacaatgtcctcaaggttcatgcgtgttggcacacctctcagaatttccctcctggctgggtgatattataggctcacgcctattatcctagctgttagggagacagaggtaggaagatagcttgaacccaggagttcgagacctgcctgggcaatatagcgagaccgcattttccacaaaaagaaagaaaaaaaagaatctccttcctggtaaaggttcagtaacagtctactgtatgcataaccacatttcgcttgcccatccactcacccatagaccctcagaatgcttctaccttttgactcttgtgaatcacgctgctttgaacatgggtgtgcaaatatctgtgagagagcctgctctcaaaaaaatccatattcttggcaccatgaagaatcacctctcacagacaccagcgaaaagcaagtctgtctgagagcagagggtgaggaggggaaagccgggctgcggatcacagtgggcggaggaaagcccacccttgtgctcccatgtgtgggaggagagaggagagatgccctctagtgaaggaactcttgtagcagccagctccattcctgcttggcctgtggagggccagctcaggaacccagaccaggaagaagtcaaatgaccgacaagatccatcaggaagcagaagtgtgctgtgtctcatcggcaacaacaaacagagctaggaccagccacccaccccccaacccaggggaaatgcatccaccacacaactaccaccgctgcgctcatgacactctcagagacaggcacgggagctcctggcaaggcacaaccagggcaagtgacagtttgccagtcctgggcaagcagacacttatcctctctccagtccccaatcccaccagcctgcacaagcagagaaacatcctgcataaattaaaagatcatccggatcatcaaaagatctgagcaaacaaaacgactgagacaaaaaacaaacaaaacaaaacaaacaaaaaacagaacaacaacaacagaagaacactcatttttacagagagatttgagcccatcccaacagagtacaatgctctttccaagctcatggatggcgtttgggaaaatttagctgtgctaaaggagcaggaagcctcagcccctttcccaagaattgctgttacacaaatcacattctctcaccagggtgcaacaaaattagaaacatgcaataacaaagaccatgttaaaagtgcattttggggccgggcacggtggctcatgcctgtaatcgcagcactttgagaggctgaagcgggtggatcaccccaggtcaggagatcgagaccagcctgggcaacatgacgaaaccctgtctctactaaaaatacaaaaaattagccaggcatagtggcaagagcctgtaaacccggctactagggaggctgaggcaacaaaatcacctaaacttaggaggcagaggttgcagtgagatgagattgtgctactgcactccagcctgagtgacagagtgaaactctgtctcaaaaaagaagaaaaagtgtgttttggaaacaaagttagttttcacaatgaaaattataaaatgcctggaactcaatagcaatagggtattacatattaaaattatgaaactcaacaaaattgacatttagggagaaatttatatcctcagattaatttgtcagaaacaggataaaaggagaaagctcatgataatttgagtaaaagagaaaataaaaactaaaatgaaaaacttttcagaaacaaactacaataagtgtgtgacctatcaaaatctctggatgtgtccaaagcagttctcaggggaaacgttatagctggaagtgtttgttaatatgcttcaacagaagacatataaaattatataaactaagtaaacatacaagaagcttttttaagggaaacaagaaataaatgtatttaattttaaaacagccataataaaagtagacttgataaataaaacccaaaaccacttctttgaaaagaccgttaaaaaaacctctgagaagtcaagcaaaagagaaagaaaaggcacaaattttaaaatgttagatttagaaaaatggcataataaccaacgtggagaagctgcttcaaatcaaggagacgggaggccagcttcattccatgggaggccagcttcattccagtaggttccgtttcacctggatgaaatggaagattttcttggaatgtataaattggcttagcaggaggcagaaaacctgaacaaacagaacaaacagaaatggtaagcaggtgctcgaggggctccatcagcctccagggatgggctgctgtgttagggagggccagagcacaggggaagtggagtgtaattctttctacaagattagcaagctgaacttgaatctcacacacgcacacacaccacagtgacgtggaaagaatccacaggacacttatgagaggtaaaaatagaaagtttctgcacaaaacaatcgtgtgtgtttaaaagataccatgtggcagaaaatagtgatgtttgtttgccagtgtctaggaagaaaccttgaaggcgcacgccagactggcggctgggttggctagggaggagacgatggggtgggagcagctaaggacgacacacactcttttaactctgttcctgcgttgtcgggacgtttacaaactgaagatatatatttttaattaattatttttttttttaaaattttactttaagttctgggatacatgtgcagaacatgtaggtttattacataggtatacatgtgccatggtggtttgctgcacctatcaatttgtcatctaggttttaagccctgcatgcattaggtatttgtcataatgctctcctttcccttgcccccaacccctggatagaacctggtgtgtgatgttcccctccctgtgtctacgtgttctcattgttcagctcccacttatgagtgagaacatgaggtacaaactgcagatatttatacattactttaaagtaattaagttaaactaaactaaatgtaagccaactacatgtaaataaataaaaccaataattaataacaagataaaaataattaatacttaaataattactaatttatttctcagctaaaaattaaaaatttagaaaatgtggaaatgtgtttcataataggaggatatttaaaatgaaagggcatttctgtagtcaaaggggtaggagactcacccaaacaagacacaacctcaaaaccaaaaggaaaactatcaggtttgattatacgaatactgaaaacctctgaatacatgaaaggcaaattctatatcccatgaaactacccttcagaaatgaagagagaaataaagacattctcagaggaagagaatataggaatttgtcactggtcaatttagaaatgctaaaaagtggctacggaaatatgttctgtcatttccacaatacaaaaaattaaaacaaaaaaatcaaaataaaaaaatggctatagaaagttcttatgcagaagggatgaatatgggactatgggaggagggacaaaggaaagacgagaaatgtggatacatacgcgagacaatccacagttcttaaaatcacatctgacgactgaaacaaaaactataccaccacctaatactcaagccagtgatttatacaagtggaaaaggtaaagagacataaatgcaaggcaggtttccacactttgaagtggtaaatactggtaccagtagactactatattacaatacacatattgtaacatccagagcaaacactttaagactatacaaagagatacacgcaacaacattttacagaaatagatcaagatggagggaaagaaaaaggaaacaaaaaagcaaataataaaaacatcaggcataagcaattatgtaacaataagcaccttaaatgtaaatggtctaaataaaccaaaagacagattgatggagagcctataataaacacatggcccaactaaatactgttcatgagaaacttcaaactcacttaaggacctaagtaggttgaaagtaaaagaatggagaaagatatcctgtgaaatcattaattttttaaggaagcaggagtgactatattaatatttcatgaagtagacttcaagcaaaataatttaccagagctggagagggtcttcgctgaattttaagatctaaaatttcctatgctgccttgacatctttgagcctcacagggccccaaaggcctagccgtgggttttcctgtttctaccagacaccccctaccccgccacccaacaggaaaggctccccacctggctagttcttttatcagccagaacagttgcacctcagcctaagaagtttcgcttcacctgtctgccagcccatgaatttattcaaacaagccaattgcattccccctcgggaaccattggtcatcgtgtgctcttgttactaccaagcccgcctgcttcctcagcccgcagccctcactccactacagagtgcggtgcccatctgaccctgtgtggcatgcagtgtcctcctccgagctgtgggtatatgcgactaaaacactgctgtcaatctcatccatccacgccaggtgtcatgttcggccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaaaacaaaggatagcttgaggccaggagttcgagcctgggcaacatagcaaggcctcatctctccaaaaaattttaaatttagccaggtgtggcggcacacacctatagtaccagctactcaggagattaagccagggggagtacttgaccctaggaagtcaaggctgcagtgagtcatgttcgtgccaccgcactctagtgtaagtgacagagtgaaactaggcagaaaaggagcaaggatttacaaaagatctgaacagtcaaccagcaaaatctgacatccgtataacaccccactccccaacagcaaaacacacacatttttaaagccaatagaaatctaccaagatgaggtacacttggggcaataaaagaactcacagcaaatctcgctgtgtgcccctctgcgccggcgccgtgcccctctctgcgccttcttttctcaccatggggaagcgtttgggggcctcttgagggaccccctagatgcttctactcagagcccccaaagccggggagcctccactcctctgtctgcagcctcccctgtcggttctcgctacccagggttcagtggcctgggggtgacggagggggtcgcctctgccaaggcccctcccggcgcctccctggctcatctagcccaccttcctcccacgctggctcacgcaaagtgctctggtcaccaggagcccttcctgaccagccccagccccttcttggccttcgcccacctggcctcccctggagccctgacctgggtgccgggcctgctgggtccagagcccaccccgccctgaacaaccccgagtctcagccaccctcggttcttaccctttcacagctggggagtggagcctgggcctgcacctctccgcgccagagccggcgccagcgcctctccgcgcctgcgccgccgctgcgcgcctcgccgccgctgtctgcctctccgccgctgtccgtctctccgccgcgccgccgctgtccgcctctccgccgcgccgccgctgtccgcctctccgccgctgtccgtctctccgccgcgccgccgctgtccgcctctccgccgctgtccacctctccgccgctgtccgcctctccgccgcgccgccgctgtccgcctctccgccgctatccgtctctccgccgcgccgccgctgtccgcctctccgccgctgtccgtctctccgccgcgccgccgctgtccgcctctccgccgctgtccgcctctccgccgctgtccgtctctccgccgcgccgccgctgtccgcctctccgccgctatccgcctctccgccgcgccgccgctggccgcctctccgccgccgtccgcctctccgccacgccggcgccagcgctgtgtgcctttgcgagggcggagctgcgttctcctcagcacagacccggagagcattgcgagggcggagctgagttctcctctgcacacacttcggagatacagcgaaggcagagcaatgttctcctcagcagagacccgggcgggcgggccggtggcaccgcgagggcggagctgcgttctgctctgcacagaccttgggggcactgcctcgctttgggacaactcggggccgcatggacggtgaataaaatccttcctgtttgcagccctgtttgtggttggtggcagcgatggacactgcagccagccagagcgtagaaaggcgtcggggtaagtgcgctatccaggctgcactgtgggtggcctgggacgggttgggagccctatctcaggcgtcactgcccgtcttgggtggccggttgggtgtgctatctggggctgtgctgcctgcaccgggcggggggtggggggtggtttgggggccaaaccggggctgcactgcctttggtggggagccggttgggggcactatcccagactgtattgctggcaacagtgaggtgggctaagtgtgctatccggggctgcactgtgcggctgtcgggggggtggcggtttcgggttgagggcgctatggggtgctgtaatgcccatggtgtggggaggcggggcagtttgggtatgttgggtgtgctattgggggggtgacactgctggtggtagggggcagggtgggttgggggccatatcaggggctgcactgatggctttagctaggatttctggtactatgttaaacaacagtggtgacagggggcatccttatcatgttccagatcttagaggaaaagctttccatttttccccattccatatgattctagctgtgggtgtctttcctgtagtttttattatgttgcggtatgtttcttctgtgcccgtttctttgaggatttatagcatgaagggatgttgaatttcatcaaatgctttttcggtttcagttgacgtgatgatactgtttttgtcgtttatttggttgatatgatgtatcacattgtatgttgagtgacccttgggtcccagggatacatcccacttgatcatgatgaattatctttctaatgtattactgaatttgattcactggtattttgttgaggatttttgcatccatattagagatcctggcctgtagtttccttctttgatgcttttgtctgattttggtatcacagtaataatggtctcacagaataagtttggaagtattccctcctgtttttcaaaatagtttgagcaggattcgtactaggtctttaaattgtttggtgtgaagccatcagcagtgaagacatcagttcctgggcttttctttactgggagactttttctgatggcttcaatctcattacttgttaccaatctgttctggtcttggatgttttcattgtttaacctaagtaggttgtatgcatctaggaatttgccaatttctactaggctttccaatttattggcatatagtagccagttatgatcctttgaatttctgaagtattagttgtaatgtctccttttttaatctgttgattttatttatttgaatcttgtctcttttcttagcctggttaaaagtttgtcaattttgtttagctttccagaaaaccaacttttcatttaatcttgtatgttttttatttcaattttgtttgtgctacgatcttatttattttcttattttcggtttagtttgttctttactagttctttaagatgtattatttgaaggttttcttttgtttggatggtaggcacttatagctgtaaatctctgcctttgtactgctttctgcataacaagttttggtatactgtgttttcattaccctttgtttcatgaaatttttgaatttctgtcttagtatcttcattgatccgctagtcatttattcaggagggtagtgtttaacttccatgtgattgtattgtttccaaaattgcttttcttattgatacctagttttattcctttgtagtgaaagaagatggccacggagacagacagcagcgtggtcagagtggtaggagccggccatcagcgagagctgctccatgcctggctgctgggtcctagagcctgtggcccactggcttgcctcactgtggttggtggtggtggtgacagagactgcaggacgaccagatggtaggacaggggctatccagggctgcacctttcgcagtgtggggtgggttgagggcgctatccagggtgtcattgcctgcattaggggtactggttggtagcactgtacagggctgcactgcccacggcagggagggtgggttatgggtgctttctggggctgcaatgcccatggaggaggacaggttagggcactatcggttatacgctactggcggcattgggggacggaggtggggggcgctattgagggcaggactagcagtggagcgggggcgagttcggtgctatcaggggctgcactgctggtgtcggtcaacagagttggcatcccaggaaggagtggttctcctctccctgactccacactccagagggcgacccactcttggtcatactggagtgcagcagggcacgcagcgtttgcgtgggaatcctgagcatggcagagcccccacacccaccgtggttcctggttcctgggcctgtgtactgtgggtctgtgcctcagaggctgccaggcacccctggggacaccacgggggacagggccctgtgcgtggaggcgtccggaacaggaattggcacctgggtgtggagggctggctgggtctgaatttttctgcttctcctgctccccgaggagtgcagccccagtgggcccaatggttcctgtggagtggggagctgggtgctgtggtgtctccagcacccaccccagaccccagttcctgcccagcttgggccaaaaggagaggctggactttggagggtgggtgtgagtgcctttgctgaaactggcccctgccacccagtggccggcatgacaagttgaggctctaacccttccacccctcacgtctttctctaggcttttctggctttgcccgcccagctgctctgtgccaggaagaggaggagacacctagagcctgcgacaccatggctcgcctcgctgcgggtgggcggcagtgacggagactgcagtgcgccagagcggtaggagagcggctgcgctaggagggcaggcggctgcagccagggttgggggtcaggcttagagcgatggacgggctgcagcagtggccagatggtaggagccttgtaaggagggctggtgcattggcaatgggcctggctttgccctgcgcctgccgtggatctggccctgtactgccctgccttgccctgtacctgccctactgttacttggactctcggccctgtcctgctctggtcccatcctgaccctgtcttggccctgtgctaccctgtccctgccctggtcttgccctggcactggctctgccctgaacctgcactggcctgaccttggctctggccgtggctctggccctgcctcttgtcctgaccctggtcgtgtcatggcactggccctgccaatggtcatggtcctgctcctgttctggccctgacctggccttggacatgtcctggccctgctttggcccatccctgccctggccccaccatgggcctgcctgttctgccctctcctggcactgaccttgccctgtcatggcccagtggtgccattgccctgccttaccctgcgctggttgtgacttggccccgcttggtgctggccgctccctggacctgccctggacctgccctgaccctgcccttggcttttgccctgccctcactgtggcctggccctggccctagccctggtcctgccatatccctggccctgcccttatccaggccctgcccctgctgctgccctggccctggcctggaacctggtcctgtcaaggacctgccctgactctgccatggccctggccctgctctgccttgttcctggccctgacccagacccagaccctttcctggctctgcactggactttccctggccctgagctggcaatggtctgcccctggtcttgccatcaccctgccctgctgcgctctggatgtgtcatcaccctgccctggccctactctgcctttgaccctgccctggccttaccttggccctcaccctagtcttcgctagaccctgctctggagctggccctagcacagacctggccctgatcctggccgtggtctttgtcctgccatagccctggccctgaagtggacttggaggtgtcctggccccggcataacatggctctgcattggcctgtccctgccctgccgctaccatctccttgccctgctctgtcctgtcccagtactgtcccggccgtgctatttcccttccctaccctgccttggctgtgccctggctcggttctggccctggccccggccctgccctggacatgctctgacactgcctcagcctcggcactagcctggctctttcttggcatcagctctgctctctctgtggaccggctcttgtcctgtcctgcactggccataccatgccctgccctgccctgccctgactcagtcctggctcagccctggcccaaccttggccttggcattgcccctggtcatgccatatttcttgccctgtccctaccctggccttggccctgacccttaccttgctgtggccctgcccttgccctaacgcagcccctggccctgtcatggccctgccctggacctgtcctggccctggcccttccctgcttgagaacttgccctggttctcccctggccctgaccctgaaatgcctggccctaccctggccttgcactgctctggcccttgccctgactctggtcctgtcactggcctagccccagccctgttgctggtcttaccatggcccagaccctgccttggccctgccctgacactgtcctggaccctggctgtgccaagaacctgcactgtccttgccattgttttgctcctgccccgaacctggtcttccccaggccgtggccgtggccctggccctggccctgcccaggtcttggcactgtcctggccccgccctgccctggccctatgctttcctggccctgccttgccggccctggccctgccttggccctagcctggctttgaccctgccctggccctaccttggccttcaccctagccttacctgggcactgtgttggacctggccatagcacagacctggttgtggccctggtcctgccgtggccctgtctcagaccctagccctgccaggtacctgtcctggcccagctctgggcctggctttgtccctggttcttagatgaacctggtcctgctcctgcccttgctcttgccctggaactggccttggacatgtccatggtcctaaccctggccctgcccaggagctgccactgtcttggctgtgccctggctctggccctgccccggccccaaccatagacctgccctggttggtcgtgaactaccttaaccctgtgctaccctgggcctgctccaccctgccctggccctgccctccctttggccctgccctgaccctgccttggccctcacactggccctagcacagacctggtcctatgtgtggccttggcctggcattgacccctgctcctgaccccggtcctgccatggccctggccctgccaatgaccctggcagccctggccctgtcttggccctggccctgaactggccctgccctgaccctggccctgaagtggatttgcaggtgtcttgtccctgatgtaacctggtcttaccatggccctgtccctcccctggctctgtcctggccttctgctgaccctgacccagaccttggccctgccccagccttgtcctagatctggccatggccctgcgtctgccctggaccagcgctggcactggcatggaccctggccctggcccttcgctacttaaggccatgccctggcccagccctggtcctgaccctgtcctggccctaatttggcgtggctctaccctggcatgctattctggccctagccctgaccctgtccctgtccctgtcctggccccagccccattgctggtcctgccacggcccttgtcctgacattgccctttcctggttctggccctggccctgtcccagccctgctctggccctggtctgaaccctggccctgcaatagacctgccttggtcctgcccagaccctggctctggccctacctctgccctggccatacccttgccctggcctggaccccagtcctggtccttgtcctgccccagccgtggccctggccctgccctgcctgtgccctgttctatcctgggctggccctgccatggcctggtcttgccattgccctgccctagcctgccctgcttgtgccctagacctgccccggcctttgcccctgtcttggttctagccttgactgagccctggaccttccctgatcttgcctcagccctggcactaccctggccttgccttggcatttgccttactctctctatggcctggctctggtcctgccctgctctgctcttgttctgtcctggcacagccctggccctggccctggccctgccgtatcactggctctggtcctgcccttatgcagacctgaccctgccactgccttggctttggcctggaccttggccatacagtgaccctgccatgaccctttcctggccctggcctggaacctggccctgccaaggactcgccctggctctgtcatggccctggccctttcctggatttgggtgtgtcctgtcccttatttgccctggcccttccctggctctgccataccccttctctggggtagggccagggtcaggaccagaccagggcagggtcaggaccagggtagggccatggtaaggcctgaagatgggaagggccagggcagcggctggaccagggaagggtcagggccagggatgtagtaggactaggggcagagccggcactagggctgagccaggacagagcaggagagattacattgggctattacgtaaaatttttattttagatttttaagataactatagtagtagtaatgtctatactatattgtttgtaatagtaataatatttgcagtaatcactaaattttaactaatactatctttgcttccagtagtgttctatgagtataattttatcaatatgttaatatgtgaggcattgattctcacaataattctatgtgctaggtacttaaagcatccccattttccaaatgtaggaaacaggcataaagaagttaaatacttggccagattactcctgtaatcccagcactttgggaggccaaagcaggcagatggcttgagctcaggagtttggaaccagcctgggcaacattgtgaaaccccatctctactaaaaatgcacaaaaagaactaatttaagtttcttgtaggattctggttacaaaacactggtcaaacacacagggcatggatagggcagggccagggacaaggtcaggccaggaaggggccagggccaaggcagggccagagatggacttggaagtgtcctggtctgatttgccctgccccaacgttggcccagccctgctctggcacttcctgtcatgccctgtccctggcctgagcactggccctggccctgtcctgcttctggccctgccccggagttgaccaggcactgccatggcccagtcctgcattgccctgccctcctctgccctggtgctaccatggccctgcttgggccctagctctgcctctactctggacctgccctgactctgctcagccctggatctaccctgactctgccttggtgttgccctcccatctctatggcctggctctggctgtgccttgcatagatcatgctctgccctgcgtgtcccagcctgggcccagcccttgtcctaccatattcctgaccccagccatacccttcttctggccgtgaccctgccgtggccctctcctggcccttccttggtcctgccctgcccttccatgccctggccttgccctcaccctgcattggccctgcactggtcctgccctgccctggcactgccttggccccggccctgccttctccctggtcttgcctttgccctgccctggcctgaccccaggcctaccgagtccatgaaatggccctggacctgccttgccatcgtctgtcctggccctgtattgtccccaccatgctctggtccagcgcttgccctggccctgttgctagtcctgccactgttatggccctgccctgtttttggccatgccctgtgctaccctagccctgccctgccttggccttggccctaccatggccttctcctaccctggcctggccctacactggccttttctaccctggccttgcccttcccctggtcttgccttgccctggccttgccctgccctggccttggctttgccttatcctggtcctggttctgccctgaccctggccttgctctggatcctctctggttctgctttctccctggccctgcccttgctctggccctgtccctggcccagccttgaccctgaccctggccctgacaatccccaggtctgacactggccatgcttggccctggcccctccttttggccctgccctggccctgccttggccctgtgctatcttagtcctgccctggccctgaactcaccctggccctaccctcaccctacactggccccgccctaccctggccttgccctgccctggccctgcctttggcctgctctggctctggttctgccctggccttgcccttgccctggaccctccctggccatgttttttccatggtccttctctggccttgcccttgccctgtcccctttctggtcctgccatatttctggccctgtcctgtccatgtcctggacctgactctggccctggacctccctgtccctgccctgccataccctggcccgttccttgctctacactgaccctgccctgccttggccctgtgctaccctagccttgccctggccttctgctgaccctgatcctgccatggccctggccctgccatgtccctgccctggccctggttctgccctgcttctggccctggccttggtcctctcatgtccctggccgtgaccctgcccctggtttttctctggccatgaccctgcccctgttctgtcctatccctggccctgtcttagttctgtcctagccctggcttttcacagtactttatgcttagtaagggctccatggtgtctgtgagttgaatgttgtgttcatagtatctgccaaaacagaaagaaaaaaaacaaaatattttgataagaagttaaagctttgtatataatatgccttgaattgtaaatgcctgttattagttgtattacatataggtcatggttttgtacacataactccaaaccattgatactgttaaaagaatatatgaatatatgaaagaatgtgtaaatgtaagaatgtatcagtatctaattacctttccaaattaatttttatttttagctctattagatttttctcagtgtaacaaatgtttattcctatgtaattaagggcgtatttcctgtacagaatattcatattacctaattgaaaattatatgatacaaaaatataatactatttttaggccaggcatggtggctcatacctgtaatcccaacattttgagaggccaagtttggagaatcatttgagtccaggagttgaccagcctgggcaacatagtgagaccttgtccttattaaacaaataaataaataggttgggcactgtggctcatatctgtcatcccagcattttgggttgccagtgcaggaggattgcttgagcccaggaatttgagaccagcctgggcagaatagcaagactccatctctacaaataataaaatattaaccaggtgtggtggtgcgcacctggggtcccagctacctgggaggctaatgtgggaggttttctcgaggctgcagtgaactgtgaatgcaccactgcattccagcctaggccacagaacaggaccttgtctatgaataaagaaataagtaaaaatataaataaaaataagtaaaaagaaatattagtaaatataaatataaatacatataaacataaaaatgcatgcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgatgagatgagatgagatgatgagatgaaatggagagtggaaatgagatgaaatgatgagacgaaatgacaaagctgaaaagaaattgaaaggagatgagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaatgaaataatgaaatgaaataatgaaatgagatgaaatgaaataatgaaaggaaattatgaaatgtaatgaaattgaaatgaaattgaaatgagatgagttgaaatgatgagatgtaatgatgaaatgaaatcatgagatgagatgaaatgagatgaaataatgagatgaaatgagatgatgagatgagatgaaatcatgagatgaaatgatgaaatgaaatgaaatgatggatgaaatgatgagatgaaatgagatgaaatgtaatgagatgaaatgaaatgacataatgaaatgaaataatgaaatgagatgaaatgaaataatgaaatgatgaaataatgaaatgaaaatgaaatggaaatgatgagatgagaagaaatgatgagatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaatgatgagatgaaatgatgagatgagatgagatgatgagatgaaatgatgagatgaactgatgagatgaaatgaaatgaaataatgaaatgaaattgaaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaaatgaggtgaaattaaatgagatgatgaaattaaatgatgaaatgaaataatgaaatggaaatgatgagatgagatgaaatgacgagatgaatgatgagatgaaatgagatgaaatgatgagatgcaatgatgagatgaaatgatgaaatgatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagataaaatgagatgaaatgatgagatgaaatgaaatgatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgatgagatgaaatgatgagatgaactgatgagatgaaatgaaataatgaaatgaaattgaaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgtgatgaaatgaaatgatgagatgaaatgagatgaaatgaaattagacgaaatgtaatgagatgaaatgaaatgacataatgatatgaaaaaatgtaataatgaaatgaggtgaaattaaatgagatgatggaattaaatgatgaaatgaaataatgaaatggaaatgatgagatgagatgagatgaaatgacgagatgaatgatgagatgaaatgagatgaaatgatgagacgcaatgatgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaatgagatgaaatgaaatgatgaaatgatgaaataatgaaatgaaaatgaaatggaaatgatgagatgagaagaaatgatgagatgagatgagatgaaatgatgacatgagatgatgacataagatgagatgaaatgtaatgatgatatgagatgaaatgatgagataaaatgctatgaaatgatgagatgaatgatgagatgaaatgatgagatgagatgagatgatgagatgaaatgagatgaatgatgagatgaaatgatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaaatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacgaaatgaaaaaatgaaataatgaaatgaggtgaaattaaatgagttgatgaaattaaatgatgaaatgaaataatgaaatgaaataatgaactggaaatgatgagatgagatgacatgacgagatgcatgatgagatgaaatgagatgaaatgatgagatgcaatgatgagatgaaatgatgaaatgatgagatgagatgagatgtaatgatgagaggaaatgatgagatgtaatgaaatgagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatgagatgagacgagaagaaatgatgagatgaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaaaatgatgagatgaaatgatgagatgaattgaaatgaaatgaaataatgaaataatgacatgagatgaaatgaaatgatgaaatgatgaaataatgaaatgaaaatgaaatggaaatgatgagatgagaagaaatgatgagatgagataaaatgagatgaaatgatgagatgaaatgaaatgatgagatgagatgaaatgagatgaaatatgatgaggtgaaatgacataatgaaatgatgaaatggaataatgaaatggaaatgagatgagatgcaatgagttgaaatgagatgaaatgatgaaatgatgagatgaaatgatgagatgagatgtgatgaaatgatgacatgaaatgatgacataaaatgagatgaaatgtaatgatgaaatgagatgaaatgatgagatgagataaaatgatatgaaatgatgagatgaatgatgagatgaaatgatgagatgagatgagatgagatgatgagatgaaatgatgagatgaactgatgagatgaaatgaaatgaaataatgaaatgaaattgaaataaataaataaaattgaaatgagatgagatgaaatgatgagatgatgaaataaaatgataaaatgatgagatgtgatgagatgaaatgatgagatgagatgacatgaaataatgaaatgaaataatgaaatgaaattgaaatgagctgagaagatacgagatgaagtgatgagatgaaatgatgaaatgataagatgaaaagagttgatgagatgataagatgaaatgatgagatgaaaagatgagatgaaatgaaatgatgagatgaaatgagatgaaatgaaattagacgaaatgtaatgagatgaaatgaaatgacataatgaaatgaaaaaatgaaataatgaggtgaaattaaatgagatgatgaaattaaatgatgaaatgaaataatgaaatggaaatgatgagatgaagtgacgagatgaatgatgagatgaaatgagatgaaatgatgagatgcaatgatgagatgaaatgatgaaatgatgagatgagatgaggtgtaatgatgagaggaaatgatgagatgtaatgaaaggagatgaaatgaatgagatgaaataatgaaaggaaattgaattgagatatgagatgaaatgagataaaatgagatgaaataagaaatgatgaggtgaaatgaaatgctgaggtgagatgagatgaaatgaggagatgaaacgatgagatgaaatgaaaggatgagatgaaatgatgatatgagatgagatgaaatgagatgaaacgagatgaaatgatgaaatgatcagatgagacgagaagaaatgatgagataaaatgagatgagataaaatgagatgaaatgaagtgaaatgaaatgaaataatgaaattgaaatgagatgagatgaaatgagataaaatgatgagatgaaatgatgagaagaaatgagatgaaatgatgagatgagatgatgagatgaaaaatgatgagatgaaatatgatgagatgaaatgagatgaattgaaatgaaatgaaataatgaaataatgaaatgagatgaaatgaaatgatgaaatgatattgaaatgaaattgaaagatgagatgaaatgatgagatgaaatggtgaaatgttgaaatgaaatgatgaaatgaatagatgtgacatgaaatgagctgaaatgatgagatcaaatgaaatgaaatgagattaaatgatgagatgaaaaatgatgagatgaaaaatgatgagatgaaatgctgagatgaaatgagatcagatgaactgagatgagatgagatgaaataatgaaattaggtgaaataatgaaatgatatgaaataatgaaattgaaatgagatgagaagaagtgagatgaaatgttgtaatgaaaggaggaaatgatgagatgaggagatgaaatgatgagatgaattgagatgaaatgagatgaaaaatgatatgaaaaatgatatcaaaaatatgagatgaaatgaaatgagattatatgaaatgacaatgaaataaatgaaattagatgaaatgaaatgaaatagtgaaatgaaatgatgaaatgaaataatgaaaatgaaatggaaatgcgatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagttgtctttgtgttccttaatctgatgagattttcacactctgcacatgataattgttagatttttattgtgttgataaattgtatatcaaataaaaaatgttattacctcttaaattaggatttttaggtgatataggcagaaaggacagcaagtttttataactttgtctaaatgaactttctaaatgcctgagtattaaaagatagcatgtctataaatcacaatgtatatattactgtatgacctaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaaggaattgctttcttaatttcttgtttcagctagtttactatcaatatatagaaatgctactgatttttgtatgttgatttatatcctgcaactttattaatttcatgtatcaccctaagaagcttttggtagagtcttatttttttccatgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaagctttcaccttttccacactcagcatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaatcagtatatcaaagacttacctgcacccccatgtttattacagcactattcacaatagccaagatatggaatcagcaaaagtgtccatcaacagatgaatggataaagaaatgtgatatacatatataatggaatactatttagtcataataaagaacaaaatcctgttatttgtggcaacaagaatgcaagtggagggtattatgttaggtgaaataaacctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgttgggtgactgtagttaacgggaatttattgtgtgttttcaaataactaaaataaaagattttaaatattctcactgcaaagaaataatacatgatttaggtaatggatatgataatgactctgacttgatctttacgcattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacattcagtaagaatagaaaacttgggcaccgtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataagcttttaatatagtagtcaaagtattaatttctcacattgcaatttccttcaaagacatgaatacaacctttctaatgactccttgttcatcaagatacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccaagtagctaggactacaggtacataccacgatgcctggctaatttttgtatttttagtacagtcaagagtttcaccttgttgtccaggctggtctcgaactcctgacctcaggtgatccacccaccatggcctcccaaagtgctgggattacaggcataagccaccgcacccagcctgatattgcactcttggattttgaacactgaatatctttttgaaagattacacctctttactttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcacagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcatgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgaatggagttgtacatataatttttatgaaaaaaattaacaagtgcataagttcataatagaaaaaccaataatactccaggcacaagttagtactaaaaaaattatgttgaatattctctaatacaacatgctttttcccttcatgaacaatttgtgttttactgagaagagtcactgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgcaatgtactatgtttatctgggttttgaaaagtgatgtttcctaatatgagaaagccatttacagttttaaatctacaaaggcaaatggaatggtactaaattatttacataataatgtttagatggtggcccttataacattctttctatacttcctacagagttggggatatgcaatcctagaatatttctgggagctaatcctttagcttgatgaatgaaacaagacttttaaataaaattaaactttcaaattatccaggtaatgggcctgtcttttaattcaatggatatggagcataatgaattaacccctgttcattgggtaataagttctcattcttataatactcaaaatgtcctttaatttttaatttttgatagtcatatcattatccctaggtattttagcttctatcttaaattctaaaataattttgaaataggagaaagtattctttattactatatgtattaaacatcatggttttcaaattgaactgcaaatgtatcttttcattgcttcttgatgacacccttcaccctatccatattgtcactaccaagtggtgattacttttcaggttcacatacttattcttcagaaaaatcttctctgtgccttataaagaatatgattgttggcattcaaaagccagcgaagtatacattattagcctgttgcctaactcatttctttaagaaactacactaattacccacatacttatgtttttatttcctcattatttctggagaaaacaaatactgctaacatgatatttgtaagagagaaaaaagtcttttcttgaaaagtgctgtcattgtagtactaacttatagtatcaacttctttataaactccttagacactttttattctgagagaaataaaaaagctaaaagtcaaatgactttttttactctccttattataagcacccatcttggtaatttagggtctttatagttagggtaagttgtgtcataccgaggttacaaaataaaaagtattttgtctttttgggcctttccttattcagtaatactgtcagtttggctttttttgtaggtcaacttattgaactcagtattctgaaataatatgtttactatcttttgagaagcacttaaaatattagatttattgttactcttctgcctttattgggctggaagaataattgtttcactccacaaaaggcaagttgcggagaaaaacacatagacattcaaccgcaaagcagagaaacttgactattttctgcaattttaaagtgtatattgaataaaaccatctttttattttcttttttgctcactggcaaatattaacaacatcaagtgtattattataatgttatctagttaaaaatctcaaaaagttttcataattaccattttaaagtatataaataggtgacctaatgttaatttttattgtctgagaccatgtctgttatttcactctttaaattcagttagtagtgcagaacctagcacttagtagatactcaaaaattatttgctgaataaaaaaaggttaaacatgtaatatatacaaaatgtactggaaaaaaatgcaccaaacaattttgttataccagtttaatgtaaatattgcctttaaaagataatatagttttcaggtgtctacagtgattttgtaatatttgtgcacatataaaataatatttccaaaaatgtaatccagtggggaaatatactttctaaattctagatttataatttagggtttaaattataaaatcattaaataagacacaagtgaaatgtagtcaaatatccccttggaaaaaaattaagtggcctctaaagtgaggtattcatatatgtaattttacaatcctctagtgatagaattaattaaatacaccaccaaattgattaattcctactgtgttaaaagagaagcactaacaatgccagttaccatgtaacatggatttaagctacaagtcatagaaatgtgatgagaagcctcagcgctgtaaaacagagggtggaggaaagcttttcctctctcaaatgagctttgcgaggtatacttcttgaaggataggaagttgaagtgttcaggacttttatgtctattctactttggcttagtttacatgattcgtagtttattagcctagaaatggccaagaaaacttaaggttcaataattagttataaatatgaaatatccccgatttttaagataaaaacaacttataaatgtatttgtctgtaaaaattgtgtatatttttacagaacatctatttctttttttatttttttatatttatttattatgctttaaattctagggtacacatgcacagtgtgcaggtttgttgcatatgtatccatgtgccatgttggtgtgctgcacccattaactcatcatttatattaggcatatctcctaatgctatccctcccccctccccccaccccacaacaggccctggtgtgtgatgttccccttcctgtgtccaagtgttctcattgttcaattcccacctatgagtgagaacatgtggtgtttggttttttgtccttgcgatagtttgctgagaatgatggtttccagcttcatccatgcccctacaaaggacatgaactcatcattttttatggatgcctagtattccatggtgtatatgtgccacatgttcttcatccagtctatcattgttggacatttgggttggttccaagtctttgctattgtgaatagtgctgcaataaacatacgtgtgcatgtgtctttatagcagcacaatttataatcctttgggtatatactcagtagtgggatggctgggtcaaatggtatctctagttctagatccctgaggaatggccacactgtcttccacaatggttgaactagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatgggtctatttctttaaaacaaagggaggggagtctctcatttgcattagtttttttcatagccttttgaacttcacaatttctatgtttcagaacctatttcttacagtttttctatgctaaactctgtcctagtcagttctagagtgtatgaagaaccaaatgatgtaatagtatgccacctggctgtagtggaacaaatttgactcttaagtatgcaggctctaattttcctgtctggttttggcaagtattccttacataggttttttctttgaaaatctgggattgagaggttgatgaatgaaaattaatcctttcacttttttgtatataggtttgcaataattaggtcagagtggagttttaaggtcacggaggggtctgatgacttacaaataatgggctctgattgggcaactactcatctgagttccttccatttgacctaattaagcttgtgaaatttacactaagccatgagctcatctttaaaaagttttattaaaagattttcagctgttccaaatgggacttattactggaatgtgttttaaaggatcatatcagatgaatgaaaggtatttgatccttcgtttccttaataataaaatgatggtttggaaaaataggctacagtctaaccacagtgctattattaggctttcttgttaaacataggtctaagcctaagtatgtcaatacaacaaatacttactgtttcatttctagtaatgaaaaaaaaaaaaaaaacaagtctttctggcataaggatgattttcatctggttattttgaaacatttttgtaaaataaatttccatctataaagaacatttttatttgtaaggaggggtatgtctctgtgcactggaagagagggaggactaaatcactgggaagtcttatgataaagaagccattggcttaaatcagcgaagcaagccgtcccttggtttaaggtgtttttcctggccatcctgtcttgactagaactttacctacaccttcctttttggtttaggcaaattatagtatctaaaactaaagtctcagctctgtgtctttgacatataaatgttctaccatgtcttctctggaatctgataactatctatctctttaaaatgcaagtctagggagatgactcatcagaaaaagaagaaaaaagaggtatttggaaattgtgcaaattaaagcagcccctgatgtcaaagtctacacattcctgagtgagtcagttctggccagttctagctggatcaagagagctcttctgggcaggcctgaagagcacctgaatggcagccacctgaggagccaggtgcctgaaacttccttcacctgcttgaggagcgccaaagcccaggtgctggctggacaaccacttctggctgcctaagcagatggcagaagaaggaaacaaggtcagaggcagagtattgaaccctgcctcccaggtgggtggaagatgcctgtcgccaaactagggcccagcttgccgggtgagatgggtgaactggtgatcccccgagagagtggacgtcagaactacatgttcctggacttcacctcggccagcgaaggagagagagggttaatgttaactgcacgaggcccactctagccttaaattctgtaattcaaacccttcccttggagacaaaacaaacatgacaaggaattctgaggtcaggggacaagaatcacaaagtgggagattgaggaggcagtgtccttcctgcccttggtctactggctaagaaccttcctcagcctgacctttgcacattgcactttcagctctgtttgcaattttcctcctttagtgctgagggaatcccagtgttccatcctgaaatctataggttcctaatgggtggttaaaaaaaaacctcagcgagagaagcagaaaatgtttcctcttcctgaaaaactgtagaaaggcaggcaccattctgggtgaggacatggtccttgcaaatgtctttgtgttgtttttgtttttgttcttgtttttgagatgaagttttgctcttgttgcccagactggagtgcagtggtgtgatctctgctcattgcaacctccgcctcctgggttcaagcagttctcctacctcagcctcccgagtagctggaattacaggcacctgccaccacacctggctaattttttgtatttttagtagagatggggttttgccgtgttggccatgttggtctcgaactcctgacctcaagtgagccacccgcttctgcctcccaaagtgctgggattacaggagtgagccaccgcgtccagcctgcaaacgtctttaaagacagcgtgtttcagaggctgtgacagtgccctgtgaacatgccaattctcacagtcccgggagctctgaggagcaggcccggctccttgccaggctgatggtactgaaactctgctctccaagacataacctgatggccatgcaagatttcttaatcgactgtggaccgtgagagtctgcatctcattttaattaagatgggaaaagaaagaacaaaagagcaactcccaggttatagagaaagtggattttagtataatattcaagtgtagcattgctaataataacaaacctttcccctcccaaacggtaaacacttgcactgcctattatacaaaaattcaaccaccctctctgttaccccgatatctcctccccagtgaccccccctctcatgcggcctcatgagcctggccagtggtgaatggcactttcatgggcatgagactccacgtgagtgggactcagctgggacccctctccacgtgggagctggggaagccaccctagtagcagctcaaagtgtccgtgatgtccctgctgctgaggtaggggccgcctctgagctggtctcggggtgtgagctgctgctggtagtgggctctgccctgagggcctggtggctggtcagaagggcaggcacacatgggtgactccccaggaactcaggccacctccccaccacagccctgcactgtgtgctccaggcatgtgctgagtgcctggtcaatcaccagtgccctattgatcccagtctccagagagagcatttagtgtcactccacagaggggaaactcggcccagagaagtaaagtgactctccccagtcacagggctggtcagcagtaggatgggaggctagtcccttgctgtctgactccctgagcccacccatatcccaaggcagccaacctctgcccgccctggttcaggccccgactggcccctgtggtgggtgatgtctatcttcctggcctttgtgctcccagccaactgggatggagcctccagctggcatgacaggttgtagctacggacagaagagtggctgtgaggctgccaggaatctcaccagggccccctcccagggcctgtccagagtgaggtctgggtaccccaggcattgccagaccacaggatctgatgttggccaagaggccatggccacaggctttctgaggctggcccccagggagagttcaatcctactatcccaattcctgtcctggccttacctctcagtctcaccgagccacttcatggtcccaaaccaggacccaaagtgctgcttgggctcaaggttgtaattatttgcagccaactggagcagtggacctccttgcttactttgaattcctgggtccagagggaaaaactgggtgatgacagggactggacagggatgccacaggggccctgtgggggtgttagatggggtggtggccagtctttgctcataggggaccccctcctcctctccagtcctgtccccacctgttctcagagctggctcaaacagcagctcctccaggaatgtgtccttggtttcaacctggtactcccacctgcaggtcttcctggagtgtctcctctttctctctgtctccccataaatctaagacgagggggatggatctgcccactgctactcaccgtatgactcttgtgaggttgatcagtctcccctggaaggccaacagctgaagtccatcagaaagggtcctctggcccagagccagcccctgcccacccctgtcttgctgcacccagggtgcaagacccagatcaggtctgggtgacaggaggggtatagaggggctgaggctcaggggccttctagcctaacttgtctggagacagttggggaaactgagaccccaagcagggaggtatggctccgagagattattctcattaatctggaacatttttgcaagctgttaggtataggaagtctgtcacaggtaagagaaatgctttttaagagcatgagagacagcagggttgtgacaatattgaaacaccaccgtgcagattcaccaattgccaccaccgggagccccctgagagtcattgcagatgcacagccctcccctgcaacccctggacctccccgtggtctggcacctaaagggttatgcctcatggcaggaatcaggaccctcagggtgccctgcccactccaaggtctgcctctgctctgattggtcactgacattcagattgtcacccaaatataaggacattagcagaaagactcattcaatacaagtggactcagacatagataggaattgggttgcaagaagccccttttgtttcttttattttattttggaaaaaacttttattgtgaaaattcacatatatatatatatatatatatatgtatatataaactcaatcaatgcaaaaggatagacaatgaacaaatgaattccccttccactccagatccccaactcagatccagacctcctgagcccacttcccccatctcatcacagatccagacctcctgagcccactttccccatctcatcacagacccagacctcctgagcccactttccccatctcatcacagatccagacctcctgagcccactttccccatctcatcacagatccagacctcctgagcccactttccccatctcatcacagatccagacctcccccactttccccatctcatcacagatccagacctcctgagcccacttccccaactcatcaccagtgatttcttgggctctgcattagttttctattgctgctgcaaccaacagctacagactcagtggcttccatttctgtcttatagttctggttgccaaaagtcctaagaggatctcactgggctaaagtcaaggtgctggcggggctatgtcccttctggaggctcaagggatgaatcgggtccctgccttttctagcttctaggggctccagcttctaggtttgtggcctccttcctccatcctcaaagccagcaacagcaggtgaagtcctcgcccatcatgcatcactctcccttcttcctccttcaacttttttttttatatttagggggaacgagtaccggattcttacatagtcaaaaagctccttatagagaagctcggaactttcaatacaactttgccttttctgccattttaattttccatttaatttaaatgtattctctcatttgaccttcatactctgtggagaaatattcctatttcggcttgtattgacaagctgttttcacacagcccccacatcacccaaccaaccagcaagaaacagataaagaaactgaggcccagggaggctaagagtcctgccaggatcattcacctttcaaggtaaggagccagttccagacctgggtttgtgcagctccaagctcccccgtctttctacaatgctagatttagactatagcaatctagcaagtgtggccacacaatgatcaagttggatttagatgatgttccctataaatccattctcctctcccgtgtaagcaaggcaaagtcctccaggccatggggagtccctgaagactcgatgaactgcagtggccacatcaggaggttgcaggttgaccagaactcaccgacacagcaggagagcagcttggaacctgcaacctagccaaaacctagtgccttggattgggggagaaaacaggcagccattcctctctctctgctggctagaggggattctggcttttcctgccagagccacccctttccctcctcctaaagttgatggtggttctttaaggaaagggagaagtgcacggtgtgatagggcaggaagagaagaaaatggaggagaggaggggactttcccataagcaggcagaagaaaaggcagctgtggtgtgtgatggacatggatgcagtggtgtccaatgtggggtcagccctagaggagagacagagagagagacagaaaagtgagagtcctgacccttacgattaacatgggatctgcctgcaaatgctgtttagggccatcgcctcttcctgtactgctatttttgagagtgatgctcctgagccccatgacccagtcaaatttgatgtcccctcgagccagattcagtgctgggagtccagtgtgatctgcctggatcttgctgcattgagaacaggccagtcttgaccccaatacaggggctggatatgaacaggcaacagctgggtttctgagtcagaaagacttggttaattgctaattgcttaggcgagtaatttaattttgttgagtcagattcttcagctacaaaatgcagatgacagtacttattcctccaggttgtggggaaaatggagattctaagcacgatgtccatttcacagaaaggtaccaatttggtggcttattttcctttctaccttcagaagtggctatccctgccacccaaacagacccttgactctcaagtggacggggtcccatttgcacagggggagaccttacagcctacgttgagtctatacttaccacttagtgagcattgtgtccgctcaggggcctctgtgggcatccgtctcctctgcagcatctttcctccccactgctgggtctgcacatgaccccctccttgggttaggcctctgatcagtgatgaccttggtatggtggtgatggtcagtcttggcatcaaatgagccagtttatatcatcagctattcaataaaatactaatctaggtgtcaccgtgaaagtattttgtgacattgttatgtacgtgttgttacaaatgtgcatgatgcatttactacagcatagaattttgcctgggtgccagcctgaagtctgtccgacagatcatagccatgttagtcccacagtcacaggggccaattgattaaattattttatctcccttgaaaactaaaaataaaatcctaagccccccacccgacttaacagaccccctgttggccaacggaacctcaaataaatcttaaaattcagttcttggccatgacaggacaggaggtcagacatacctccctgtacctccctccctcttatggtttagaccccacaactgaacagcattaatgttaaaatagagatcatgagactgacagaacagactctttgtggcaataagacctcaaattataaacaggagctagggccatgccaggcgagcgttaagtcttgtaccctactcttaaagaattaactagattctaactaccacgtgggttttatttttctctagcaaccaagcaagcactggctgtgagagaagcaagattaaaacaattacaactcacccagttcacagacgctgagtaactgatctcctgccccactaaccttaatgacagctttctctggacaagggactgatttcagtaactttctcctgataagagaccatcctccatggactggttctggccagttttggaggctgtgcctgtacagaggctgagtaccttcatgtccctgcttcactttttgatgtgtagggcctaattataatacatttaaatgtcaagtctccaccccagaatgaacatgcatgtttatggaatatgcatgcattaggacctcttttatgagtattctcataaaatgatatagctcctctgatatcctattgagtatgtatatgtagccaattcatttggctcaaattcctgtcctctccttccctccctggaaatgcctgcctctggccttggctgtaggccacacttcccagcctgtcataatggccaccttgcagactgcaaacctatataagaaataaagctctcttttctaaatttataaaattgtgtgatttttcagttgatgctctctttctacacacacacacacacacacacacacacacgcaatttatacagaaggaaatctggagaatatatgtgggaatggatattaagtgtgtggcaccgtggtggaagtaacataaagttggattaggctaaatttattaatgttggcccactaaacagagattctggactcagggttgtaggtcaaagctttagaaagggctccaagggttggtttgatcggttacttggttggttgcttgcttggttggttggtgcttgcttccttgcttggttgtttggttggtttgttgcttgcttgcttgttggttgattggttggctgtttgcttgtttggtgacttggttggttggctgaaacagaatcagagtttacctaaggtacataaagttgagatgccacaacttccttggtttatgtgtacagaaaggtatgcaaaaactcagggagactggatttattatgtcagacctgctcactcacactggagggtctacggaacatactcctcacaacgatcatgagaaagaatattgtgagaggagcccagtatcctggaagagctttgagcttgtgctctcagtaggcaaaatgttacagcaggaactgcagccactggactgggatctttaagtaaaatgaggataattgaatcctggggtggcagggaacatgggctgtccttaatcaccaaagatgaggtgggtgtggtcaccacagtggaaagcagtgtcaaagcagcagtcagaatggtttgactcacagacacccacggcattgtgtagtccatggtatccacagggagagctaatgggctgtaccaaagtcttagttgttctttaaaaaatgaagaattctaggtcaactgaataaaagactaactcaaattaatgaaacacagatctaaaaccctcaatcaattcccagacttgagccagttcacaggcccacaaccccttaagtgaaggggaggctgggtgatcttggggaagtacgctgctacgttgccaaaaatttacattgttaatctttttcccagtcttccccaaagggacttacagccttctgccaggatgactgtgacttaaagaaaagaaaattctcagatatttggggaattactggacactggctctcatttgacactattatcactatgttgcctaggatggattcatgctcctgggttcaagcagtcctcctacctcagcctcccaaagtgctgggattacagacatgagccactgtggccagcagagctttgaaactagaacatggaggtccagtggtaaagatttgacaagtctgggaagagattgggccaaggcaatgttgatgattcttttttttttttttttttttttttttacaacagagtcttgttctgttgtctaggctggagtgcaatggcgcgatctcggctcactgcaacctctgcctccggggtccaagcaattctcctgcctcagcctcctgagtagctgggattacaggtgcccaccaccacaccaggctaattttttatttttttgtgttttttgagacagagtctcactctatatcgcccaggctggagtgcagtggcgcaatctgggctcactgcaaaccccgcctctcaggttcatgccattcttctgcctcagcctcacgagtagctgggactacaggtgcctgccaccgtgcctggctaattttttgtatttttagtagagacggggtttcatttcaccatgttagccaggatggtcttgatctcctgacctcatgatctgcccgcctcggcctcccaaagtgctgggattacagggatgagccaccatgcccagccacaccaagctaatttttgtatttctttttttagttgagacagggtttcaccatgttggccaggctggtccctgaccttgtgatccacccgcctcagcttcccaaagtgctgagatgacaggcatgagccaccgtgcctggccaatgttgatgattctaaacagcagccgttaatgtgaaaaccatccaactggaagccctggccttgcccagaggacacagtctgggtggtgggcagagacttcagctgccttccaaggcaagcagctccttgctgcccgcttgctggggattttacttacagggcagaagctggcaggtgatttgggggcaggaattgcttcctggatggtataggatgaaccacactccccaggaaggcactcatcctggtggcctaacagaagcagccctcaccccaaaaggcaatgctgctccactagttttatggggtgactccttcctgtaggttccttccagctttaccagaaacacagaacatctttcctgacagggcattggttttgtttttgaacagagagatccttcttttaaaaagttagttttttgttttgttttgttttgttttttgtaatggaatcaacctaggtcctaagcctagcaggttgttattattatttttatgattattttttgagatggagtcccactctgtggtccaggctggagggcagtggcacgatctcagctcactgcaatgtctgcctcctgggttcaagagattctcctgcctcaacctacagaggagccaggattacaggcatgcaccaccatgcccggctaatttttgtacttttagtagagatagggttttgccatgttggccaggctgatctcaaactcctgacctcaggtgatccacgcacctcagcctcccaaactgctgagaatacaggtgtgagctgccatacccagccacaggttatttttgctgatcttctccctcctcccaccctcaaagaaaacgcggtacatctacaccatggactactacgcaaccctgaaaaggaacaaaatcacggttggtttttttttttttttttttgcagcaacatggatgtagctggaggccattatcttttttaattatttttattattttttttctattctactttaagttctggggtatatgtgcagaatgtgcaggattgttacatagatatacatgtgccatagcggtttgctgcacccatcaacccatcatctacattagatatttctcataatgctgtccctttcccagtcccccacccctgcagtaggccccagtgtgtgatgttcccctctctgggttgatgtgttctcattgttcacttcccacttatgagtgagaacatgcactgtttggttttctgctcctgtgtcactttgctgaacatgagggtttccagcttcatccatgtccctgcaaaggacatgaactcatctttttcatggctgcatagtattccacagtgtctatgtgctacattttctttatccagtctatcactgatgagcatttgggttggttccacatctttgctattgtgaacagtgtggaggccattatcttaagtaaattaatagaatgctgcgtgttctcacttataagtgggagctaaatgttgtgtatatgtagacacagagaagggaacagatattggggtctagttagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccatcatttgcaccagcaattccaagactgggcatctacccaaaggaaaagaagtcattctaccaaaaagacacatgcatggtaaagttccttttttttgtttgttttttgagatggagtctcgctctatttcccatgctggagtgcagtagcaatctcggctcactgcaacctctgcctccagggttcaagtgattctcctgcctcagcctcttgagcagctgggattacaggcatgcgccaccatgcctggctaatttttgtatttttagtagagacagggtttcaccatattgaccaggctggtctcgaactcctgacctcaggtgatctgcccaccttggccctccagagtgctgggattacagtgcctggccctgtaaggttcatcacagcacgacttacaataggaaagtcatggaatcaacctagttgcccatcagtggggtaccggataaagcaaaagtggttcttctacagcatcgaatactacacagccatgaaaaagaacaaaatcatgtcctttgcggccacatggatgtagctggagggcattatgcttaatgaattaacacaagaacagaaaatcaaataccacatgttcttgtctggataaagcaattgtggcccttctacaccatggaatactgcacagccatgaaaaagaataaaatcatgtttttgcagccacgtggacacagctgaagggaattatgcttagtgaattaacgccaggaaaagaaaatcgaataccacatgttctccactagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaacgccaggaacagaaaataaaacaccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttgggtcacggatttttctgttgcattttcttgcttgtttgttttctatctctctctctctcttttttttttttcttttttttgagatggagtctcactctgtgacccaggctggagtgcagtggtgcaatctcggctccctgcaacttctgcctcctggattcaagcaattcttctacctcagcctcccaagtagctgggactacaggcacctgccaccacacctggctaatttttgtatttttagcagagacggggtttcaccatgttggccaggctggtctcgaactcctgacctcaggtgatctgcctgccttggcctcccaaagtgctgggattacaggcatgagccactgcacctggccctcttcttatatatttctagaactcctctcgaatttggggtttgtttttcttaattacaaggaatcaagttgaatcattagtgcatatataaatatacattttattttagtacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcctcacgcccaggggacactcagaatgtcgtttgcagaacacgggttgtttttcttagaaacgccttgcaaaacaaaataggaagcaaaatctttctcactccttccactccataatagacaaaataaaatgagggggcaggaatccagagactttgaccacagttggcagatttattgtggtacagacatgaaggcaagcagtgttctctctgattctacgaaccgtacagcccgggccagctgccttctgctttctggatggtgcaggcgtgagctccaagcccaaatttcactggagctccaagaatcgagcctggcccaggcactcactgcacgggggccaagcgtgaaaccagtgatcgctccagcaaggtaacaggacagcttggtgatccttcttgccggccacaaaaggttatagccagaattccaccgaatgtggtctttctgtgtctctccccagatagtgaagctgcacaaacctgggggtggggggtggggggtgctgacctcagtggggtgtcctggagaggcaggaaccagagtttacagggtgcagatcctactgaagcaaatggacgtggcatccgtgggcagagctggctgtggctggccttccagcctggatgtctcccccccccccgcctggggtgtcaccaaatgcacccagagaccccttctaaacctggggggatgtgctgacctcagtggggtttcctggagaggcaggaagctgggtttccagggtacatatcctactgaagcaaatggacgtggcatccttgggcagagctggctgtggctggccttccagcctggacgtctcccccactgcctggggtgtcaccaaatgcacccagagacctctcttctgaaagcccattcatgggaagcctccaggtctcctcagcaggcagcatcacgtctgatttcactgcgttatcaggtaatgcaggcctgttctacctgtgtgcgtgagcgcgtgtgtgccgtgtgggagtgtgtgtgttgatgtgggtgtgggtgtgtgcttgtgtggctgtgtgtgtgtgcctgtttatgtgatgatgagtgtgtctgtgagtctgtaagacaacgtgtgtttccatgcgtgtttctgtgtgagcgtgcattcctgtgttttatggaagtgtgtttttgtgatggtgtttttgtgtgcacctgcgtttatcgtatttgtgtgtttgtgaatatgagtgtatgtgtgtgaatctgtatggcaatgtagaaattcttttttttttttttttgagacggagtctcgctctgtcacccatactggagtgcaaaggctcaatctcagctcacagcaacctccacctcccgggttcaaacgattcttctgcctcagcctcctgagtacctgggattacagacacccaccgccacatctggctaatttttcttttttgatatggagtctcgttctgtcacccaggctggagtgcagtggcgtgatcttggctcactgcaacctctgcctcccaggttcaaatgattctcctgcctcagcctcctgagtagctgggattacaggcataagccaccacatctggctaatttttgtatttttgagtagagatggggtttcaccatgttggccaggctggtctggaactcccgacctcaagttatctgcccgcctcggcctcccaaagttctgggagtacaggcgtgagccaccttgcccggccccagtgtgtgaatttttatgtttgtgtgtctacatgattatgtgagtctttttgtgactgtgtttccatgagtgtgtgactgtatttatgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcctaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttaatataaacatgatttttatagttcatataaataaagttatatatagtgtatatgtaaaatatacttttatttgtgatacataattttatagattaaattttatatactaagcaaagttacatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgtgtgagtacatcagtgagtgtgtgaatgtgtgtgcatgtgtgcctgtgtttgtgtgagtgtaagagtgttgtacatttatacactcacattttgttttctggttaataacaagatctatctttgatttaggatatgaagaattcttataagcaaccccccacacaaaatttgtatttattttaaaatattcttaaaatatgggttcttttatttttgcacaaacagacaagagtgttttttctttccaaaacttttatttcaaattctgaccctgaggagcagaaaaagaagaaaacattgtgtaaccttatatacattagaaacataagtagttactaaatgcaatacagattttgacaacatgcatttaggaaaaatgaggaattcaaactcgtagctgcctcaatattgaactttctaaagtttaattttttttaattaaaaaatattcatttgggttcaatatgtatggatctccagggcagaaatgtctctccaaaaagtgaaccactctgaaaatcaccgtcatttgggaaagggtgatgccccagctgtcttctgaaaaatagcagaggcttccggccagtggggtgtctctctctttccctgaggccgaaatgtcagggaatttttcttccccacccctaggagcccagtaaatgcagaatatttcagaaggatttgcacagggtcccggcttctgctatttatgagctccatggattcttggctcaggcttgtgatcagctcacctgctccagaatcacttcccatcttagcttctgggctaagacacctcaaaaccagcaaaggaaagtcctcactggtcaacgcgtccatcccaactcccccatctccccttagggtgggtttggggttcgggactgctttactgttcctttcaaagcagactgggaggtaagattttattctgcttccagaggttcaggatttctgcagacggtcagcaactctttgcatcctactggtaaaagttttatatactttgtatttatagaaatacgcattgtgtatattttatatgaatagattgatataaattattttagtaacttaaccatatgacttttatatttttatataaataaagttatatgtagtgtatatgtaaaatacttttatttctaatacataattttatagattaaatttaatatattaagcaaaaatatatgtaacatatataacatataacatcatttctataatatataacttaatgtaaataagtatataaaattgatattatatttgttaatacataattatacatatatactgtgtaaaaataaaattacatattgtatatgcataattatatttctataagtacaattatatactatgtataattatgtataaaataattgtataataaaattatataataaattttgaaacgttataaattattatacatagtattttattgtattaaatttagaaatgtgttatatgtaataaaattttattataataaatgtagattatataaaatcttatttataataaattaccttatgtataattataatatgagaaaataattacatatcattgtattataataaatttagagatgttatacattattacatataaaatttcattatattaaatttagaaatatatgtaataaaatggtattatgttaaaatttttatgtaacattttattatacatgtataattttatataatgttttataatatatagaatataagtacacagaatataagtacaaaaatatttatatacagctacacgtaatataaatacatcagtgtaagatgttttgtgtgtgtgagatggagtctcgctctgttgcccaggctggagtgcagcaacacgatctcgtctcactgcaacctctgcctcctgggttcaagcgattctcctgcctcagcctcccgagtagctgggattacaggcatgcaccaccacacccaatcaatttttgtatttttagtagagatggggtttcactgtgttagccaggatggtctcaaactcctgacctcaggtgatccacccgcctcggcctcccaaagtgctgggattacaggcatgagccacagtgtaagatactagctattaaaaaataaatatatatatatactgcaacagctgatttgtctggaagagtttggtcagaagacagtgtattaagaagactgtgagttcccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacagcataaacataaagtacaaaaatatttgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatattatataattaatatattctatgctatataatatataatatattctatgcaataaaatatatagcatatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatatagcaaccggtgatttgtctggaagactggtcagaagacagtgtattaggaagacaggcagtctccgcaggaagcatggtgcaggtgggatctggaggtgactctgggctgccagaagacgccccactgctttgcggcagacacaggtggagaggtcctctctgtagcttcagcatggacagtgtgtgtgtcttgctgtgggaacacttctttctgcttccctctccactgtgaccccatcacactcactgacctgccctcctccttcctctcgctctccggggcccctgtggaaagagggtcttccctccgtgcagcaggaacccccaggaccatccccatgctcctgggttctgaacttcagggacatatgatcctacctgaccgggcacaggctctgttcaccctcaggaacccctgtcctcccaggccaccgtggactggagaactggcctcctgaaaatccagagagaacttagcactcacaacttctttctttttttcttttttctttgagactggatcttgctcttttccccaggctggagtgcaatggcatgatctcagctcactgcaacctcctcctcccaggttcaagcagttcatcctgcctctgtctcccgagtatctgggatcacagtcatccacccccgcggccaactaatttctgtatttttagtagagacggggtttcaccatgttggccaggctggtctcgaactcttgacctcaagtgatccacccgcctcggcctcccaaagtactgggatgacatatattagcatgatgtatattcttctattcctccggggactcactgtcttcttgggcagtaaaccactgtgcccggacttctctgtccacatctgcacacatctaaacctctgtagattctgaattgtttttccttttgcacagaatgagaggaactgaagtcgggaggcccagccccaacacggtccctgtggctctgtgctcaggtggtttatggctgagaaggacttggggggttgagggcttcctatcagcccaggagacattacctgggtctgggaagcctgctctgcacttgtgggtctcgaattgtctgttgcatttacctgcctcattattttttcttcctgtctctcttcttacatatttctttcgaatttggagcttgtttttcttaactacaatcaacttgaatcattactgcatatataaatataaattttatattgagtagacattatatactcaatctactacacattccaacacgggccatatctaagacgaatatttatatttaatgtttaaaatatgtttacatttcatatagaaaaatatatttatatttaatatatatgtgtatatttaatacaggaaatatatatttatatttaacatataaaaatatatgtttatatttaatatgggaaatatatgctttgtttaatatacataatacatgttgatatttaatatagaaaaggtatagttatatttactatgcaaaatacatgtttatatttaatatagaaaatatgtttatatttaatgtacaggatacatatttacatttaatatagaaaatacatatttatatttaacatacacagtatttatatttaatgtataaaatatgtttacatttaatgtgctgaatatatgcttatatttaatgtctaaaatgtctatatttaatgtactgtatacattaaatgtaccaaatgtattcttatatttaatgtataaaagaagtttatatttaacatataagatatgtttacatttaatgtataaaatgtttatgtttgatgtataaaagatgtttatatttaacgtatacaatttatatttaatgtaccaaatatattattatatttaatgtccaagccagccaagccagtcagccaagccagctaagccacccacccagccaagccagccaagtgagtcagctagccagccagccaagccagccaaaccagccaagccagtcagccagccaagccagccaagccagccagccagccaagccagccaagccagccaagcaagccagccagccaagccagccagccagcccaggagccccagccagccagccaacccaaacagccaagccagccaagccagccagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccagccaagccagacaagccagccaaccagccagacagcccagccagacagccagcccaggcagccaagagacccaagccagccagcgaagctggccaacccagccaagccagtcagccaagtcagccaagccggccacccagccaagccagccaagccagccaagccagtcagccagccagccagccaagccagccaagccagtcagccagccagccagccaagccagccaagcctcccagccagccaaaccagccaagccacccagccagccaagccagccaagccacctagccagccaggcccgccagccagccagccagcgagccaagccagccaagccagccagcctgccaagccagccggccagccaagctagccaatccactcagccactcaagccagccaagtcacccggccatccaagccagccaagccagtcagccagcccagacagccaagccagccaagccagccaagcccgccaaccagccaagacaggcatgctagccaagccagccaggcagcgaagccagccaagccagccagcaagcaaagccaggcatgtcagccaagccagccaggcagccaagccagcaaagccagccaagccagccagccagccaagccaggcatgccagccaagccatccagccagctaagccagccggctagccaagccagccaagccacccggccagccaagccagccagccaagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagcccagacagccaagccagccaagccagccaagcccgccaaccagccaagacaggcatgctagccaagccagccaggcagcgaagccagccaagccagccagcaaggaaagccaggcatgtcagccaagccagccaggcagccaagccagccaagccagccaagccagccagccagccaagccaggcatgccagccaagccatccagccagctaagccagccggctagccaagccagccaagccacccggccagccaagccagccagccaagcctgccaagccagccaaccagccaagccagccagctagccaagccacccagtcagccagctagccaaaccagccaagccacccagccagccaagccacccagccagccaagccagccaagccacccggccatccaagccagccaagccagtcagccagcccagacagccaagccagccaagccagccaagcccgccaaccagccaagacaggcatgctagccaagccagccgggcagccaagccagccaggcagcgaagccagccaagccagccagcaagcaaagccaggcatgccagccaagccagccaaccagccaagccagccagctagccaagccacccagccagccagccagccaaaccagccaagccacccagccagccaagccacccagccagccaagccagccaagccaatcagccagccaggcagccagccacccagccagccaagccagccaagccagccaagccaatcagccagccaggcagccagccacccagccagccaagccagccaagccacctagccagccaggcccgccagccagccagccaggcagccaagccagccaagccagtgaagcccgccagccagccaagacaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagccaagccagccagctagccaagccacccagccagccagccagccaaaccagccaagccacccagccagccaagccacccagccagccaagccagccaagccaatcagccagccaggcagccagccacccaagccagccaagccagccaagccagccaagccacctagccagccaggcccgccagccagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagcccgctggctagccaagccagccaagccacccggccggccaagccagccaagccagccaaccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccagccatccaagccagccaagacagccagccagccaagccagtcaagccagccatacagccaagccagccaagccaggcaagccacccagccagccaagccatctagccatcaagccagtcaggccagccagccagcctgccaagccggccacccaccaagccagccagccatccacgccagccaagccagttagccagccagccaagccacccagccagccaagccagccaagccacacagccagccaagccacccagccagccaagacagccaagccacacagccagccaagccatccagccagccaagacagccaagccagccaagccatccagccagccacgcaagccaagccagccagccagccaagcaatccgtgccagccaagccatccagccagccaagcgaggtgtccggccaagccaccccaccagccaagccagccagccagccagccagccagccaagccacccagccaactaagccagccaaaccacccagccaggcatgccagccaagccacccagccagccaagcctgtcagccagcgaaccagccaagccagccatgccagccagccagccaagccatacaagccagccagccagccatgccaggacgagactccatctcaaaaaaaataaaaaaaaaacagcctggccaacatgatgaaaccccgtctctactaaatgtataaaaaattatctaggcgtggtggcacacgccagtaatcccagctactcgggaggcccaggcaggaggatcgctttaaccagggaggtggaggttgaagcgaaccaagattgcaccacctcattccagcctgggcaacagggtgagactcaatctcagaaaaagaaaaaaaaaaaggccagcctggccaacacggtgaaaccccatctctactaaatatgaaaagaaattagctgggcgtggtggcacatgaatgtaatcccagctactcgggaggcccaggcaggaggatagcttgaaccctgggggtggaggctacagcgagccaagattgcaccactgcactccagcctgggcaacagggcgagactccatctcagaaaaaataaaataaaatagaccagcctggccaacagggtgaaaccccatctctacaaaatatacagaaaaattagctgggggtggtggcacacacctgtaatcccagctactcgggaggcccaggaaggaggatcgcttgaatcagggaggtggaggctgcagcgagccaagattgcaccactgcactccagcctgggcaacagagtgagactccatctgaaaaaacagaagcattccagcctggccaatagagcgagactccatctcaaaaaaaaaaaaaaaaaaaaaaaaaacaccagcctggccaacatggtgaaaccccgtctcttctaaatatacaaaaaaaatagggccaggcgtggtggctcatgcctgtaatcccagcaccttgggaggccgaggtgggtggatcacgaggtcatgagatcgagaccagcctgaccaacatggtgaaaccccgtctctactaaaaatagaaaaattagctggatgtggtggcacatgcctgtaatccctgctactccggaggctgaggcaggagaattgcttgaacctaggaagcggaggttgcagtgagccgagatggcgccactgtactccacggtggtgtcagagtgatactacatctcaaaaaaaaaaaaaatagctgggtttgatggcacacacctgtaataccaggtactcgggaggcccaggcaggatgatcacttgaacccgggagggggtggttgccgtgaaccaagattgtaccactgcactccagcctgggcaacagggcgagactccatctcaggaaaaaaaaaaaaaaaagaccagcctggccaacatggtgaaaccccgtctctactaaatataaaaaaaattacctggatgtggtggcacatgcctgtgatcccagctgctcgggaggcccaggaaggaggatcgcttgaacctgggaggtggaggctgcagcgagccaagattgcaccactgcactccaccctggataacagaattagactctatatgaaaaaaaagaagaactccagccagggcaatagagtgagactccatctcaaaaaaaaaaaaaaaaaaaaaaaaagaccagcctggccaacatggtgaaaccccgtctctactaaatacacaaaaaaattagctgtgcgtggtggcacacgcctgtaatcccagctactcgggaggcctaggcaggaggatcgcttgaacccgggaggtggaggttgcagcgaaccaagattgcaccactgcactccagcctgggcaacagagcgagactccatctcaggaaaaaaaaaaaatatcagcctggctaacatggtgaaaccccgtctctactaaatatacaaaaaaaattagctgggcgtggtggcacacgcctgtaatcccagctacccgggaggcccaggcaagaagatctcttgaacccagaaggtatatgctgcagcgagccaagattgtcccaccgcacttccgcctgggcaacagagcgagactccgtctcagaaaaaaaaaaaaaaaaaaaaaacaagaacaggttggccaacatggtaaaaccatgtctctactaaatatacaaaaaaattagttaggcatggtggcacacgcctgtaatcccagctactcggaaggcccaggcaggaggatcgcttgaacccgggaggtggaggctgcagcaaaccaagattacaccactgcactccagcctgggcaacagggcgagactccatctcagaaaaaaaaaaaaagaccagcctggccaacatggtgacaccccgtctctagtaaatatataaaaaaattagctgggcatggtggcacacggctgtaatcccagctactcgggagccccaggcagtaggatcgcttgaacctgggaggtggaggctgcagcgagccaagatagcaccactgaactccagcctgggcaacagggtgagactccatctcagaaaagagagaaaaaaattaaaaaaagaccagcttggccgacatggtgaaacctcatctctactaaaaatacaaaagtattagctggccgtggtggcacacgcctgtaatcccagctactcgggaggcccaggaaggaggattgcttgaacctgggagtttgaggctgcagcgagccaaaattgcaccactgcactccacccgagtgagactccatctgaaaaaaagaactccagccacggcaatatagcgagactcaacctcaaaaaaaaaaaaaaaaaaaaaaaaaacaccagcctggccaatatggtgaaccccgtgtctactaaatatacaaaaaaattagctgggtgtcacggcacacgcctgtaataccagctacttggtaggcacaggcaggaggatcgcttgaacccgggaggtagaggctgcagtgagccaagattgcaccactgcactccagcctgggcaacagggtgagactccatctcagaaaaaaaaaaaaaacaaaaagagcagcctggccaacatggtgaaaccccgtcaatactaaatatacaaagaaattagctgtgcatggtggcacacgaatgtaatcccacatactcgggatgcccaggaaggaggatcgcttaaacccgggaggtggaggctgcagcgagccaagattgcaccactgcactcgagccagggcaacagggccagactccatctcaaaaaaaaaaaaaaagaccagcctgggcaacatggtgaaaccccatctctactaaatatacaaaaaaattgctgggcgtattgctacacacctgtaatccccgctacttgggaggcccagacaagaggatcacttgatcccgggaggtggaggctgcagcgagccaagattgtaccacagcacttcagcctgggcaacagagcgacactccatctcagaaaaaaaaaaaaaaaaaaaaaagaacaggttggccaacatggtgaaaccccatctctactaaatatacaaaataattagctgggcgtggtgacacacacctgtaatcccaggcaggaggattgcttgaacctgggaggtggaggctgcagccagccaggattgcaccactgcactccaccctgggcaaaatgtgagactccatctgaaaaaaaagaagcattccagcccgggcaatatagcgagactccaactcgaaaaaaaaaaagaccagctggccgacatggtgaaaccccatctctactaaatatacaaaaatattagctgggcgtggtggcacatgcctgtaatcccagctactcgggaggcccaggaaggaggatcgcttgaacccgggaggtagaggctgcagcggagccaagattgcaccactgcgctccatcctgggcaacagagtgagactctatatgaaaaaaaagcactccagcctgggcaatagagcgagactccatctcagaaaaaaaaaaaaaaagaaagaccagccttgccaacatggtgaaaccccgtctctactaaatatacaaaaaaattagctgggcgtcatggcacacgcctgtaatcccagctactcggtaggcccaggctggaggaatgcttgaacccgggaggtggaggttgcagcaaaccaagattgcacctctgaacgcctgcctgagcaacagggtgagattcaatctcagaaaaaaaaaaaaaaaaaaaaaaaagagcagcctggccaacatggtgaaaacccatcaatactaaatatacaaagaaattagctgagcatggtggcacacgaatataatcccagctactcgggaggcccaggtaggaggatcccttgaacccgggaggtggaggctgcagcgagccaagattgcaccactgcactccagcctgggcaacagggcgagactccatctcaaaacaacaacaacaacaacaacaacaacaacaaaaaacagcctgcccaacatggtgaaaccccgtctctactaaatatacaaagaaattagctgggcgtcatggcacacgaatgtaatcccagctactcgggagtcccagacaggaggatcgcttgaacctgggagttggaggctacagcgagccaagattgcaccactgcactctgctctgggtaacagagtaagagtccatctgaaaaaaaagaagcactccagcctgggcaacagagagagactccatctcagaaaaaaaaaaaaaaaaaaaaaaaaaaaaaagaccaggttggccaacatggtgaaatcccgtctctactaaatatacaaaaaaaattagctggacgtggtggcacaggcttctaatcccagctactggggaggcccaggcaggaggatcacttgaacctgggaggtggaggctgcagcgagccaagattgcaccactgcactctggcctgggcaacagagtgagagtccatctgaaaaaaaagaagcactccagtctggtcaacagagcgagactccatctcagaaaaaaaaaaaaaaaaaaaaaagaccaggttggccgacatggtgaaaccccgtctctactaaatacacaaaaaaattagctgggcgtggtggcacatgcctgtaatcccagctactcgagaggcccaggcaggaggatcgcttgaacctgggaggtggaggctgcagcgagccaagactgcaccactgcactccggcctgtgcaacaaagtgagactccatctgaaaaaaaaagaaacactccagcctgggcaatatagcaagactccatctcaaaaaaaaaaaaaaaaaggaaaaaagagcagcctgtccgacatggtgaaaccacgtctctactaaatatgcaaaaaaattagctgggcgtggtggcacacgcctgtaatcccagctactcgggaggcccaggcaggaggatcgcttgaacccgggaggtggaggttgcagcgaaccaagattgcaccactgcactccagcctgggcaagaaagtgagattccatctgaaaaaaaagcactccagcctgggcaatatagcaagactccatctcaaaaaaaaaaaaaaaaaaagaccagcctgtccaacatggtgaaaccccatcagtactaaatatacaaagaaattagctgagcgtggtggcacacgattgtaatcccagctactcgggaggcccaggcaggaggatcgcttgaactcgggaggtagaggctgcagccagccaagattgcaccactgcactgaaccctggacaacagagtgacactccatctgaaaaaaaagaagaactccaaccagggcaatggagcgagactccatctcagaaaaaagaaaaaaaaagagcaccttggccaacatggtgaaaccccgtcagtactaaatacacaaagaaattagctgagcatggtagcacacgaatgtaatcccagctactcgggaggcccaggcaggaggatcgcttgaacccgggaggtggaggttgcagcgaacaaagattgcaccactgcactccagcctgggcaacagagcgagactcccactcagaaaaaaaaacaaaatgaaaaaaaacaccagcctggccaacatggtgaaacaacgtctccactaaatatacaaaaaaaatagatgggcgtggtggcactcatctctaatcccagctactcgggaggccaacgcaggaggatcacttgaacacaggaggtggaggctgcagctagccaagtttgcaccattgcactccagcctggcaaaccaagccagccaagccaaccagccaagccagtcaagcgacccagccagccagccagccagctaagccacccaaccagccagcctgccaagccagccaagccagccagccagccagccggccaggcagccaagccaagccagccaagccagctagccagccaagtcagccaagccagctagccagccaagtcagccagccaaaccagccaagccacccagccagccaagccacccaagacacccagccagccagccagccaagccagccaagccacccagccagccaagccagccaagcaagccagccaagccagccaagccagccaagccaggagccagccaagccagccaagccagccaagcctgccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagcaagccaagccagccagccagtcaagccagccaagccagccagccaaccaggccagctaaaccagccagcctgccaagccagccaagccagccagccagccaggccagccagccaaacaaggcaccgcagccagcccagccagccacacaagccagccaagtcagccagccagccaagccagccaagccagcccgccaaggcagccatgccagccagccagccaagccagccaagccagccaagccagccagccacccagccagccaagccaggcagccacccagcaagccaggccagcctgccacccagccagccaagccagacaagccagccaagccagccagccacgcagccagccaggacatccagccacccagccagccaagccatgcaagccaacaagccagcccagacagccaagccagccaagcaagccagcaagccagccagccaagccagccagccaaaccagccaagccacccagccagccaagccacccaagacagccagccagccagccagccaagccagccaactagccaagccagccaagcaagccaccagccaagccagccaagcctgccagccagcagagccagccaaccagccaagccagccagccagccacttaagccatccaagcaacccagccagccaagccagccaagccaccgacccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagcctgccaagccagctagccagcccagacagccaagccagccagccagccaagccagccaagccagccagccagccaatctagccaagccagccaagccagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccgccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagctggccacccagccaagccagacaagccagccaaccagccagacagcccagccagacagccagcccaggcagccaagagacccaagccagccagcgaagctggccaacccagccaagccagtcagccaaaccagccaagccggccacccagccaagccagccaagccagcgaaccagccagacagccctgccagacagccagcccaggcagccaaaccagacaagccagccagccaagccagccaagccagccagccagccaagacaggccagccaagcaagccatggaagccagacagccagccagccaagctagccaacccagccagccaagctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaacccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagccccaagccagccagcaaagctggccaaaccagccaagccagtcagccaagccagccaagccggccacccatccaagccagacaagccagcaaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccggccaagccactcagccagccaagatggccaagccacccagccagccaagcctgccaagagacccagcaacccaagccagccaagacacccagccagccaagctagccaagacacccagccagcgaagccagccagccagccagccagccaagccagccaagccacccagccagccaagccaggcaaacaacccagccagccaagccagtcaagccacccagccagccaagccggccaagccacccagccagccaagctggccaagtcactcagccagccaagccagccagccagccaagccggccaagccactcagccagccaagatggccaagccacccagtcaagccaactaagccagccaagccacccagccagccaagctggccaagccactcagccagccaagccagccagccagccaagccggccaagccactcagccagccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgaagccagccagccagccagccagccaagcctgccaagccacccagccagccaagccaggcaaacaacccagccagccaagccagtcaagccacccagccagccaagccagccaagccagccaagccacccagccagccaagctggcaagccactcagccagccaagccagccagccagccaagccggccaagccactcagccagccaagatggccaagccacccagtcaagccagctaagccagccaagccacccagccagccaagccagccaagccactcagccagccaagccagccagccagccaagccggccaagccactcagccaaccaagatggccaagccacgcagtcaagccagccaagccagccaggcagccaagccagccaagacctccagccagccaagaaaggcatgccagccaagccagcaaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccacgacacccagccagcgagaggcagctaggcagctagccaagcctgcccagccagctcgagccagctaagccaggccaagcaagctagccatccaagcttgacaagccagccaagcatgccagccaagccagcgcagctggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacacaagccagccaactcagccagctagccaagccagccaagccagccagccagtcaagccagccaagccagccagccaaccaggccagctaaaccagccagccagccaggccagccagccaacccagccaccgcagccagcccagccagccacacaagccagccaagtcagccagccagccaagccagccaagtcagccaagccagccagccagccaagccagccaagccagccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccagccagccaagccggccaagccagccagccagccaagccagccaagccagccagccagccaagccagccaagcaagccagcaagccagccagccaagccagccagccaaaccagccaagccagccagccagccaagcgctttacccgaacgtccgtgaggcagtgagagccaaagcagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccagccaagccagccagccagccaagccagccggccagccaagctagccaatccactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaacccgccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaacagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagccaacccagccagccaagccagccaagccagccaagccagtcagccagaaaagccagccaagcctgccagccagtcaagccagccaagcctgccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccggccaagccacccagccagccaagccggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagcctgccagccaagccggccaagccagccagccagccaagccagccaagccagccagccagccaagccagccaagcaagccagcaagccagccagccaagccagccagccaaaccagccaagccagccagccagccaagccacccaagacacccagccagccagccagccaagccagccaagccacccagccagccaagccagccaagcaagccaggcaagccagccaagccagccagccagccagccacccagccacccagccagccaagccagccagccacccagccggccaggccagcctgccacccagccagccaagccagacaagccagccaagccagccagccagccagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagacaggcatgccagccaagccagccaggcagccaagtcagccaagccaggcagcaagcaaagccaggcatgccagcccagccagccaggcagccaagccagcaaaaccagccagccagccaagccaggcatgccagccaagccatccagccagctaagccagccggctagccaagccagacaagccacccggccatccaagccagccagccaagccggccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccaagccagccagccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccagccaagccagccaagccacccagccagccaagccagccaagcaagccagccaagccagcgcagccaggagccagccaagccagccaagccagccaagcctgccaagccagccagccagccaagcctgcaaagccagccagccagcaaagccagccaagtcagcctgccaagccagccaagacaaccagcaagccaagccagccaagccagccaaggcagccaagccagtcagccagccaagctagccaagccaggcagccatccaagccagccagccatccaagccaatgaagccagccagccagccaagacacccaagccagccaactcagccagccagccaagccagccaagccagtcagccagccaagccagccaagccagccaagccagtcaagccagtcagccagccaagccagccaagccagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagccagccaagcctgccaagccaaccatccagccaagcctgcaaagccagcccgccagcaaagccagccaagtcagcctgccaagccagccaagacagccagcaagccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccagccaagccagctagccaagccagccaaggcagccaagccagtcagccagccaagctagccaagccaggcagccatccaagccagccagccatccaagccaatgaagccagccagccagccaagccacccaagccagccaagccagccaactcagccagccagccaagccagccaagccagccagccagtcaagccagccaagccagccagctaaccaagccagctaaaccagccaagcctgccaagccagccaagccagccaagccagccagccagccagccatcccagccagcccagccagccaagccagccagccacccagccggccaggccagcctgccacccagccagccaagccagacaagccagccaagccagccagccagccaagccagccaagcctcccagccagccaagccagccaagccacccagccagccaagccagccaagccacctagccagccaggcccaccagccagccagccaggcagccaagccagccaagccagtcaagcccgccagccagccaagacaggcatgccagccaagccagccaggcagccaagccagccaagccagccaggcccgccagccagccaagccaggcatgccagccaagccagccaggcagccaagccagcaaaaccagccagccagccaagccaggcatgccagccaagccatccagccagctaagccagccggctagccaagccagacaagccacccggccatccaagccagccagccaagccagccaagccagccaaccagcaaagccagtcagctagccaagccagccaaccagccagccagctaagctggccagcctgccagccaaccaagccggccagacagccaaggcagccaagccggccaggcagccaagccagccaagccaccgacccagccaagccagccaagccacccagccagcccagacagccaagccaggcagccagccaagccagccagccagcaaagccaggcagccagccaagccagtcaagccagacagccagccaagccagccagccagccaagcgagccaagccagccagccagccaggccagccagccacccagccagccacccagccagccagcccagccagccaagccagccagccagcccagccagccccgccagccagccaacccagccaccgcagccagcccagccagccacacaagccagccaagtcagccagccagccaagtcagccaagccagcccaccaaggcagccatgccagccagccagccaagccagccaagccagtcagccagccaagccagccaagccagccagccagccaagccagccaagccagccaagtcaactgagccagccaagccagtcagccaagccaggcaagccagcaaagtcagccagccagccaagccagccaagccagcccagccagcccagccagctaagccagcccagccagccagccaagccatccaagccagccagccagccagccagcccagccagccaagccagcccagccagccaaccaagccagccagccagccatgccagccaagccagccagccatccaagccaaccaagccagccagccaagccagccaagccagccaagccagccaagccacccaggcagccaagccagccaagccagccaagccagccaggcagccaagccagccaagccagccaagccagccagccaagccagccagccagccaagagagccaagccagccatccagccaggccatccagccacccagccagccaagccagcctgccacccaaccagccaggccatccagccacccagccagccaagccagcctgccacccaaccagccaggccagcctgccacccagccagccaagccagacaagcctgcgaagccagtcagccacccagccagccaggccagccagccacccagtcagccaagccatccaagccagccggccagcacagacagccaagccagccacccagtcagccaagccatccaagagagccagccagcccagacagccaagccagccagccagccaagccagccaagcaagccagcaagccagccagccaagccagccagccaaaccagccaagccacccagccagccaagccacccaagacacccagccagccagccagccaagccagccaagccacccagccagccaagccagccaagcaagccagccaagccagccaagccaggagccagcccagccagccaagccagccagccacccagccacccaagacagctaaaccagccagcctgccaagccagccaagccagccagccagccaggccagccaagccagccaagccattcaagccagccagccagcccagccagccaagccagccagccagcccagccagcccagccagccagccaacccagccaccgcagccagcccagccagccacacaagccagccaagtcagccagccagccaagccagccaagccagcccgccaaggcagccatgccagccagccagccaaaccagccaagccacccagccagccaagccacccaagacagacagccagccagccaagccagccaactagccaagccagccaagcaagccaccagccaagccagccaagcctgccagccagcagagccagccaaccagccaagccagccagccagccaaaccagccaagccagccagccagccacttaagccatccaagcaacccagccagccaagccagccaagccaccgacccagccaagtcagccaagccacccagccagccaagccagccaagccagccaaaccagcctgccagccaagccagccaagccatccagccagccaagccagccagccagccaagctagccaatccactcacccactcaaactagccaagtcacccggccagccaagcctgccaagccagctagccagcccagacagccaagccagccagccagccaagccaaccaagccagccagccagccaagccagccggccagccaagctagccaattcactaagccactcaaaccagccaagtcacccggccagccaagccagccaagccagccagccagcaaagccagcccagccagccagccagccagccagccgagccggccaagccagacagcgagcccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagccaagccagccaaccagccagacagcccagccagacagccagcccaggcagccaagagacccaagccagccagcgaagctggccaacccagccaagccagtcagccaagccagccaagccggccacccagccaagccagccaagccagcgaaccagccagacagccctgccagacagccagcccaggcagccaaaccagacaagccagccagccaagtcagccaagccagccagccagacaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccagccaagccacccagccagccagccggccaagccactcagccagccaagccagccagccaggccagccgggcaagccattcagccaggcaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccagccagccaagccagccaagccagccagccagccaagccaggcatgccagccaagccatccagccagctaagccagccggctagccaagccagacaagccacccggccagccaagccagccagccaaggcagccaagccagccaaccagtcaagccagtcagctagccaagccagccaaccagccagccagtcaagccggccagcctgccagccaaccaagctggacagacagccaaggcagccaagccggccaggcagccaagccagccaagccactgacccagccaagccacccagccagccaagacagccaagccagccaaaccagcctgccagccaagccagccaagccatccagcctgccaagccagctggccagccaagctagccaatccactcacccactcaagccagtcaagtcacctggccagccaagccagccaagccagccagccagcccagagagccaagccagccagcccagacagccaagccagccagccagccaagcctgccaagccacccagccagccaagccaggcaaacaacccagccagccaagccagtcaagccaaccagccagccaagccagccaagccacccagccagccaagctggccaagccactcagccagccaagccagccagccagccaagccggccaagccactcagccagccaagatggccaagccacccagtcaagccagctaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccagctcagacagccaagccagccagccaagccagccaagccagccagccagccaagccggccaagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagcaagcaaagacacccagccagccaggttagcaaagacacccagcagggagccagccagcaagccagcgagccaagctgggcaaggccaccaagcgagcccggcagctcagtcagtcacagaggccagcagaccgtggtcaagccacccagccagctaagcagatctacgcacaagctctccaagccactcagccagctaagctagccagcagtcaagccggccaagccactcagccagccacggcgccaagccacgcagtcaagccagccaagctagccaggcagccaaggcagccaagccagccaagacctccagccagccaagaaaggcatgccagccaagccagccagggagccaagccagccagcaagcaaagccaggcatgccagccaagccagccagggagccaagccagccagcaagcaaagccaggcatgccagccaagccagccaggcagccaagccagccaagccagccagccagccaagccaggcatgccagccaagccatccagccagctaagccagccagcaagcaaagccaggcatgccagccaagccagccagccagccaagccagccaagccagccagccagcccagccagtcagccagccaaaccagccagccagccaagccagccagccacccagccaagccagccacccagcaaagccaaccaagagacccaagccagccagcaaagctggccaaaccagccaagccagtcagccaagccagccaagccggccacccagccaagccagacaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagccaagccagtcagccagaaaagccagccaagcctgccagccagtcaagccagccaagccagccagccagccaagccagcgaagacacccagccagccaagcaagccaagccacccagccagccaagcctgccaagagacccagcaacccaagccagccaagacacccagccagccaagctagccaagacacccagccagcgaagccagccagccacccagccagccaagccaggcaaacaacccagccagccaagccagccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccagggagccaagccagccagcaagcaaagccaggcatgccagccaagccagccaggcagccaagccagccaagccagccagccagccaagccaggcatgccagccaagccatccagccagctaagccaaccagcaagcaaagccaggcatgccagccaagccagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccagccagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccactcacccactcaagccagccaagtcacccggccagccaagccagccaagccagccagccagcccagacagccaagccagccagcccagacagccaagccagccagccagccaagccagccaagccacccagccagccaagccagccagccaaaccagccaagccacccagccagccaagccacccaagacagccagccagccagccaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccggccggccagccaagctagccaatccactcacccactcaagccagccaagtcacccggccagccaagccagccaagccagccagccagcccagacagccaagccagccagcctagacagccaagccagccagccagcaaagccagccaagccagccagccagccaagccagccaagccacccagccagccaagccagccagccaaaccagccaagccacccagccagccaagccacccaagacagccagccagtcagacaagccagccaactagccaagccagccaagcaagccaccagccaagccagccaagcatgccaaccagcagagccagccaaccagccaagccagccagccagccaagccagccaagccagccagccagccactcaagccatccaagcaacccagccagccaagccagccaagccacccagccagccaagccagccaagccagccaaaccagcctgccagccaagccagccaagccatccagccagccaagccagccggccagccaagctagccaatccactcacccactcaaactagccaagtcacccggccagccaagccagccaagccagctagccagcccagacagccaagccagccaggcagccaagccagccaagccagccagccagccaagctagccaagccagccaagacagccaagccagccagccagccaaaccagccagccagccaagccagccagccacccagccaagccagccacccagcaaagccagccaagagacacaagccagccagcaaagctggccaaaccagccaagccagtcagccaagccagccaagccggccacccagccaagccagccaagcctgccaaccagccagacagcccagccagacagccagcccaggcagccaagagacccaagccagccagcgaagctggccaacccagccaagccagtcagccaagccagccaagccggccacccagccaagccagcaaagccagccaaccagccagacagccctgccagacagccagcccaggcagccaaaccagacaagccagccagccaagccagccaagccagccagccagccaagacagccaagccagtcaagccaggcaagccagcgagccagccaagccagccaacccagccagccaagccagccaacccagccagccaagccagccaagacagccagccagccaagccggccaagccagccagccaagcaagccatggaagccagacagccagccagccaagccagtcaagccagccagccagccaaaccagccaagccagccaacccagccagccaagccagccaagccagtcagccagaaaagccagccaagcctgccagccagtcaagccagccaagccagccagccagccaagcggccaagccgcccagccagccaagatgccaagccacccagccagccaagcctgccaagagacccagcaacccaagccagccaagacacccagccagccaagctagccaagacacccagccagcgaagccagccaagacagccagccagccaagccgccaagccagccagccaagcaagccatggaagccagacagccagccagccaagccagtcagccaagccagccaagccggccacccagccaagccagccaagccagcgaaccagccagacagccctgccagacagccagcccaggcagccaaaccagacaagccagccagccaagccagccaagccagccagccagccaagacagccaagccagtcaagccaggcaagccagcgagccagccaagccagccaacccagccaagccagccagccagccaagcggggggagccactcagccagccaagatggccaagccacgcagtcaagccagccaagccagccaggcagccaagccagccaagacctccagccagccaagaaaggcatgccagccaagccagctaggcagccaaaccagccagcaagcaaagccaggcatgccagccaagccagccaggcagccaagccagccaagccagccagccagccaagccagcgaagacaccgagccagccaagcaagccaagccacccagccagccaagcctgccaagagacccagcaacccaagccagccaagacacccagccagccaagctagccaagacacccagccagcgaagccagccagccagccagccaagcctgccaagccacccagccagccaagccaggcaaacaacccagccagccaagccagtcaagccacccagccagccaagccagccaagccgcccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccagccaagccagccagccagccaagccaggcatgccagccaagccatccagccagctaagccagccggctagccaagccagacaagccacccggccagctaagccagccagccaaggaagccaagccagccaaccagtcaagccagtcagctagccaagccagccaagccagccagccagccaagccaggcatgccagccaagccatccagccagctaagtcagccggctagcccagccagccaagccacccatccagccaagccagccagtcaagccagccaagccagccaaccagtcaagccagtcagctagccaagccagccaagccacccggccagccaagccagccagccaacccagcccagccagccaaccagccaagacattcagctagccaagccagccaaccagccagccagtcaagccggccagcctgccagccaaccaagccagccagacagccaaggcagccaagccagccaggcagccaagccagccaagccactgacccagccaagccacccagccagccaagagagccaagccagccaagccagccaaaccagcctgccagccaagccagccaagccatccagcctgccaagccagctggccagccaagctagccaatccgctcacccactcaagccagccaagtcacccggccagccaagccagccaagccagccagccagctcagacagccaagccagccagccaagccagccaagccagccagccagccaagccagccaagccacccagccagccaagccagccagcaagccagccagacagccaagccagccagccacccagccagccagtccagccagccacccagccagccaagccagccagccatccagccagccaggccagcctgccacccagccagccaaggcagacaagccagccaagccagccagccacccagccagccaggccagccagccactcagccagcccagacagccaagtcagccaagtcagccagccagccaaggcagccaagccagccaaccgaacaagagagccagccaaccaagccagccaagccagccagctagccaagccacccagccagccagccagccaaaccagccaagccacccagccagccaagccagccaagccaatcagccagccaggcagccagccacccaagccagccaagccagccaagccatccaagccagccagccagccagccagccaagccagccaagcctcccagccagccaagccagccaagccacccagccagccaagccagccaagccacctagccagccaggcccgccagccagccagccagccaaaccagccaagccacccagccagccaagccagccaagccaatcagccagccaggcagccagccacccaagccagccaagccaaccaagccatccaagccagccagccagccagccagccaagccagccaagcctcccagccagccaagccagccaagccacccagccagccaagccagccaagccacccggccatccaagccagccaagccagtcagccagcccagacagccaagccagccaagccagccaagcccgccaaccagccaagacaggcatgctagccaagccagccaggcagccaagccagccaggcagcgaagccagccaagccagccaggcagcgaagccagccaagccagccagcaagcaaagccaggcatgccagccaagccagccagctagccaagccacccagccagccagccagccaaaccagccaagccacccagccagccaagccacccagccagccaagccagccaagccaatcagccagccaggcagccagccacccagccagccaagccagccaagccacctagccagccaggcccgccagccagccagccaggcagccaagccagccaagccagtcaagcccgccagccagccaagacaggcatgccagccaagccagccaggcagccaagccagccaagccagccagccagccaagccaggcatgccagccaagccatccagctagctaagccagccggctagccaagccagccaagccacccggccggcaaagccagccaagccagccagctagccaagccacccagccagccagccagccaaaccagccaagccacccagccagccaagccacccagccagccaagccagccaagacagccaggcagccagccacccaagccagccaagccagccaagccggccaaaccagccaaccagccaagccagccatccatccaagccagccaagccagccaggcagccaagccagccaagccagccagccagccaagccagcgaagacaccgagccagccaaacaagccaagccacccagccagccaagcctgccaagagacccagcaacccaagccagccaagacacccagccagccaagctagccaagacacccagccagcgaagccagccagccagccagccagccaagcctgccaagccacccagccagccaagccaggcaaacaacccagccagccaagccagtcaagccacccagccagccaagccggccaagccacccagccagccaagctggccaagccactcagccagccaagccagccagccagccaagccggccaagccactcagccagccaagatggccaagccacccagtcaagccagctaagccagccaggcagccaagccagccaagccagccaagacctccagccagccaagaaaggcatgccagccaagccagccaggcagccaagccagccagcaagcaaagccaggcatgccagccaagccagccaggcagccaagccagccaagccagccagccagccaagccaggcatgccagccaagccatccagccagctaagccagccggctagccaagccagccaagccacccggccagccaagccagccagccaagccagccaagccagccaaccagtcaagccagtcagctagccaagccagccaagccacccggccagccaagccagccagccaacccagccaagccagccaaccagccaagacattcagctagccaagccagccaaccagccagccagtcaagccggccagcctgccagccaaccaagccggacagacagccaaggcagccaagccggccaggcagccaagccagccaagccaccgacccagccaagccacccagccagccaagacagccaagccagccaaaccagcctgccagccaagccagccaagccatccagcctgccaagccagctggccagccaagctagccaatccgctcacccactcaagccagccaagtcacccggccagccaagccagccaagccagccagccagcccagacagccaagccagccagcccagacagccaagccagccagccagccaagccagccaagccagccagccagccaagccagccaagccacccagccagcccagacagccagcaagccagccagacagccaagccagccagccacccagccagccaggacagccagccacccagccagccatccagccagccaagccagccagccatccagccagccaggccagcctgccacccagccagccaagccagccaagccagccaagccagccagccacccagccaagccagccacccagcaaagccagccaagagacccaagctttttcagccaccagccatcactatcctcttgttttcaaacaggattgggatttgattatttcaaacccttcatgggattgaaactttgtcttaagtcagtgactactacatttccaagtactttcgaggagacatattttcatgtgtttttttgcatagctctggatttcaacttacacacccagaaatgtcacctttagaggcccctttgttgagtacatttgatctcaagtattccaggtctggggatggatctagctggaaaatgttcagacactgaagtttctagagcctgaagatgctcccctatcaggtaccaggaccagccagatctcattctctgactctacataacttctgacaaatgaaatgaagtttccgtttttggccaaccatggagcctgctccgtgtctgatattcttctttgaagactgaggatgtgacctgattgttctctgcctcctttttctagctacatttttttttttagctggttctcacacgggctttccatggcctctctctgattgtggggactggccgtttcccaggcacagcaccttggcctgggggagccgtgagaactgatgagtgtcttttgaaggagtcactgggcttctgcaatgggaggatcttggtgtgtggggagcgtgggaacttttccttttgttggttcaggaatgaaattgttgtgtaaatggaccaagagacctaaggaaagggacagtccttttggctggtgggtcctctccactgatagatccaaacaacagagtggaaaatgtaccacaagaagactacgctcgttgcctggaactcagtagcccctgtggctggtgttggcacttgccttaccagtgtgagcctggttttcccgatcatttggccttccacaataaggacaatttaagagattatttctcaatgttaactacttccttgattaattttgtgatctacctttctcctttctgaccagtagtagaatccatttatgttttcaagatgttgctacttaggatacaattatttctaagaaatacaagtgacattgctttgtagaatgggaaccatgttctacagccctgcaaagacctgtcctgagagagctggggggacgcaggcttggaggaggtgagggcaggcactgagtgggtggagggaatcaaacggctgccagaataaacatcagatggagctcctgggcttcttgaggggtagaatttcctctgagctctctacaagacctcagccacaaccattcatctacttaatacattgaagcaattcacataaaaagccagacagatttttttctctgaatttaaaactggatttagagactagattaataaatattgtctttgtcatgtgagtcactttggagagaatcatgtccccactgtatggcaatgcagcagatcctgaccatgcatatttagtgtgtccttcctgctctcttgggcagaccatcccatcaggctatagcacggagctctcacccatctccctgctctgccatgcaccctccttcttgcctgctctttcttctccctatggccagcccctccagccaacatactttttatctctctttgttttgcaaaatccttttctcctatcacttccatcataaaactagtatttggcaaacaatcacatgtcggcataaagctcttaaattgacctgctttagattaaagcacaatatgggttttatagtttgcctcaggtgaccatttaaatgtcttgaataatgaaatgaaaaactggacagactaaaataagagtcctgtctgcctgtgacagtgaagaataagagtcctgtctgcctgtgacagttaaagaatgatccctcattgcctctcacacagctgcagtcagggttcccaccaccctttctgctgattctgaaatcagccctagttcataaattatcagggaatttggtgagttttctcttttaatgtcagtctgtttatttgactggtagtttctggccttaacacatcccactaatgtgttgtttagttgagcacaataataaatagaacttttgtttacttttacatccaaagataaatgttgagtgctattaaaaacttttctaacatagtaggcctccaatgaggaattttccttcagcaaatcataaaactgggtctagaagtgccaacccaagtaaaattactgatgaactaatcatagttgttatttttccttcatcttttcctttttttttttagacaatcttgccctgtcgcccaggctggagtgcagtggcgtgatctcggcttgctgcaagctctgcctcctgggttcacgccattctcctgcctcagcctcccgagtagctgggactacaggcgcccgccaccatgcctggctaattttttttgtatttttaatagagacggggtttcactgtgttagccaggatggtctcaatctcctgacctcgtgatccgcccaccttggcttcctaaaatgctgggattacaggtgtgagccactgcgcccggctccttcatcttttctatgtgctttgtttgacacttattgaggatacagttgctgaagaccagctgagtaggacataggctctgtcatgcattaactcatccacccattcatttattcactcatctattgagcatctgctatgtgtcaggctctatgccaaactttctgttcaggagccaatatatcaataactacagtgtaagctaagtcatgcaatgaaagacttagagaatagacaccaagttgaatattaacccaagtaaattattggaagatatattagttatctaaaataggcttaaaacaataaacatttattatcacaatttctgtaggtccagaatctggacatgacttagcttgatgtttatggctcaagacctcttgaggtttcaataaaggtgttagtcagggctgcagtctcatctgaaggctcatctggttgggggtggtgtctgtatctatgtggttattggcaggccttggtcctcactacactggaactcttcaaagggttatctcatgacacagaagctagctttccccagggtgaagaatgtaaaagaatgtgagaactcttaagacagatgctatagtcttttctataacttaattttggaagtgatattccatcacttctgccatattctttgttagaatcaagtcagtaaatccagcccagattcaagtgaaaggattccacaagagtgtgagtaccaagaggtagggatattgggagccatctgagaggctgcttaccacagagggccagccagttaggaagtgggttcagctgctgctgttaacaggctcgacctaagtggcttaaacacagaagagttgttgttgttgttgttttttctaatgagaaatctggaggcagtcagttgctggccttggctcaaaggctgagggcactgtggttcttgtagcctttcgcttatggccctaagctgctggaactcttgccatcatgtctgcattccaagcagcagaacaacaagaaaagaacagggggagaagagaaagagggcaccagcccactgactatcctgttcatcctgggaagtaccactcaacaagctcaactctcatttccacagccatctccagctgctcaggagtctgggaaatgtaatcacatgcaccattatccccaagtgcaccactgcctccagcccctttccacctttcagttatagccataaacatccagttagccataaacattcagctaatgcatgtgcagattcttgatctacagaaattgtgatagtaaatatttattgttttaagtctatcttagatcactaacatatcctctacttaacatttcacttgggttaatattcagcttagtgtctattctcaagttttccattgtatgtcttcgttcgcactctcctcattgaaatattggctcctgattagaatgcttgagtactgttcttttataccaccaagcctgctcctcaagccgattttgtgccccgcaagccagcgatggctctattaatggttgtccttgtcttttatgagttcatgtgactgggtgggggagattcaacacccaccctcatgctgctcactctcaagtaaacaagtaagccaacattagagtctcagggctatgaatgggagcacagaaatcacagtgcaacctcccaagtacaggtcaggaagcctggtttaaatatttgaaagcaatttgaggaagttcccagtgggaaatgaacttgagaactaggtcattcatatgtccattcaacatctaccttctgcttatctggagtgtgcatggcactgcctggggccactgcagtgaataagagagatgagaacccaggcaactccgagagacccagtcccacctgctttgctggcaggggcttaggatgcagtcactttccattaaagtcagagtcctggagtcccatctgctttgcttctgcattccctacaatgatgagtggttaggagtccaggtctcagagaaagactgtctaggtgtgggtccccaccttgtcacttctgtgtccccttgtgtgagctgctggacatctctgggcctcagtttcctaatttataatgtggttgcctgtcagaggattacatgagaagatgcatattgcttagcgtagtgccaagggcatagtaatagcccaacacttattaaccacgttgatgatggctatggagatgatggtgatgatgacaatgatgttgatgatgacaatggtgatgattatgattcagtttctattctaagatgtggttacagtttcctaactttgggagatatgcctatctgtatatatcacggcatagtctctttctcttattgtagagaaaacaccttcacattatagatgcaccgcttggccttcctatctctcagtgtagaggagactctggaattcctcttgactggtccagatgcccacaaaattctacagacaagcagcaccaaacttaagagcatacatgtgatccaaaatattcttttaaagtcaaagctgtcattgcatttttccagaaataaaatgataaaaactgtgcacaggactgcttatcatacttaactcttaacacagctgacctttaaatggcattaagagtaccaacctgagttctgggtcctaggaaccaggaggagataaaagattaagaaatagggaaggagagcccgggtgtggtggctcacgcctgtaatcccagcactttgggaggctgaggcgggtgcatcacctgaggtcaggagttcgagactagctggccaacatggtgaaaccctgtctctactaaaaatacaaaaattagctgttctgcagacttgggtctagaggtgatcagtttttccccagccaaagcccaagggcagccttgctcctctctccctcccctggcttatgttcccctgtgtatgactgtgtccctccagcccatgacctatagagaatgcagaccatctctctgccagtgttggagaccagatcccatggaagggcactcatgtccagcctggggccccctgccttggcagacactactagttgacataatccagctacttgggaggctgggacaggagaattgcttgaacccaggagtcagaggttgcagtgagctgagattgcactgctgcactccagcctgagtgacagagtgagactctgtctcaaaaaaaaaaagaaaaaaaaaaaaagagaaagaaacagggaaggaaaaatgactggaagaagatgaatatgctgagccacattctgagattgagaagtctatctatgatcacttgcacctcttctcttctgggtagtgtctacttccccacgtccctctgccattcttttgctgaagccatgcccaccttaccatggggtgcagggcagtgaagaagcagcaagctgcgaaggctgagccatacctggaaagagtgactgctaagtgcgtgtgtccctggaggcatttgttccttcacaaggaaatggttgtgaactcaaactgggttctaattgtcaacattcaagggagttggcaaaaagagtcattattcaataaactataccaaatactacagtatgtgcctggcatgttgtagatgctggagacacaggagtgaacaaataagcaaagcccctgccctgtcactgcatttctgcagaaaagatgttttgcttcagggaagccaaatcgctcaccaggagcctggccccgagtccactcttggggtcaacacccagggctgcccagtgggctgtgtctgctgtccccccggtcctagcccacaggctttttgaaatctccagtgtgctcgccatgaggaaagcaggggtgaagtctgctgggcagcctttgtcatgtctgtgattaaggacgactcttttctggaaattaaaatgagcagtcctgctatctcaccgtacaatcactggcatagtttacttttttattctgtgtctggattttccccctggggctgcagcagtaagcctgcttccttggttcaaagccagtgtgtgtttctgcaagaaagaacttctggatcagcagggccccttaacaggctgcaagctggctcttgagagggagcaggcagccaaacaatatttggcctgtccttcccctccatgccagccttagttctggttcctgctcagtaggcaaggggcagcccaggacttcagagggaacctgataacttgtctttgtgtgattaaggctgggtagcagagcccactgagaaccagctatgcttcaccataaaaatagaacttagctctgggtaccagggagttttaataatgtggaaaaatgcttatgttgtcatgttaagtgaaataaagtagagtcctaagcaatgtatacagtgtaactacaactctgtaaacagagagagagcagaaggaaatataggaaaatattaatagtgtgtggctttggaaggtgggattaatatgctctacttggctgggcacagtggctcatgcctgtaatcccagcactttgggaggctgaggtgggtggatcaagaggtcaggagttcgagaccagcctggccaacatggtgaaaccccgtctctactaaaaatacaaaaataagccaggtgtggtggcatgcacctgtagtcccagctacttgggaggctgaagcagaagaatcacttgaacccgggaggcagagattgcagtgagccaagatcatgccattgcactccagcctgggtgacagatgagactgtctcaaaaaaaaaaaaaaaaaaatacgctctactcttctaattttctaggttatccccaggcagcatttataacttttataatcatacaaaaataaactttatattaaaatatacatattttgcatattttaatacttttccccagctttaagaatatctgataaaagaaatttatgttactctaacgagcagctgctatcttggttaattcatattttttcacaattaataatataaacattaaacagaaactggtgggagcaattgtccattgggtaatcagtgggcgaaactgcccatgaaatgaaagcaaaacaaaaaacaatatgaaaataaaaacaaaaaatccacaaactacatcagaaatgaatttcctctttgggacatgctgaaaaatatcctgggtaaaatcaaggtattttgcaattatttttcaagtaaatattgtacagagggacgcagtgatcaatgctgctttcctttactgctttgcaggcctgtctagaaactttagtggccagagaggcggcctgcaggctcagggataactgtcttgccaacaaggaacttgttaagttccttgttgcagtttcctactatgaaaatgtggggtagttttgtgggaaactgttagttccctagtcaatttctgaaagatctaagagaataaggaagttcaccaaatcgcaaattacggtggggttacagccacactgcagatttttacaatgtggtacccagagttgattaggatggggcccactgtatcaattacacttaacggttcgttgcatatagcagaaacctacaataacaaaggctcgaatacaagacattttattgtttcacataaaagaaatccagaggataatgggtctggggttacctggccactgctcatccctgctaactcaggctccttcgacctcttcaccctgcctctccccagtggtggccacccccagctgcaagggcgataacacacgtggagttgttctaggaagaattattttgtgcccagctgaaaatcaggggcttgattatcagggaagggggagaacacatgtggggttaggcaatcagcagtcactgccgtggccatgactggagcatgtcgaatgttctgaggcctccagggggtgcatggcagtctctcagtagtgtgcaacttggcctttctcgacccagaagcctataaacagataataaagcaataaattagctgccacacacagctcggtaccctacagtagaacaggggcaggataatagcaacagcaccaccattccaagaggagcagacaggaggcacacaggggcccctgcctagcaataaaccttctgagcatgcagtgggaggcctttccccctggttttctggtttatccctggggaacctctctactcactgtcctctggggcccctagcttgtgctcagagagaccctctggtctctcactctggatagctgtgtatgatatgggattagggacatgcccttagtggggtctgcacagctcctccttcccacttgctgctgctgaaggttggaggttccacagttgaatagtcgaatgcctttaaaaaaattgagatgtcgtggggcacagtggttcacgcctgtagtcctagcactttgggaggctgaggccggaggatcccttgagcccaggagtttgagaccagcctggaccatgcagtgagacctcagctctacaaaaaaataaaacaattagctggatgtggtggtacgtgcctgtagtcccagctactcaggaggctgaggtgggaggattgctttagcccaggaggtcgaggctgcggtgagtcatgaactcaccactgcactccagcctgggtaacagaaccaaacactgtctccgaaagaaaaaaagaaaaaaaagggagggcggtgaaattcaggtaacataaaattaccatttaaaaatgaacaaattcagtggcatttaggacaaccacaacatcgtacaaccaccacttctgtctggttccagaacattttcctcaccccaaaaggaaaccttgtactcattaagcaattattctcattcccacctccccccccagcccctgacaaccgctaaactactttctatctgaatggacttgcctattctgaatatttcatatcaatggaatcatgtagtgtgtgtccactttgcataatgtattcaaggcttgtccatgttgaagcatgtattaatatttcattctttttatggctgaataatattccaatttatccataaaatatatttttaactcatggtttctttgacaattcaggatccacaaaaacacagtcagcttctgacctagttgcttctcatcagctccctggctgcagtcacactgaattcttgccaagacctatgcctcagacctgctttattgcttttcttttgtgccccttccctcactctcatttgatggaatggtggctaccttgactcttcccggaacaccatatggcaaacgccagtcctttcccttcatctcattctgagccgcttcagaccttgaccactcaaaggccagcacagtctcatctctaatatttgggctttataagcagtcgacttttctgactttgcaaagccctgaatttctgaactctattcctttcctaagaacaacaattccgttgacttctaaacagcattggttgcatcaccaaggggaaaaaaataaaccaaaaaaacccaaaaaacccaaaaaccccaaacctctgccagttaaaccatgtcatgccgtataaagcaagtgccattacaatgtgaaaaagaaatatgcaccgcagagttgacgacgtgcagtaaaacagtaccgatatgaatggctgacattagttgaggttctacgctgtgtcaggcattgtgaatcttttgagagagatgtcagaattgttatctttcttttacagaggaggcagtggaggcagagtgaggttcacacccagcaaccctcactcagaaggcttctgcttgggtagagcttgcattggccaaacctcatccacttgccattcattcagtcattcagtgacaagtgtttatggtcacctgtgggagtgtgtgtgtgggaagggtggaaaatttccctcttggtgttttcaatttagtggaggagtaaagccttgcagcaaaatatgaaagatcattcaaacattagggactcaagtgaacgcaaaggagttggggaaagttccgcttaggaagtgacatttgaatctggtcttcaagacgaagaaggaatttgcttggagagaggggctggaggagaaatgagcaggctgggggtggggggagcacaggtgtaggcagggagaaaagaaaaggggcttttggtttgagaccctgcgaggaggcagcatggaggaaggggctgcagggagctttggggttggggagaggatgcagctggaggagtccctgatgtcacttgggtattattaatgtcaataatcagcttatatagaatgaccttctcactagaataaacagtcataactgtggtgctttaatcaacatgacagcattggagaatctactcaaactcacttgggtctagaggggatcagtttttccccagccaaagcccaagggcagccttgctcctctctccctcccctggctcatgttcctctgtgtacaactgtgtccctccagcccatgacctatagagaatgcagaccacccctctgccagtgttggagaccagatcccatggaagggcactcatgtccagcctggggccccctgccttggcagacactactacttgacaacagatacccctctccccttcttgcttaatttaaaaaaattctatttcagatggcattgtgtcagttgaaagatcacattttctagactagtctgcagctaggtgagcccaggtgatctagttccatatgtggaaccattatgtggaattttcagtaggctccgtcacggtgggaagagatggcgttacacatttttctgtcgtccctcacttcctcctactgtcaatatggggaatacggacttgctggctggagtgccagcaggcatcctgggctgtgaagccactttgaagatgaaagccaggctctgggatggtggatcaggaagacaggggcccaatttcctagcaatgctttggggctgcacccttggcctgtgcttcctatgccaggctacttttacatgaaagagaaaaagaagtcctgacttaatgcattgctgtatttttccagaaatgtgcagccagacctaatgataggtggtttagggtgggaagcagagtaagatgacagaactttaggaccacatgaagggaaggagagggtcccccaggaaagggtgcagtttgttagacagaacaatagcatatccgttacaaagagctgccatttgctgggcgctaagggcctggccctctgtgaacctcaccatctgcatcatctcacttcatcctcaccagggtgggggcatgaggactctctcatgaccagggctattctcaatttacaaatgaggaaacaaaggctcaggaagggctctttctcaaggccactgagttgggagctacgttccactctgggtctgtttgtttcagggacaaaccttgaagccacacaagggccccgagaaactgtgcagatgtgaaacccagagtggcccgatcagatctatgactttgtgtcatcacaaaagtgaaagaagcagttcacagaaggagtggagtgtgcaggtcagaggcaggaaggacaggcagacactgtgatgatgataggctgtgaagaggtgggcgatgcctgggatgggagggactgtgttggacccagtgctgacctgagaacctcctctcaggccctcagtcaggctggcccctgttagacatgagatttgactcactggttcccattaacagccactagagatgaatgcactctatcaagtccatgtctgattaaattcaacaactcaggagtagtggtcaggaagtgtgctgattttttttcaatacaggtaaagtttttaattatgaacttttcagagggcaaactcagattgcttagggtgtatttgtccttgtagtgtttttgagggagtcattaggggcatggaataattaagtgaaaattaagaagctatgaaagaatcactcagctaagaaacaagatggtagatcaggctccgtctgatctcttggcagtatgcattagaccaaagggttatttaggtgtcaaggattttgttttgccagttatcaagcctaagaaacttcccagttacatcaaatcaagcaaaatgatgaaggctatcatccacccttgcttacaacaaaaagaaaccacttataagttcttcccgttagccaaaactgaagaatttaaactgccttggctcttaataatagttttactttatggttttcttgctagtatttcaaatacatagtctgtcttcaccaaactagaaatagttgataccaagaaaaacgtgtttgcccggactgaatgatgtcattgcacactcacggaccatgcactctttagcagcacccatctaattccatgctgacctgccttctccatttgtaggataactgcaatactcagaagccggctggtggatcccaggcctctatcattcaattgccatcactgtacttggtggggcctcaaaggatgctccagatcccattttcctgcttctctttttgaaagcattgtctatgggtgctgcacccactccctgcagccaagctcctgtgcctcactcatggaggctgccggggccatctccctggtcaccatggcctccatgtggccaggtcagtgcatcctgctctgctcctgtctgacttgacctctcagcagtgctggcaggtggacctctcctgccttcttgatacgctcactccttggcttctgagcggtgattttcttggtgttcttccaacctcaccctcactggctgagggtgctgggttcccttctcatctttctccacatattctctctctctctctcatccaggccaggtctttaattccatctgtagaacattaactcttgaatctgcctctaatattgacttttcccaagaattctaagcctactcaacatctccacatggatatctgataggcacgtccaaattaagatggccaaaaccaaatctgggatttcacaccacccatctctgtaagtggcactcctcagttactcaaaccaaaaatcgaaggattatgcttgattcatctctctccatcactgccctcgaacccaatccatccaacaactctatctccaaaacattactcaaacaggtcctcatctttctgtctctgttacactcatcagaccccaaggggacccactgatctcccttggttccacttggtcctacacaagggcttcacacttagcagtaagagttatcctcagaggctgggcatggtggcacatgcctgtaattcccgcactttgggaggctgaggcagctggatttcttgagctcagaagttcaagaccagactgggcaacatagtgaaactctgtctctataaaaactacaaaaattagccagcagtggtggtgtgcatctgtagttccagctatttgggagactgaggtgtgaggatcacttgagcccaggagattgaggctgcagtgagccatgatcacgtcactgaactccagcccgcaacagagcgagaccctgtccaaaaaaaaaaaaaaagaaaaaaaagaaaagaaaaaaagaaaaagttgtcctcagaaaattcaagtcagatcatgtcactctcctgtttaaaagcctccagtgtctcctcatcacacctggcacaaaattcaagctccttccttgccaccttctccagccccatcccatcttctcttgctgttgcttactaagcagcagccatcctggggactcttacttgttcctttgtgtcttggggtcttggcgacagctgctctcttgtcctggaatgctgctgactggctcctggacatcattcagatctcagcttaaatggcacctctccagagtgaccttcctagatgacctgcccatctcaagtatttccctcctaccctatgctaattttttgcactgttcaattcactagcttgtacttttctcatgtacttattttctgtctcaccctcctagaatataagcttcacgagaacagggatcttttgtgccttcttcttgctgtgtcccaggacctgagttggagcttggcatctggtgtgtattcattaaagattagttgaatggttgagtcccaaacttactgtcttttgctccatgtgttctgatatcttctttattatggtctgctttgttgagtaatgtgttatgatcatcgagatttactcataggcactgagtttcaaaagatgatgcatatttagtgtatgattcatttatttaaaattctagacttttgactgcagcctgtgactcaaatactgtattggtggaaaaactttcaaatcatcaaccacacgtatttgggttttaccagctccatggcacatacgaaaaatagccagtacttagagattgttcttattatcatcctagacatttgtggatattaatttttaattcttatataaccctatgagtatgaaactcttatccccattttgtaaattggctgaatgtgtcagttctctaatgctgtgtaacaaattcctgcaaatggagtgacattaaaacaaaccccatctatgagttcacagttctgtggggcagaagtctgggcagactccactgggttctctgctcagggtcacacaaaccaaaatcaagatgtcaaaggggttgggttcatgtctggaggctttaggggaaaattgacttgcaagctcatcggagttgttggtggaatccaattccttctggctataacctagaggtatctgttttactgctggctgtcagctgggggttgctcttagtgcttaaagacctcccgaattcctgacacgtgaccttctcctgctttgcgtctctgacttcctcttctgctttcagccagagaaaacgcgctgcaattttttttttttttttttgagacaaggtctcattctgtcacccatgctggagtgcaatggcatgatcacagctcactgcagcctctctgagtagctgggactacaggcatgcaccaccatgtctggctaaatttttaattttttttataggtaaggtctcaccatgttgctagctggtcttgagctcctagattcaagtgattcttccgcctcaggcttccaaagtgttgggatttctggtgtgagccaccacgcctggccaatgccttgcttttaaagggctcacctgactgggtcaggcctactcatctattctccttattttgtggtcagttaacttggactttattatacttacaaaatcctcttgcagtattacctattattagtgtttgactgaaaaagcagagacaggaatcttggggaagtatctttagaattctgcccactgccctgaggttcaaagaagttaggtgatttatccaaggtcatacaaccagcagtggaaaccagattcaaatcaaggcattctggcccccagagtctatgaccttgaataataccctgcagtgtgatgagaatccagtgctgcattggaaattctgctgggcagattttctgacaatctgatgtagccatgcaggtgagacgcactgggctactttgttcataaggaccggaactatccatggtgccttgtctcctcactcccatcacctccgatgtaaccgaagacagacatgaccaaagaagtcaggactctgcttttcaatggattgaacccacggatgctgcaccattttccacgagtcagcagcaccatttccaggtttttgctgcccccagaacttggttacccctcaaatcctttcatcatcagcatgagtgaaatcaatgtgactcccattaacaagaatattattattgtgcacatgagaattaagcccaaaatgcaatctgtgctcacacaggtttgatgatggatggatgcagtggtgtgctggcagtgacttgttctgggttttggaactaatttgttcatctctgcccaactcactttcagtgagagcatgctggtagtttgcaattggcaattggggagaatttacactagagaaatcagcaaacactacaaatcagggtttgctttattcatttatatttgaagatgtgattgctaaacatttgccagcacacctctggatggatggatggtagatggaagcggtgagagccaagagagcttggggattccagctttcataaccagaagcatggacattcttggaatgcttatgggggtgtggagggaggacccccagcatcagcccaggagaatgagtcttgtgagctgggagatgaagtctctaaataagtgagaagggaggtgatttgagctaggaatcttggcaaatagccccagggcagaggcagaggggaggagaaaaaagaaccatcagagccaggaagatcagtggaaaactggaggcctcacagaaagcaagggccttgcttgagcagaatgatgcctcttgagtttcttaaaaaggaaaaggtaggggtaaggggctgtttaatctattaatacttcagcccactctcagcacccaaataatagggtgggtgcatcaaatcttggtagccatatacataagaatacttgtaggggttgtttaatttagggccttataaagacaataaaatgacttattgagaatcactaaaccaacacccaagtatttaatgaaaatactttttagctcatatagcttgagacaccaaactatgactatgtaaatagctataccatgtttatagattggaagacttaatgtagtaaagaagtagattctacacaaattcattgataggtttactgcagttcctttcaaaatccaagggggggacattttgtagatacaaatgaactgatactagaatttatatagaaaaaaaccaagaatagccaaaataattttgaaaaaagaagaataaagttggaggaaacatactacctgattttaagatttaacatatagctgtattaatcaagattgtggtgttgggaaaggaatagactggtagattaatggaacagaattgaaagtccaaatataaatgcacataatatggccaagtgatttcttttttttttagacggagtcttactctgtcgcccaggttggagcgcaatggtacaatctcggctcactgaaacctccctcttccaagttcaagcaattctcctgccttggcctcccgagtagctgggactacaggcgtgcaccaccatgcctgtgtaattttttctgttttagtagagatggggtttcaccatgttgcccaggctggtctcaaactcctgacctcaggtgatctgcttgtcttggcctcccaaagtgctaggattacaggcgtaagccaccatgcccagccagccaagtgattttttttacaaagtcccaaaaacaattcaatggaggaaagatagactttttaacaaatggtgttttattggatatcctcagtcagaaaactcctcaatctaaacctcacatattgtgaaaaattaacttagaattgataatatgcctaaatataaaatgtaaaactctaaaacttttagaataaaacaggagaaaaatcttcattactagagttaggcaaatattccttagaagacctaaagcactatccataaaaaaaagataacatcaactggatttcatcaaaatacttttattctgcaaaatatattgttaaagaggatgaaaagaccagatatagactgggagaaaatatttgcaaattacatatttgatctaaaaagttgtacctagaatgtataaaggtggctctaaactcaacagtaagaaaacaaagaatccgattaaaaagtggagaaaagaatgagcacacggaaagatgctcagcatcattagtcattagggacatgcaaattaaagctatgaggagacaccatgactcacatgttagagcagctaaactaaaaatactgacaataccagcaggggaaaggatgaggatcaactggtctctcatgcatacattgctggcggaaatgcaaaatggattgtatggtcactttggagaaagtttgacagtttcttataagggtaagcatacagttaccatatcacccagcagtaaattaactatttactttagacaaaagaaaaacttacatccatacaaaaacatgtacacagatgtttacagcagttgtgtttgtcacagccaatgtggaaaacaaaacaaatttccctcaacaggtgaatggatgaacaacctatggtatatccataaaatggaatagttctcagacatcaaaataaataaaatcccacaacatcaccaaaggagactttagtttcatctgtaatgttttaaggttttaagtagacagactattttcatgttctatttgttgttgaatttttaaaattgatgtttcttttattacaaagtatgaaaactacaagagcatatctctgtgcctggtcaatgtcctgtcatgtagatagattctccctcaccatagccaaaccctctctttgagcagtaggttctagccttctttctaccccaccaaattccttctcattctctcttgcatcatcaatttttctctttctaccaaattatttctatcaacaagtacacggatgggctattatttttcccatcttaacaaataaggaaatctctcttgacctcatttccccctccagctatagctttatttctagaaagcagtgtctgttctgtcttcaatttctttcccctttctctcctcactcaattcagagtttcaccccctcttccccagcaaatccttttttttgccaaatccatgtatacttttctgtctccaccttacatgacctttcagcagtgattatgcaggtgatcagtctctcctccttgaagcaccttcttcacttgcccttgaaggtcctacactctccaggcttcccttccacctcaccagcccttacttcccccactcccatctttgctggctcctcctcactccctgacctcttaaagctgcagggcagggctcagttcttgctttctttttctacgttcatttctgtggtgaactcatgcaattccctaactttacagactacattagatccaatttaagatgtcctcaattataagatgcaccattaagttaaagttccactaaggaagaagaaagcactgccaattaaactcttttcaaactctttttttttttttttttgatatggctctgtcacccaggctggagtgcagtgacagtcttgggtcactgcaacctccacctctcaggttcaagcgattctcctgcctcagcctccccagtagctgggattacaggtactcaccaccatgcccggcaaatatttgtatttttaagtagagacagggtttcaccatgttggccaggctggtctcgatcacctgaccttgtgatccacccaccttggcctcccaaagtgctgagattacaggtgtgagccactgagcccagctgccaatcaaactcttacatcctatcatcccaatttcagatgtctctttgttctcagagtccctaaactgctctggagtgagtgatgatgcttctccttcccagcacccctcttggggaacagggttcgcacccttccttctatctctttccttctaactctcttcatcacccagcctgtggaatccttatatgagcttgggatggtatcgcctgtttctacacctagctttgccacatatggttgggcacatcacaacttgtatggatttactccattgggttgtgcagtatataacctgtacaactatacattgttgcctgacttcacccattcctccaaggttttttatttttctctttataatactgtcttagtctattttttgttgctgtaactgaacacctgaggctgactagtttataaagaagataaatttatttttagcaattctggagtctgggaagtccaaggttgaggggctgcaactggtgaggggcttcttactggtagggactctctgcagagtcctgagatggctcagggcaacacacggtgagaggacccaccagagacggccaaagtggctttcatatgagacccacttttgtgataacccattaatccattaatttatgaatgggtccattcatgagagcagagccctcatgacccaatcatctccgaaaggccccacctctcatattgctccattgggatccaagtttccaacacatcaacttctgaggaacacatttaaactacagcaaataccttgtcctgaacttttgaaactttaaagcaagaaggagactctttagttctgtgcattcttccctgttatttcttgcctgaggcaatcgctgtagccttggggtttttgctccagttgggcacccctgagcttaccacggtggctagaaaaaacatgccctcactgacataggcctgggagcccatctaggagccattcacagtggcaaggggtggcccttattttgcatagccaatgagaagactcccctggctatgagggtggagtccatcttaaccaaatgtcaaggttgctgccaagggaggaggaatggaatgaatgtgggggaacccattgggtctactccacagtgtcaaaggcagggatagtattactgggatgaaagagacttgagcctgtgtttaggtctacagacaggaagcgattaaagacgttggaggaaagagcctaaatttggttaggagcaaaatcctagagaacaaatgaggtgtacgggggagggtctagatttgaaatgaaggcatgaaacttctcctggatggaggatgatgaagagacctgctttgaaggtgtaagcgaaggaagggatgtgagggcctctaacagtcttgtgtcctccaggtaggaggagcagcgcagctggagatattggtagtgtggacagcttcatggtactttctgggaagtgtccaatgtgtaattttaattggctcttttcattaaatagaattgatattattttaagagacagatcacttgaaaattaggattttgattcacttctcaaatgaagagaaagtgcctttgcctcatgtatgtgtgcagaatttgggagaatacatcatgagctcagggaatgtgtatgcgaagatgtttgaaaagtcacttgtgggaatttgcctggcttggtggttaggaatgtggactctgaagccaggaggcctgggctcacatccaggctttgcagccttgggcaggctcctgaacacctctgtttctttgctaaacagtgggcaggatatcactatttttggtatagacctactggaaggatcagaagacttaatacctgtgtgtgttttggagagttattggcacatattagatagttttactgtgaatcatcattatttataataattctctgacatgctggaatgtacactgtctttagaaatgaaatttgttttgttttcctaatttcgtgcaacctacatttttccagtgctattttctttggggaaagagcatgcagatgttccgtgttttcaatgtagcggtgtataaaatgtcatcattgtttcctttctggtggaatattaagagccagcttaaagataatctactcccagaaagttccatattagcaattatgtggggctggtgctcatatgcctcaatgaatgatttatttattagtatattgggaatggcctccctcttctcacactagcaccttttccccactttccagcccatttccaaatgagaagggctgaagtcaatcaggaattaagatttagcatttgtgggattatctttgaatgcgacactgggggggacacagtttcactcactctccatggtggcagtccaaattgctctttcgggaccctggctgtgtctaaagcctcagaatgatccagaaggctcctataacagtgccactgtggaagaaaccacttctaatatggcaggaaggtgtggccctgcttggagcccatgttttctaactatttcacatttctttctttcatccctggtgttattttttgaaattaatttttattttcagttctcctaggaattaatgagttaacttaataaaagtaaaagtcttcataaagaaggtaaaggctggctttccacatagagaacaaacataacaacccacatcctctgcagagctcctggtcaatgcattcttctagtggggctgccacacccctggggcctcaggcaagcaagccccttgtggatgacaggggctgggctcaaagcagtctctggggctgtgcctccttcctgttctccactcttttctctaaaggaaatgcactgcaatgaattgcacaatacagacattcctaaattctggaaaaccagcaggctttgaactctcctgggggaaaaaacccataaaacacaaaactgcaaggaatgagactatttggccaaatggccaatatgctacaactttcatagggaactcaccgcacttggtattgcctgatggaaaaaaatgccctgaatttcccaataaaatatttgagatgtggcaaaggaataaatattttttccctaagataaatctagctgtagatgaaaactgggtctcatgcctcggacaaaatattatttccttatttactctaagtctatatcagaatatagcctacacagcatcaggtactaagccaaaaaaggctccaagggcaccattgttcatccatgactttgactgtgtcaccccccagaaaccttgagttgggcagatgtaatcacagcagcctttggtggtttcttgagcagctgctaaggatcacatggattctgctcacacccagtgcttctcataatttaaaaatgcttgaagctgtgggaggctgcccagccctctgcattattcaaaagaaaaccaggaggcagcgacaattcttgattcttgcagataaacattctccaacaattattaagagttggattgctctaccttcatttaattccttggtgctttactatttgaatctagaatattcttgaagtctgaaagatggatagaaaagaggtaagtcatgtaaacttataaacagggcacgaaccccgctaacagacagctttgaagagatgatgattttagatcttgtgaattgttatgtcagaggaatacatgcagaagaaaacaggcaccgaaatagttattaccagagcaaagtaaatctgaacacctaaaagaataagaaaatatcttatgcttctctctactctgaactgccttgaaaagagcaagaatttcatacatgagcctgtagcacattacaaaatctgagtatgtatttgaaattcaaatgcacacaaagttcatgcattttattttccagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctttagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctccgaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggggttaaaatcgacttaggatgccgcccttatgtaagtgaccagctcccagcttgggtcccagctcctctgggctactgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggctagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgccacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcactcggagacgtgccaccttcatggagacgggagccaatcaaaggcaaactgcgttagacagctcttccatgcggtatggacaccaacattcgatcatccttgtttcagagaaggtgccgggccccagacatgtgcttatcactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcaactggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaaaagtcatagcacgaatgtcatgagtccttgtgaagattttatgattagcacacaagttacaaggagacacgataactgttacgtacgtactcattcgttcggaaatataacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagttatcatcatcatcatcatcatcatcactgtcatcatcattgacatcatcacaataagaactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcggcgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacatgaagcattgaatgctttatacgtctccatcctgattgtttaggctttgaatgctgagaagtatctgcactttgttggtcaattgtagatggtgctaatttgtggggagtttttcctgcaaattccccctgtgccataatccagaggacctccctctgcccccagtgctgtaggctaggcagctatgggcctggctcagggctgtcgggcaaggattggactctctataggttccgtttggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgctacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactcagccatccttagcactggcttccttcctccaagttatcttatgcttcaagaaggctgctggagctcctgccatcacttctgcattccagacagaagagaggaaggaagtggagggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataataggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtcttctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgtggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaaggttagctagggattctagaaaagctctctaaaggagactgacatgtaataggcttagcattttgcacctgaattctctccttccccctgtctggaatgcagacgtgatggctggagctccagcagcctccatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctttgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattatcatttatttgtggttttcctctgattttaaaataaatcaaaattaaaacacttttgcaggcccctaacagtatcatgggccccatgcactgtgcccagcatgcccaatggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattccccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcggtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcagcaaatgcacccagcaatgtctgattgatagggcaccctctgtgggctttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcatacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccacgagtggccactagtggaagcctcaatgtctccacttccagtgggctctcaggcctcacatgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagatttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcccagtgatgaagccaccgccagggctgagcctcagctcagccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccacatttcatttgctgacacccaggggcagcattaggtgtagagtgctggacatctaagggaagaggttcaattgtccatctgtttagttatttactcattattcaatgaatgttaattgagaccagtcagggcagctgagaagcagtgcggttgtgaggagggctgttagtaggggagatgcaggtgctggtgtgcttccgtgtatgaatatggcagctagtgcagggtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctctgcccccgaagtcatataagcatagccacgatgggaaggatggtcataactcaacatgcccattcatataccttgagcacatatcctgtcccagagactgctgaattattgcatgagccccagctccttccacaccaaagcccttccgactgcatggacctcaccacttctgttcaagctcttccttcttctcatggttcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtatatatatatcttttagagacaagatctcactctgtcactcaggctggagtacagtgaagcaatcatagctcactgcagccttgaacttctgaactcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgacttttttaaaaaaaacttttttttttaacctaagtagaactttgcattatcgttggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaacgtatcatatgatcaaatatgtgatagtgatcccacagacaaatggagcgtgtggggatgatttagacactcagccagccttgtcttgatggatacccatccttctctgctgttctctctttcctccatcctcaagcacagggagcttttggcgaggttagctaacttcggggcagctgtgaattagatactggctgtaagttacctccaacatccagagcatttaaacgctcggctgtcaatgattgtcattttcattgtttacatatagtcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgcgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacgcagcccctgtccgcacatcctcacccccatctgccctctgcttgccagaattatcagaatctctcaattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattactacctcatgcaggacttacaagagatcagccatgctgcttacattgtgtgtagtgaatcaatgttattctgaagggcctcctggaagcagtagggattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaatcacgaatctccaatggcttgcacacatccaggtttgctggatcctatttgtcaagaccacatgcagattaggagccttcaaacaaattatttccaagggagggcatctttctctgtaacccctaccctggcaattctccatggcctcagggagtccagccggaagctctgcaatgagtcctggggaactctcatctggaaaaaggcgctcatgacaggtggtgccaaccttccacggatgcttttcagcatctcttgggatgaggatacagaatttctctttcaccctgtaaatgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttcagagtttctttatgcaaatacagtataagcaaaaaagaatgggcctttttcttttcttccttattttccacaaaatctatcaaaatgggttttttttgttttgttttgtttgagacagggtctcactctgttgcccaggctggagtgcagtggcacgatcacggttcactgcagcctcgacctccccaggctcaggtgatcctcccatctcagccttctgagttgctgggactacaagcatgcatcaccaggcctggctaatttttctattttttgtagggacagggttttgctgtgttgcccaggctggtctcaatttcctggacacaagcaatctgcctgcctcagcctcataatgtttttttttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcatccctaggtggatggatgggtggatgggtaggccctggccttcagggaatgcactgtgtgtggtcttccagccccagcaaagtctcagggggcccgagcgggaagtcgccatcctcagggggtccgagtggggagtcaccatcctcacggtcagccgtggtttcgaattgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattgggtcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctatgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccagctcctcaggagcacacggcaccccacgtgcgtgcaggggacagctgtcctcacaggaacagccccgggacctacaggacttcctggggtttaccctcagagcacccatgaggttagaatcacaaagcccgggagtcaggagacacagggcagctggagggaggtctttactgaggctactgaggcacagcagccccgtctagaggcctccccgagaggcacttcctgaggagtctggtggattttgagctgctttttaaacaaccttctccttagcatagacactgacactgaagggaaagaaagcaaatggtctgttcttagtgggaaggcaacttgctttcaggggaacgagtttgggggaagaggactggtagaagacacgactaagaaagtgagtaggagtccagacgtgtgtgattcatcctttagggcctctgtgtgtgatgggttgacttgtgtgtcccaaaattcacatgtggacgtcctcgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtacaccatgtgaagactggacttaaacagctacaccaccagaagccgagagagaggctggaacatagccttccctttggaggtagcctggcccggtgggcactgtgatctcagacttccagccttcagaactgtgagacaatattttattgtttaagccacttattttttggtactttcttacggcagccctagcagatgctaatccagcgtgcgtcctgacagaggttgaagggggcttctcaagtcccaggtccagcttggtgtggttcagctactcaagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccgtgcgaggttggcggccgagccacggttcccatgtgagcaggacagcacagtctcacctcacacagagaacctcgcccgaacatggaactttcacccacgttgccattttcccgctccctttccctcctttgaggttcacactcgtctctccaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcaccttgaaaatccggtggagtcagttacacaagacataaccgcacacaaacatggcatttctgatagtataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacaggagtgggccaaagagaggcccatggatccctgcccacctcagaaatgtgagcaggcagctggggggcatttggactctagccgggacaacctagtggccgggcaggggatgcaggcaccacaggtcacagtggtttgctacgagcgtcagcttttaaaattttaaataatcctcttattgtaaaattgaggacattatttgaagcaacgcaaaaaccatgtaaaaaaatgtctgtaggatgtgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccagtcaggcatatttcctcccaatcctgtcctctctgtgtatttggtaattgcgtaaatcatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccttctttgctgaagagttagttttatggtaaaaatccaataaaattgtagctaagcactgaaaaaaagtaaagaattaagctcagcctccagaaatactgattttatatatatttgctctggggaagattggtttaagaagacctatagcctgttaattgcccttttataaattgcctccctatattttttgccctcttttcccctccctccctcctttattccctctgtctcttccctttcccctccctccctcccttcattcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcacatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgactcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgccggacccgtggccgatgttgatatctgctcggccggcctcacaggtgtgcgcgctgtgcagtcgcttagggcctcccctgcgcagaaggtcctggcttggtttaatgccctgctgttaccatcttaaaattcttaatggtttttgaacaaaggccgcacatgttcattttgcaccgctttgtaattacatgatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaacatgcttctagtcacctagcataggtctctagggggcctctgccacaaggcagggccaacgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaactctctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgtaaagaagcaccctacctgggagaaacttactgtctagttgtaaagaaagcaccagggggccatgatgcccatcccacccatgttcccacccaaactctcctaaacccacagctcccaaacaagttctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgttcgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcgataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcagaaggctggggacatgtgtgtagagtcccaactgtcagatcacagtgttgggttgggtctttcacctgcaggggcgtgtgtgtgtgtgtgtgtgtgtgtgtgtgtgtgtgtgtgtgtgtctgtgcacatgtgtgtgtgtgctgcttagagtttttgagcaaagtttggaatgatcaatgtgcagctttagaataatgacttggtgggaagaattgaagtgaggaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatatcacactgacattttgagaattcagaacagatggcaacacctgggcccctgcctgtgcagatgggccagaaaaacgtgacatgtgtgaaggtgggcatggggtggcagcagtttctctcgcccaagcattaagagtgttacagagcagaactgttattacggaattggtgaagcacctctgggggactccctctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggtggcccagcccggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaagaacaggagataatttaaacagccctgtggtttggaagtcacaggttctgctgcttcatgttcatgcacgagactaagagcctttgaagaagatcacttcctagaccaaggctttatgtttggattaaatgcagctcctccagatcatctcccgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattggaaagtaatgacattgaaaagaagtgaaaaaaatcacaggtatataattcagcaccaaattgatgaggacacagaggtgaactagaaaggcatcccagcggaaaccacttacagccccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtggatttggatgtgcagtggtggtccgggtgtgtggagtgggggtcagcatgtgcaaaggcatggaggtcagcaaaccaaggctgagagcacaagaggttcgctgtgtgtcttccagctgcccagtgagcacatggaggtaaaggtgcacaacttggtaagcgacaggagtttgtgtggatcaggcctgctgtgacataaatatgcaaatgatgtggtccctcgtggtagcaccctcaggatgacgcactcttctaccaaaacatggctgaaaatttttggtgtgtgggggtgtaccctgggagcccatttagaagctacagtgaaaagagccctcattgcttcagctttgagccatctgggccctcccacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgttcgaattatcaacttagtcctttattaacaacttcaaggtgcaaatttgtgagattccagacaggcagttcaatgagcagctggattttgctggttcccaagagcaaggaaaattcccttgttttaaaaagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcggttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaacttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcctgctcctggcacagtcttttctctgtacgtgctcatgtctgtgtcctgatttccttttcctagtagggccagtcaaattggattagggcctaaagtaattatctcattttactttacttctttaaaggccatatgtccaaatacagtcacattctggggtgctagaggttaagatttcaatatataaatttgcaggggacacatctccacccataacaatttgtttttcgtaatacgtttaaaatacccatttctgggctggatgcagtggctcatgcctataatcccagcactgtgggaggatcacttgagcccaggagtttgagaccagcctgggcaacatagccagactctatctataaaaaaaaatacacacacacacaaacttggccagatacagcggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgtagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcagcgattctgaccagtagtcaacaattgcaagtatgtggaatgtgattctcctgctttgggaacaagggagctcccagttttgtgggcaggatccgacattcccatcataagggcggcctcacctgtctgtacctctgacacctcagtcagagcccttggagtcggctaggccagttttggccctccttactgagacctagtcattctgtagacatacttcattctcccaggcttgggcttctggttcaacctgtggctctgtcattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatttttttttttttttttttttttttttttttttgagatggagtcttactctgttgcccaggctggagtacagtggtgtgatctagattcactgctacctctgcctcctgggttcaagtgattctcctgtctcagcctccagagtagctgggattacaggcatgcaccgtcatgcctggctaatttttgtattttcagtagagacggggtttcaccatgttggccaggttggtctcaaactcctgatctcaggcgatccactcgcctaggcctcccaaagtgctgggattacaggcgtgagcctaccgtgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcccaccacttactggtcatgtaactttgggcaattcagtttgcatccctaagcctcaatgtcttcatctgtaggatggaggtaaccataatgcctgtctcagaggctgctgctagtgttaactgtgggacacaacacagagtgaggcacagacgaggtatgcagaaaacatcagcttcgtggttttttactcttctgcacttgctgtagcattctgcaaaactattattcctttcctagactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggcccagggttcctttgaccacctcacacctaacaagttccctcactgtctctcactctcccctgaagattctaagctgcctctgtcctgctaaaactgtagacctgagaatgaagtaaggtgcttcaggtgaggcttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcgctgagcctgggaggcagaggttacagtgagccaagatggcgccgttgtactccaacctgggtgacagagggagaccctgtctcaaaaacaaaaaacaaaacaaaacaaaacaaaaaccaaatacacacacacacacacacacatacacacacacacataaaagtctcatattttacacttatgaagttaggtgggttttttttgtttgtttctttgttttgttttgttttgttttgtacccaaaagtacataacctactactacctacctttttggtttttttttttttttgagatggagtcttgctctgtcacccaggctggagtgcaatggcgctatctcagcttactgcaacctctgcctcccaggttcaagcgattctcctgcctcagcctcccgagttgctgggattacaggcacctgtcaccacacctggctagttttgtatttttagtagagacaggatttcactatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctgatgtcttatggactcctgagaagtttgtggtggtgattcttagagctcagctcccgactgctggactgtcggtcactgggcagaaacagaactcagttctcatcacctggatgccgtttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcagtggctcacgcctgtaatcccagtgctttgggaggccgaggcaggcggatcatgaggtcaggagattgagaccttcctgactaacatggtgaaaccccgtctctactaaaaatacaaaaaattagccaggcgtggtggcgggcgcctgtagtcccagctactcgggaggctgaggcaggagaatggcgtgaacccaggaggcggagcttgcagtgagctgagatggcaccactgcactccagcctgggcgacagagtgagactctgtctcaaaaaaaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacacacacacccacacacacacacccacccacacacacccacacacacacacacacacacacacacacacatccaattgattctgtttctttggagaactctgactaacacagtctccttctcagtattaatgtttttttcttggacagaaaatatagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctctcaacaggcagcaggcaccttttccctaatgaactgtctttccaggtttcactcaagccctttctatcagacttctaccatgcagctctgccaatttctttaagcatctctcccttcttcctgactgtcctgaccaggaaactccctaatctctaatatctaaagtcatgaagccaattgcatcattagatgcgcagtatatataaataacatttacttacaagaatatttttatagaaatgtatgtaaacatacttacatacatttctataaatacatttaaattcctaaagacttgtttgagcaatttaaaaaaaaaatgctccagtttaacttcctactacaattaggaatttggggcagggtgcataattgccagtgtactcacagtgactgcaattagaatgtgctgtggagtcagaggaactgcctgacagtgccgggcagttgaccctgggctgggttcagagctctccagtggccactgagaagtaggagagtgtttcctgcacaatcctgatttcttgggggaggaggtactactgcacgctgctgggaggagcctctgaaactctcctgggccaggtctcctcccgtgcttcctctccctgaggcagcctcacctcttgacgcctgtccccagcacacccttctgtagctttcctctgactcacccctctgtgtgtctttctctccaactcggggtcctgtcacctaggcctctctcctttttcctaggtggctggcagttgctcttcccttggttttctctaatttgatctctttcccacccttccagtctgccacagtcacccttgatatccgcagaatccaccctccttggaagggatgaggaagggggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttatccagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcttaggggttggtgggcagactcattcatgttcccatcccaggggtgcaggggacccttctcccttccccacatcagcccagggccacagaagctcctcaggaggcaaggaagggaatggagaggacaagagtgcctacagagtgggaaggagacaagcattctcaggtatttatccagggtaagggcaagggcttttctgcagtccaggacattagaagagtcctgaaccaagaactccacccctgccccgatatcagctgtttttattgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtatatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagcctgggtgtactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattctaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacaattatctgaatctcataaataaaataatgattacagctgcatggaattattcaggtctaaattcatataaacatatccctaacaaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagagaggattgaaggggcccgaggctgtctgtcctctctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagacagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacctcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacacacacacatgcgcgtacacacacacgagcgcgcatgtgtgtgcacacacacacaaattagccaggtgtggtggcatggtaattccagctactctgggggctgaggttgggaggatggtttgagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacaactcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaatcacaagtggctctagcatttatgtattctatgatattgggactcgtgatataaataatacaaatgcttttacatgcataattcaatttatactatgttttatctttaattactggataataaaaacataactactctcaggaagtgtgggggattgtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgctcttcattctctataattaatatacttttcaccgtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaatgttccagcttctgggccaggttaattatctgaattatcttatttcatccttacattgggaaccagatgtccccaatgcccttcagtgatttttttggtggctttgaggaaaaatgaggcccagagaggttatgtaacttgtccaaagtcacacagcaggtagatttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttggatacacatatcaggtggcatttattgctgatgacagtaaaagaaaagtgtaaaacaagataatttgtttacatttcaagatacattaagtttttttttttttttttttttgagataagagtcttgctcggttgcccaggctggagtgcagtggcgcaatctcagctcactgcaacctccgcctctcgggttcaagtgattctcgtgcctcagcctcccgaatagctgggactacaggcgtgtaccaccacgcccggctaatttttgtatttttagtagagatggggttttaccatattggtcagtctggtcttgaactcctggcctcaagtggtccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacatgtaactctgggtgtaaagtgagtaaaaatatgagacttagaagaatatttcatcatggtatgctgactggggatttcacttactgatactagaaaggttttgcatttcagaacacgatgaaataggtaatatttatctgaaagacgcagacaagtggtggaggaaccagacacccccagtgccatttgctggcttttatcagacagaaagcagaaaggagaaacatgttttatcccatgagaaggaaatattggcttgatgcctaccatgcccagccttgcactagacatccaggtagctgctccatggagaagttcacagggtggtcaggatagcacagggaggaggtaatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccatcctcctgtgtggacagtagagtttcatctgctgagggcagaggccatgttttatccatctctgtccccttctatgtccctttttctcctcccttccccattccctggcatcatattgggacttgttaagggctgaattgtgtcccatcccaaattcgtatggtgccaccccaactccagtaccttggaatgtgaccgtatttggagaaagggtctctgaagaggtaattaaggtaaaatgaggtcatatgggtggcctctaattcaatatgacttgtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacatgacaacatagcaagtaggtggtcatctacaagccaaggagagagggaggcctcagaagaaaccaccctgccaacaacttggtctcagacttccagccatcagagctgtgaggcaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccggagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatccacacccatggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaagggggaggcccatgggcagcagaggctcaacgaactccgtggcctgacttggccactaggttttttcagctcttcagccactgcctgtaggaggctagctggcattccttccttggcccttagcttgcatggatcggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaatctgagcctgaaggaaaataaattccttgagttgaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccatcttaattttccttataattgttgtgcaattataaaagacaatctgagggacccgccttgacagcctggggtaatatcactgggagtaggatctctcagaatgctaaggagcagatgcactaagagagctgcatttcactccattttattggatcttttggtatatacgtttctgtgactttagttcaatgggatggactgttgcataatactgagggctatatgaaggaggagtcgtctacacttgtaaaaaccttcttctttaggggtgggtagtgtataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggtgcctgtagtcccagctacttgggaggctgaggcaggagaatggcgtgaaccctggaggcggagcttgcagcgagcccagatcgcgccaccgcactcccgcctgggtgacagagtgagactccgtctcaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatgaagtcaagatatttcagatctgtcttctcctcctggcccagtttttaatgctttgaccccattctcaaataaactcaaccctcatgatcccgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcattccatcccctgtgtgagatggcggcagaacagttcctattcagacacctgccctcatgcctcttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttcttttttttttttttttgagacggagtttcgctcttgttgccctggctggagtgcagtggtgcgacctcggctcaccgcaacctccgcctcccgggttcaagctattctcttgcctcagcctcccgagtagctgggattacaggcgcctgccactgtgcccagctaatttttggtatttttagtagagacaggatttcaccatgttggccaggctggtctggaactcctgacctcaggtgatcctcctgcctcagcctcccaaagtgctgggattacaggcatgagccaccgctcccagcattttgtttgtttgtttgtttgtttgttttagacagagtctggctctgtcacctaggctggagtgtagtggcgtgatcttggctcactgcaaccttcacctcctgggttcaagccactctcctgcctcagcctcccaagtagctgggattatagtcacccaccaccgtgcccagctaatttttttgtatttttagtagagactgggttttgccgtgttggccaggctgatgtggaactcctcacctcaggtgatccacccgcctcggtctcacaaagtgttgggattacaggcatgagccaccgctcctgacccaaaatacctttttctttttttttttttttttgagacggagtctggttctgtcgcccaggcaggagtgcagtggctcgatctgggctcactgcaagctccgcctcctgggttcacgccattctcctgcctcagcctcccgtgtagctgggactacaggcgcccgccaccacacctggctaatttttttttgtatttttagtagagacggggtttcaccgtgtgagccaggatggtctcgatctcctgacctcgtgatccacctgcctcagcctcccgaagtgctgggattacaggtgtgagccactgctcccggccccaaaatactttctgatgctgataaaatgttttgtctactcttatgcccaaggaacagttcctcccttagcagaagttagtggttaaagcttcctctatgtttgccagtcaagaatgccacagggccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcagggatagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgctgtgattgttctgttcagttttagtccctcacagcactttcggccatttagaaagacagtatttgttctgctagagcatttgcaatctgtttctgattagcttaactggtcttgaccagtgctaagttcacacttcagctttgatttatgccgtctctatctgcagatatgtttcttgttacactatacaagaggaggcctcttcttattgacttcttattttcatgtgaacgaggtaataggtatcaggaataattagacaaggccatacgcgctaatgtcataggagactgagatatggagagtaaataataacaaaattcctgattactagggcatagaaaaaaaatcataggcaactccccaagttgataatcccaaatgtctaggcgtccttctcaaatagggaaacgtgacattaaaactactcaaaataaatgagactcagtggtatttataaccatagataaaaaagagcaagggtcctggggaactgtgccaaggcccagccctttgattcacaagtatccacaaaaacagactgtacgggctgctttcaagagaaaatgtggccatcaaggtcaacactggaagccctatggccactcattcattccatctcattggccctgagcctttcgaaaagtaggcagagaagaagcccaaagaacaacatggcaggcaggttaaggaagaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaatacaaattcttacaagatgttgacttgtacagtgtggcaaggaatactgtcatacagttgtgccaaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttttcccatttatacagacttttgttctgctcttagataaaatactaataaacaggaagttgaaaaaaaaatgtggtgcaattgttctgaatgttgtttttcttgcaaggctttatgggctacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcatagctgcaaagaaacctgaattgcccaggattaaccacctttcctttagacggtgagcagtgtgtttcacgaacacattacacattttagggttgtctatggaggtatcggcactttcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagcggtatttttggaacttgcccacccccgttcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgaacctcatcagcatatttttatttttgacatttcatattttagagtggattgaaaactaatttgatccatttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtaggggacttgggtggtgtaattttagaactttactgttgggttgttggcttgaaagatccattctcttctataaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctatgaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacaacaaatacataatcaacttcagtcatctcattttcaggggagttactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcgctggatgcaatccctgcgcaaatgctttctatgcaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaggggttagattcatagagaaagaaattagagcagtggttactagtggctggaggcaagggggggaatgaggagttattgtttaatggggacagagtttctgtctgggaagatgaaaaagctctggagatggatggtggtgatagctacaccacagtgagtgtacttaataccactgaagagtacacttaaaaaatggttaaaatagtaaattttatgctatgcctattttagcacaataaaataatacacattcatggaaacagggcatttaaatcattatgcataataaagtgagaagctagttgtgatttgcaaagaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcctttaatctagacggttcacgagttccactggtgtgtctctgggggcaggctcccagatcacagactggttccaccgtgccccgtgacctcagcgtgccattagatgggaggccgttatttcaggggaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctacgggaagtatgtatgtgagaattatctacatgatttttgtaggtggctcacaaaacaaatgtcagtagccattctatggccttggagtatcatttcccacaccttttctatggactgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcatggaaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagaaaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcagagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccaggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtgggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccttgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggctactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctcctcaggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctccgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattagggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctcgaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgctttttgtaacgcctcaaatgaaggccacagctcagccaagtagaagagagctcctaataaatgaagtctggttgcctttgaatttataaaataatcaaagttgctatttcctgctaaggagacagatacagaacaggtgataggccacagtcattactgtcccctgcttgttccctgagcccctggccttctaccttttctaactgctgtcagaaccctggttggggacttccttttgcctggttctcctgggcttgaatggcaacctatattgacagatttcatgccacagttctttttcaaacaagatgattcacaatggaataattgggtttgggaagaaggcctttttaaagcaaactatggaaaataattgatgagtagcgcagttttataaaacttttttttctattaccctttaaaaactatgttgctaactgcacatcacactgcattcatatcctgggactaataccccttgacctctgccatatgaattaaggtgaaagaagggtcataagtaacaaagtttcaaagttgaatgaaccttttttttcctgtaattttactgaccatttccctttctgtttgagagatctgtgcggtcctgttgctgaggttctgtggttcaggggtgttatcggcgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccatgttcctggttgaggatacctgaaggtcgacatttatctgggatcttttgctgctgctttggtatgacttctatcaagatagctttcgacgaggtagaacgtttgctttcactctgggttttccttggtttcgacaatttttaagtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggtatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggcgacagagtgagactccgtctcaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcaatgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttagtggaaaacagaaaatgaagtgcaagagaccctcatttccggggcaagaattctgagttccttggcttctttcattcttgtctgactttcccccctccagttgcagttatttctagattttggtaaattattcattgcttttaaaagagaaaaagctcgattttctaaatctacagttgagctagccctaacctctaaagccagattgctttaacaaaattgtcatcattttatacatgacagattggcttcaaataaaatggtaaatgggaggaaaagtatattttgcttacacttaggaatgcctgtaaacgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaaggctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcgtgtttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctactggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcacctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttcattttcaatctgttgttgaaattcagcaaaacaaatattttaaaagccaagtcagctttctaccgttttgatctgaatatttaatgctttataaaataaaaccctgtgttttaattttaactagtttcattctttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattattctttttccaggaaaaaactgatgaggttgtttcagaatttgaatttactagaattccttttttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaaactcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaaaagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctggctgggacagccacacctgcagagagggccctgattggggtcgtggtcctgccccacatctggcaagcctgtgcctcatgtactcacagtcaccttttttatttgatccccatccatcctaagtccccaccccaccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaactattttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcatagggttgcagtgaggagggttgagctggtgaaaacacttctgttctcctatttgagagagatgcagcagaattcatggctgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaactgcagcctagagccagggtgctggaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaaatggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacgtaagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccggcttgagatggtcgtcttaacagagccttgctctgttgttgctcgtgatcagcacctggcatctgctgccaaagactctgcccacatcagagactcttgatgtctgtccggaacaggccaggacactctcatccacgttgctctcattggattggctcattaaccctttcttctatccccttctcactctttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacctggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgataccaatagcaccaacctgagagggctggggagatgtttgaaggaaagcttggctggggagctgtagctggcctgtggtacatgcttggtaactggtggccaggagacccgggtgtgtgtcctgggactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctgatgtgagtcaagaatggacaggctgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagctcgtggtcttcacttcctcctaccttgagacttactgcgcagaaagtagaggcttggatggttcaacttcaggggcaaaacagcctgccttgggggtgggactgggggtatgcatctgtgccactgcttctctccctttgtcagtttaccatgccagcagccttctgtctgttatcgggaacagaaagagcacgatttgggagctagctggggagcttcccgaaggttgcctgagctgcatttggggcccctgatgagggcttctattcagggtgatgtgtgtgaccctgaggccatctctcagatctggggggaagtgaggttgtgtacccacagtggggagacctacctggcggctcatcaatattagacacctgcaggaacagcaggtcagccaagccaaagagtaagagtggccctgtctgtgactagacgcttcttcagggttgcctcaacaccggagtggcgctggtggtctccacccactcccagtgtacgctggcgtctaggaagccatgtgtgtgatcggccctgaattaggggcaaaacttttagttctcagatgaactgtcgtgggtttattcagtgataactagacagccaggccaacatggagttgattcatccatgcaaaacctcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcgatttttcactgtcactagccaatgaggcctttaaggaaaaaacagataagactgtaggagtttatatggatccgttaactcacttgtacaagacattgggaaagatactgggggtgggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgcctttggccacatttcctaacaccactcagcagagccctgccagcaaaggtcattgtgcaaaaaatgttatgccccatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcgctcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgtacctgggaggccatgtctcccggggaggctcaggacctcattgggctggaattccacagggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgctgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacaagtgtgtagcctagaagcaataggccataccatatagcctaggcaggtagtaggctatgccatctaggattgtgtaagtataccctgtgatattcgcatcacaaagaaattgcctaacgatgcatttctcagactgtatccctctcattagcaatgcatgattgtatctgtaaaaatctaaggcccagacctcagtcttttggtgttcattctgctggtttactcagtttgcatcgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactccactcgttggggttagagatggagaattagaaccaaagctgaatcactttctgcttatcactcatagactgccagattttcttttttttgttggagggaaagcaccttacaacaaataataatactattttgaatttcagagctttccctttttcaaagcactttaccacctatgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttccctttggttccatcccaggtttctaaccttgtgcctaaatttttgggggccctttcttcctcagagctttgtgtgatctgcaaatttggtaaatatgccttcatttaccatgtctctttccaaggtgggtttcaccatgttggccaggatggtcttgatctcttgacctcgtgatccacccgcctcagcctcccaaagtgctaggattataggcgtgagccaccgcacccaacctccaaggtgttttttaaatggtgaatgggacagaacgcaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactagggactcaggagcagcctggctgtctgcagcagctgcaaagggagcaaaggcaagcaggacttccatgagctaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggagtgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagctttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaatggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacccctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcacttggcatcccttcctgctgcagaccccactggaatctcctcagaaggggacactggtggcttccattggccctgcctcccgccagggctgtgtgaggatccacatgggctgggatgagggtggatgttgttctctgaaaactgtccactactcaaaagtgatgttgtggccgggcacggtggctcacaactataatcccagcactttgggaggctgaggccggtggatcacgaggtcaggagttcaagaccagcctggccaacatggtgaaaccctgtctctactaaagatacaaaaaattagccaggcgtggtggtgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaatagatgttgctgggtcaaaaagggagaggccccaccctggccccctagcaccagaatctgcatttcagcaagatcccagggggctgtcacagttgctagctctgctctttatgcttgcctcagctaggtgctgagtacctgctagaggtgtgaattcggtctttattcttcagaggcactggtcagagggtggaaacatcagacagggactcctgggcccccaggcaggactccatggggatggagcgggggatggaacatttgagaatcaccaacatgcagcaaggacattagtgagaaatgagttccacctgccagaagggaagctgagaagggaatgcacaaatcaggaaaatataccatcaaaaactacgactcttctacctccagccctcgccaccaattcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgacgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacgaaagtgtgcactcaagcatgtgtgtttggggtgtgtgggtatgggtgtgagacatggtcttatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgtggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggctttgggaggcaggaatctctgaatggatttccttcctcctgccctgcttggataggggcacttgtggatgcttctggctccaacttttgtgtgcagtgactatgatggagaagcaatgagctccctctacagccttctgggctgctggcatccccagtatgtttctccctggagacactctcagtgaggccaattccaggctgctgggggcttttccttctgtcactgtcgggcctccgcagggatctgcctggctgcaagatgctgatgggtggaggggtggcccacctggcctccagaagcaggagctccctgcccactgcccgcatggccctcagccctggccctcacctgttgcccctctggaagaacgttgctcttgttagctaacaaccacctgactttcctcgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaagccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacaggcactgcttcctctccctttgacaggcaggacagcggcccgctcccaaatctgcagggtcagacgtggtagatgaacagtgatttgcctgagtgtaaatattgtgatgtctttcttttcttgaacttttaaccttgctggtaaacagggtgcatccagaattgtttttctgagaactgagttttgaggaaataggggggaaaagggtttttattagctaattttcagtcttgtgcgtgactcaaaaccttcttattctgtttcttaactttgcttcaggagacacttggccaaaaaatagctttgtttttaattgatgaaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacctctgccctgtaatttcatgaattgttcaatgaagatgtgacttattggcttccaagcttcatggaggtgttgtccaaatacaaggtccataaagtgctttggaaggcttggaggaacaaagaaacactcttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcagaccgtctttcaaataatgctccagttggaaagtaaactgagtacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaagagtgttaaaacaggcagcttgcgggaagccaattgctaacattctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggctttactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatgcaagatttgttgagagtggtacatttgaggatttatttgtaggctgtgttaatatactttcgagaaattcagttgtatctaattaatgcttttttccctttgattcattccaaactatttaaattggaaaattgtgtgctatttgaagatgcacttcaaaactccttttgttgtcatggtgcctgttgtcactgctttttgttggttggttcttgtttctatagggcccctcctctttgggatcgtgtgggtacagatgagactcacagttccctagccagatgatctatagaagtttttcaaagactgcataggtagtgttactgaacatagttcatatgtggtgtgtgtttctaaccttgcaagctccttgcaaaactacataaatacttgtatttaagttgtgctgtgcatatgaacataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaaccgccgggcagggcagagggaagtagtgtctactttaaatctgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtctttaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagtcagtttgtttaaccaaactgcttaaaatgtcaacttagtttgcaaaacagccctatgtggttggtggtattatctgcaattcatcaccaacacactaggcccagggcaaagctaaaagcaaagctaaaaacaaagctaacagccagagtgaccagaactgggtctcacctctgctacacctgtgccagggagaggagatgaacactctaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccatctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacgtcaggaagagcagtgtagtcagagagcgtggcaaccaccattcgcctggtagacagctcattccatctgccttgcatattttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttccttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacatggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcccattcccagtctctccatgaacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaagaccagagagtaaacattttaggctttgctgggctgcatggtctctatcacaatggctcaactctgccattgtagcatgaagcagccaccggtaatacatagaggaatggcagaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagaattctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagaatctcccagaacctcacaaatacccccgggctcctggtttgagggactagatgggaagcccccctccctgggagaacacaggcctagagcttcctggaacttaggcagcttggtcagagagtgtgaggactctgacaggagcacgggtgtgggacattcatgcctggaaggccctcgacacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagattgtggaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcattatttctctaattgaacgttacttttaaaaacagacaaagagaatcaggaaaaatgatgtgaggactttaggcccagatcagtttccgtttcaacaagatgtgtcaggatgatgaaaatgtcgtttggttgagccgtggtcatcaccccgcattgttgttctttcatgtgtttgtgtgtgtgtgtgtgtgtgtgtgtatgtgtttccctctgagtttcccagtagtcattactaaaaaaaaactcctaaactgactcaaaacaacaatgacaaaaacaaaagcaaacaaaaagacccaatcaccacaggcgccattcaggccctcttgtctgacggtgttcacagactgtgcttgtgtttttggatgtacccgcttccttttctctcttactcaccagatatcactgggaatccctccttcttgctccaggaccctaaaggagacactggggtaagactcatgtgggtcttggggcagcccatttccaggagagcatgacccccaccccccaagccccaggaggacggacccttcccagctgaggtctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaagtggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcataccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgcaagggcacacgcagggtgagtcttggagctggaatttgaacctggggaatggcactcctgggccttccctcctaactcatagtatctacaacctggattgtagacctagctagtaggtcttgggggttcttccctcctaacccctggtatctagaacctggatcgtaaacctagctagtaggtcttggtggttcctcacatggatggaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacgcatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatggacacaggagagcgagtgagcaccccaccccacaacagtgtcctgaggaaggcccctcttttgtcccctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacatctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcatgggccccagactcatgggaactgggggagtgcccaagtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggacctcggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccctcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgctgcctctcctttcttggtacatgccagcatggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcaggacttgaggaatccttgtagtgccaccttacaaatgggttggtgccttggaaacccagtcctggcatcaaggccttggcatctgtcaagcagaagtgtgcctggggtgtattggggggggggcagtgttggagccgatttcaccgatttctgtccctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtgggggtggtaggctggcggcacaggggctgctgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttctggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagttcctctagaaacacaagcatagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagaagagcttctccctcctggtctttaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggaaagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacagtttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttattagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacacacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctctgtgtgtgtgtgttcatcttctttggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttccttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttatttcaaaggtcaaactccagtttctctctgccagtgctttcaatttttaaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataaattataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggtgaatgaattttgattgagcacagattcatcatatcttgccaggtttgtcctttatttgtctccaatgctgatgcatctggattcacatcaactccatccactacacttacaaaggcaaatgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgtgctgtgtgtgtgagactgaatgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccccactagatgtggcccctccaccttggatttcttggcctccagaagaaaataataaatgcctggtttcgagtgctctgttatatgccacagaaaaagacaggagtggagaggcttataacccccaggatggccacaggcttatatcccttttatcctcaggggtgaacccttgcctacctgtttttccatccagccaggccagcactgtagcagagggaaaacccaagggccccatatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcgcaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacactggtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttagacttgtccatttggctctgtggatatgggttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagacttcatctcaaaaaaaaaaaagaaaagaaaagaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggagctagaggccctcgtccttagcaaactaatgcaggaacagaaaaccaagtatcacatgttcttacttacaagtgggaacaaaatgatgacaacatatggatacttagggggaacaacacatattggggtctgttgggtgagtaggggatggaaggagggagaagatcaggaaaaataactaatgggtactagtcttaatatctgggtgataaaataatctgtacaacaaacccccatgacataagtttacctatgtaacaaacctgcacatgtacccgtgaacttaaaataaaaatgaaaaaaaacagtgatagtacctacctcatagtattgttcttggaattatgttagccattatataattcttaaagagttcttggcatgtagaaagtactatgtaagtgacagccatcgttgcttttgtaatgattattttgcttcctttctttttgttcattgcacatttaaatttctaaaagagattccaatgtctttattattaaggtgagaggaaagcctgaatttaccttccccctcttcccagctctgcccctcacagcccccagacctttgctttgcttgctggacccaaagacacacaattcttgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccgcctccccatcccttgtctgatggctagtctccctcccctgagggccgacgccactgcttgccaattttgacataaggcttgaaaccaatgagtgtccagtgactgggtgagtttggttcctcctacttgtcttggcaatctcaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggtctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagccctgggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttacttctcaggcatgagccaagggtcacattataaaagctatgccagattccccatagatgatcctctatccaaaaattaggagctcttaagtcataagatgagtcaaatctacccccttagaactcaacatagctatgttcagttttactggaaaataagtcactggaaagcactttttatggttttctaaatctctcttatgcccaaagaagtggttcagccctggtctaaggcactgctcacttactctgattgccatcttcagcatcatcgtgatgatgataatgatgatgatgatgatgatgatataacaagatagtagcaataacaagagctgcctcctcccagttgtgaaattatgtttatggatatctggggctcactgttctctttaggaatgacccctgagggctcatggctcccagcccccagtaccgcaggtaaagcagtgaccctatctccagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatcgactgtttctttttggttgtaaaaccctgaggatctctctgcatttcttcccttcccacccccattgtttaagcctcagtttctcctttgagctacctgggattctgatgggcaggattgctcggtaagcgctaagctctgtccacaactcagccattttgtgtctctggtttgctttggatggcagttttccccttatcctgcccagatttccagtatccaagcccgttattttcttatattcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggccgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcgtgaaccctggaggcagagcttgcagtgagctgagatcgcgccactgcactccagcctgggcaacagagcgagactccgtctcaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacaggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaatttccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctgggcaggatgcgggagaggcagctgagctgcttattcctcagtgtgagggctgctgggagcgtggggtgcagctcagcttggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtggcagatcgcttgagcccaggagttcgagaccagcctgggcaacatagtgagacccttctctatataacataaaaatttaaaaaaaaaaaaaaaaggagaagaaaagaaaagaatctcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagcggcaagagaataatgaggaaaaagcaaaagtggaaacccctgataaacccatcagatctcgtgagacttataaactatcatgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagatattaagagggctgccaagggaggaggagggaggggttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacatgatgtatttattaccattgaacaatacacttaaaatggtaaagatggtaaatcatatatgtatattttacctcaataaaaaagaattaaattaaaaaaataagcaaaacaaacgatcttattttaccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcacttttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctatttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagaaaatatactgtgtgacctttatccagtttcccctaaagataacatcttatatgatagtataatagcactgccagaatattggcattgatatacttttacttgtcctcattgtgtgtatgtgcacacatgcatgtgtatttagttccatgcaatcttatcccacatgtagggtctgtgtatccatcaccacagggttcctcttgctgcctttttatagccatacctccttccatactcttctccttaacccctggcaaccaataatctgttcttcatttttataatgttgtcatttcaggaataatagactcgtggtgtgcatgtcttttttgctcagcacaattctctggagatttttccacactgttgggcacatcattatccaatgcccccttttcttgctgagtaggactctatggagtggatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacagacatgcctgtgaagaggccaaccccagtgtgcagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcacccccaacattctgtgcctatgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagagactcccaagccagtcctcacatatcttgctctcattactagggcagagggttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggaggttgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcccgggcaggcgacagagagagactgtgtctcaaaaaaaaaaaaaaaaaagagaaagaaagaaagaaaagaaaagaaaattagcagggtgtggaggtgcacacctgtagtcccagctactcaggaggccaaggtgggaggattacttgagcacaggaggtcaaggctgcaatgagttgtgattacattgctgcactccagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacatgaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccatgagcaaggcactggcagatttggtatccagtgagggcctgctctctgcttcataaatggttccttctagctgtgtcctcacatggtggaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacaccaaaacctgctaatgacattttaagaaaggaaaaactacagaccaatatctctcataatcatagatacaaaaaaatctttgaaaaaattattgaatcatattcagtaatattatataacataaccaagtgggattcattccatgtatacaaagctggtttgacattcaaaaatcaacgtaatttaccatatcaatgggctaaagaagataaatcacatgactatatcaactgctagagaaagtatttgaaaaaaatcaatacctatctacaataaaatctctcggcaaactagaaacagagggtatctcttcaacttgataaagaacatgcacaaaaagcctgcactaaacgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaattttaaatgaaatttacattaccatttacaatagcatccccccaaatcagtatttagttacaaatttgacacaatctatggaaactgtaggcaaaaagctagaaaatactggcaaaataaaataatctaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaagcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaatagagaagttggactttattaaaattaaaaacttctgctctacgaacaattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtaaacggatcagtggtttccaggggcctgtagagatggaagagtagagtaggcaaagcacaagagatttttttttagaatggtaaaattattgtgtatgatactgtggtggtgaatacataacactgcatttttcaaaacccatggaattttacatcacaaagagtgaaccttaacatatgcaaattaaaaaaataattaaagatgttgggggattccaagatgggatgctgagtatgacagaagactaactgtattacaaatgtataaaataattccactgaaggggtgggaggaaagcgtgctgaccaagtggcattggaagtgagtggagactgtaagactaaaaacataaggaactgtccacaaccctgtattctagtagataaagctctttcccaaaaggatataaattctgaagccactagtcacacactctgaaatgtgaagtcactggatggaggatggtgggagccaggtttatctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcaaaataaatttccccccagaactgaacagaacttcacgtacccagttaccatgacccacgagggtcatgaggcacatgccggtactgacatcccacatcttaatagtcttgtccctggatccagacagcaagaatggcccagatttaccactattttttagtctcagagcctgttgcttcagagatggaggaatatgagctttctggagcccaggaaatgcattctaccacatgctcatgttctcggagctcacccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctctatgtccttcctttaagagttctttcaaaatctccagtctcataatcccacaccttaactgtagcatcctctgaagcagagaccataacactgaacacaggatggaaaatgactcgaatgattggactcctgtgaccactcaatgtgtattttttctggcagaaaatacccattcttttgggtcttgtttctgaccaagaggtccacctgacgtaaattcttcttttgcttcatttagcgttgattctaattccataaacttcttttgtaatctaataacagatgtccattttttccccaaaacaccagcctactttatttcttcattcatatctaattcagcttcctttttaaaaactgaatatgcctcttcgtagccatttgaacgaagataatctgctttagcttgatttagttcatctcgttgtctctgggacagcaccatcttggctgtaatgtcaagcttatctcatatagtggtatgtccctcctttgggaaatgaaaaagctttttgatccgtggacgtataatataaatatgacactaagtgtcttccactcagcggaaaatgattcttttacaaatgaatccaactagtaaccagaagatattcaacaagtaagattcattctactctcccggccgctggattctgccactgccccgccgctccagctctgtctgtcacaggagctgccccaacaccctgacgtcactgtgccaccaccgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttagttaatcacatacatatgaataagtaaatggcagagaataggcacatctccagagtggtggaatttcaggtaatttatgtaatagtgcacccccaaggaggtggagcataattctcccctccttaaatatgggctgcacacagtgacttcctttcaaagtgtacagtgtggaaagggggcaggggagaaacttcacagtggagacgtccaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatggtgttctatggtggaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctctctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaaggtgaaggggaagctaacacatcttcacgccggagagagagagagataagggggaagtgctacacactttcaaacagccagatctcgtgaactctatcaagagcacagcaaggcggaagtccacccccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcatttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgcccagtgcatggcacttttacaagaaatcttatttggtcaaccccccaaatatcacagaaggacattattattatctccagtctgcagttgagaatgctgaggctagaaagtggttaccactaaaagcaaaccttttctctctttcccattgcctatccaccctgactctgggctctgacccatacccacctgctcaaggtcccaggtaggagttgcccattcttttaagtatgagttcattcatacacatcaccatgtgaggcttgatgtgacctcagtaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccatgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggggtctgtgcagcctgattgtattggggatgggcccctcgtccagttgcctatgaggataacctgcggagaagatcagatggagatacctggacttatgcagaggcgtgttcgggttaaatagaaatgcccagggtccaatagagggaaccttccaacaagtgtatgagttggcctctcacccgacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagggtgccagggattttggtaggttccgtgcggacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgaacttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggttaaaacaataaagcagaatcgatgtctgtagaacagagctggaaggggcctcatggttggttttcaaggtaaactaaccacagacatcagttttccactcctctgcctttttagcatctgggttcatcttccaggaaggccataacaaaactccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtccgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccactgtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccaccctcgatggcagcctgcccgctgcgggcctgcttgtctgctcaaagcagaggttgacttgcgcccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcagagcagggaattaacctgctgcccagggccgggccagcgaatgcttggaaggaaagcaaagcgcacgggtgtgcattttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagggctgggcctctctcaggaggtgaaccatcccaagggtcatggaaagagctactcattgtgggcctggggtgacagtgacccatcctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcacgtcccactgcccagggctgggaaggtccagtgtgcccagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaactcaaacccaccttgtcacccctctccacccaggccccacttcctgctttgctggggctggggggtcagaagtaacatagctagagacagatgtccatcatctgtgcttgtgatgacaaaaggaggtaacaggagtacagtcagaccctcactccttggagccctgttgtgagccgctcatggcatgcaccattctctgtcctcacaacagctcagacgggtaggaattattggattctttctctaaacgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctggctctatctgtgaaatgtctcaagagtccatcctgttgtctcccatcccatgtctcccacttggcccacagtccagactcttacctgtccagactcctactccagagagagccggcaagatctttgggaaaggcacattgagccatgtccttctcccccttggaactcaacagtggcttcctgtcactctgagaacagaatgcagcctcctccctgtgcatgacaagcacctccctgaggtcacagctgtgtctccctgactctgcactggtccagtccagcctcaaggccttaaatttgccactccagacccctggtttggaccctggactctgaatacattctggtcttttcctcagggaggtcgaggcactgtcctagcttgtgacctgctcccatacctattttctcagggtggaagcagacgctccaactcccacactgtgaggctggtaccattacctccaagacccaaagcctgtaggaagtatagcaggcctcacccaataccctgcagttccctcacttgctccaagtgggaggtgggtcttcacgggtccccaagatgagggtcagtggctttcctctttcacaggctacagtgggagcgagtcttccaccatgggacctctggccagatctcagggctctgtggttgggggaaaatggctctctttcatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggttgggttaaatattcagtggctgcccacacaccacttactctattgcttcaaaataattggctttcacttatcaggtctactagaatgactgtcttaaaccagtcacgtggtggaagcgtcaccatgtttcttgctcagaaaataccctttcaagggcttttctaggggagccggaacagtagccaattctagtgggacctttaagaaacaactttgcccaggatgatatttgagccccctaaagggccaataggggtccctctattcaactttccctccgagtcccaccaacctccccactttggttccatacagcttggattattgccctactagttcaaaactgaaagtttcaaataaaaaccaaaagacaaatgttaagtcacattgaattgataactgagacaatctgtcaagcatattttgctttcctgatttttcaaaaaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggtcatgagactgccattcctgtgtcctgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagaccctgtggatatttgagtcatgaccttgcctcaaggcttattcatgtattatttgtttatttattgttaacataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattattggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacagcctcaagagaacatggagtcctttgggatgctgaaaactgtaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcatgcggagaccaagtgtggaggggatttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctatgaacacagagtgtgcatttgatggacagtatttgctctgagactgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccattagaatggctaatagcaataaaacggaaaatatcaagtgttggcaaggttgtggggaaattggaacccttctgcacttttggtgggaatatgaaatgctacagccactgtggaaaacaggatggcagttcttcaaaaaatcacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgcgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctataatcccagctactcgggaggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggaaggattcaaaagagaggtgcacattcagccagacactgagcctgttgcccgtggggattatgcctaagaggaatgagataggaggggttatgttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggacgtgagggctgcaggtaggagtttgatggcagatgagcctcaggggttcaatgtcagctgggagaagcaaggccacttccagactcagttctgccactgtctggcagtgaggctctgggcaaaccattttgttttgtctctggtaaaagaaggctgtgggcaggattgggctttgtaattgccaaagattccagatctttgaggggctctgtcttcctaaattctgtgcagcctgctagcctctgcaggacagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctggttggcttgggaggtgagattagcttcctgggggcaaaaaggagccatatttgtcttaatgaggagaaaagagcaaaatcaaagcattcaaagaggataaaagaacacttcaaagaggataaaagaacatgttcagttcacaattactgcctccctaaccaggcaagtgtatgatggagaatcctgttatcctaattcaagaggacaatgccaaaggcttctcttgctggctgagaattgttggggagctccctgcccacggagggcctgtttgccagatccccagccccctgcagacctctgatctgtgaggagctggttctagtgattcacacttgcttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctattccaccagcaaatcagcctggtgagcaaacagctgccttagacaaatggggttgagtgtaggggtgaaacctgctgcaggattttagtaaattctcagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgccttttattttctttttattggatgagaagactttgaaagacacagaaaaacacagagaataacataaatacctgtgtagccacattctaggagtaacaactgtaatattttataatgcttactgcaatttattttttaaaaataaaataactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtagaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttctcatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattactgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtctcagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtactttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctatagaagccagctccttattttaaatcccatcctgcttgactatcaaagtcagacagagccttcctaaaagctgaaacacacgcacagaatgagaagtccctgcgggagcaagttcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccatctgcctgctgagtgggcaggggcccaagatcgctgtgggcaattccaagccagtactgggagctgacatcaaaccaggaaagaacacgactgtttttagctgatgtagcagtacattttctttctttccttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaattggggtttttataaacttttataatcacattttctgctgaggttatagatgactccaagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaatgtacttgaaaatatgttacttcacattggaacattcaattttatcttaaggatataaatattcaattttaccacattaatctttgtactgagataagccaaaaataacgtaaactgacaattgtttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtattttttttttctgttataaagggccagggctctatccgttggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccaggaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttcttttcgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagttataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggttttcatccgtgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacaaggttgttaagcttccagatagctgaacatgtggaggttcctggagagtggtgcacccagggagggcatggaagctccgtgaccctttctccatacctcaccctaggcatctcttcatctgtctcctttgcaatattttttaattataaacccgtaaacataggtaaacatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtttggttcataggtatatagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagaatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcatcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaaggaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccatctaaagaaagtatgcaaaaagaaagctacagatcaatatctctcatgaactttggatgtaaaaatcaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcgaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgcttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtcaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggatcctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaattttaaaaaaatcactggattctactcaatagtagaattgatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaatcattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcaatgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacagcaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttctacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggtttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaaaacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgtacccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttcttttttttttttaaatggagtctggctttgtcgcccaggctggagtgcagtggcacgaccttggctcactacaagctccgcctcccaggttcatgccattctcctgcctcaacctcccaagtagctgggactacagcgccactacgcccggctaattttttgtattttttagtagagacgggatttcactgtgttagccaggatggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgagggcagatgatcacccgctttaggagccattcttccaaaatcttaagtgagtgaaaaagaagcagagatagctttttgtatttgcgcatggaggcagagttcatctgttgcctgagctaacagtatactattcagcccctagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccgtttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaaccctaaagtataaaactcattggtaaagcagacacacaaataagaaagagaatggaaccacatgttatcattacagaaaaccaccaaactgcaaagataaacaaaggaaagaaagaaagaaagaaaggaaggaagaaaggaaggaagaaaaaggattatttaaaattatcagaaaacaattgaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaaaaccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttagcaataatctatttttaaatcaggtgtgtatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgatgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcacttagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaagatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaagtaaaataactctggtaggttctatagcaaatgctaagtaaagtaaccgctggtttctaaattattacgataatctgagaaaattatttctttgaaaaaattatagaactttcaaatatgcaaaaaactctagagagtaatataacaaatgcacttaatagggacaacctttaacattcagcagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcgtgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaacttttctgtccataaactcattgtattagtccattcttgcaccgctataaagaaatacctgagactgggtcatttacaaagaaaagaggtttacttggctcacggttctgcaggctgtacagcgagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccacgataacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtgctgggggctgggaaccagtgggaataaatcctatgggtctctgcccttgtggagattccagagtagggctgcccggatgttcttgcattgtgcacagtgcagagacaggaggctcccggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtggctccaacaccatacttaagcttacttcaaaatgacttatacatctctattttccttaaagtatgcgcacagataagaaaagatggggtgaattttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcagcctcccaaagtgctgggattacaggcgtgagccacggcgcccggccaagatggggtaattttgatgtccagacacaagttgtcatttaagatgaagcttcgattgtaactctatgaagccctgctgaatattaaaagcttatagaaagcagcttttctcccccaggcaaaaagagcccttcgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggtggtgcatcaagaccacagaagccggcccggccagccttcccacaaagttacttgaactgagctctccataagtacacatgcgcacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttgggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggcggaacaaggctggaaaactggtgcatggaggaaagaaaaaaaatgggaagggagaatggacaggtaggaaggaaggaaaggaggaaagggaaacggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaagccttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagaacgtcttaaaagatatcaactttgactcagagatttcaagaagacgctctatccgaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataacatcttatggaaactttcagagtttcaccagacaaaatgccccaggctttggctttgcagctggtgtctacagctgagcctagtccttgaagtaatcatgactcagcttattcaaaataaactcttcaagaattgcaaactctcctctcagcgcatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattttgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgattgtgcaaaaaaggaagtctctgccaagaaactaactgaatgttagtgcctgttctcaggactttccataaccctgctctactaggattcctttcaccctctttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacatgcaggagtatcaggagcagttagagataaacagctggctaataaacacatgaaaagatgctcagcatcattggtcattagggacaggcaaatcaaaaccacaatgagactctacttgactcccattaggatggcgacaacacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaatgttttggaaacagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcagggaaggtccctcagacataaaatactcacccatttagaggaatgacaacagcaaacgaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccgtctctacaaaaaatgaaaaaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaacacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagctcgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactatcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagagagagaagaccctgactccaagccaaacccttcaccgagggaaatgcaccaacactcagagggttcttgtttagtaggtgagcaagcagccaagcattggccttccccagggcaggggcataaggccggtgagcagctgagccaggatttgaacagcagtcacccttggtgaggcagaagcagatgaggatatgaatggggatggctaaggaaaggtgggcttgcttgcactggggagaggccttactggggattcagaattgagggctggggtttgcttccccggagggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaatcatttctaatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacacccccgtgggcttggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacgatggaatgctctaaacacgaggcctcaggggacagccccggtcctccttgtcagagcctgctctagtttgggatccagcaggaacctcaggagcctccttcactttggtggagaggactgagactcagagcccccaagcgcaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcttgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagcctgggaagacctctgctgacattccctatgaccactgtgacggtgcccccttcggctgcctcccccctccgtatggagagcgttccagccccaggctcccagcgcctgctcccagtgcctgctccccggcctccatcactccacgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttctagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacgtggtgcttggcatttatttattgtttatttgtttatattttgtttttggtttgtttgttgggtgtctgggctggccaggtgaacttcattttctgccctcactgagaggttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagtggccaggacagggagcagaaggtgactgctgtgctgcctggagctcttctgtccggaggcttagtgaaactagagaaactcagtggacacactacaagacttcagagatactttttgtaaacccaggaagaatcaaagatatgaaacatgcagtaggcactcactaaatgttaattttcttcctttttaaatatatgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtccctgcactggagttgccagcaatcacacgggaaggcctctagtctagagagacgggtaggagagagacgggagcacatcagaggagcgcagatgctagtgcacgggttaaatagtctcttacacatctggttaagatcacctcaaattgctgtggggttccatagctctctacagcccaattccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggcgtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagccgtggggggtctctgtgcgggatcacccctctcctaatacccctggtcccaggagatggggaggatggagacaaggccggtgtgggaatgaggtggcaggcttctcaggacatgagctgccttgctctgcccccttgggcctcatggaccccattctccctgctggagttgatgttctggcagactgggctgccccttggcccagttcctggaataccaagtaattaggtcatcatcggggcagcggaggccagcctctgatattctgcggcatgttacttgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttgtacagtcttctgtatgtgtgatgcattttataatatgagtggtatatttcacaatcaaaaacacttttaagaagctcttttgccttggctaactctcgtttgccgtttccccagggccagccagcccggcggagcatggggaggacctgaatctgccccggcactgtcctaccctccacaacatgctcaagtcacatcctgtcctgctttccattgcctctggtcactgtcacttgccaacattctgaacatcccactgccttcaaccctccccacttgttcggcacaatatggaaagtgaaaaaaaaaatgagttgcagagagccttgcttccgggtttggaatccagctccatcttgagtctgtttagagaggtatgagtgctttctgacgtagggcacttatcactttagcacacagggggctgtgtgatggcccagtaagagcctgagctttggagttacagagcctgggccttctcaactccatccctcatgggtggtatagatggttcttccctccctgctttccctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacgcattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccaccctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaagtgagaaaattgaggtaacccatgggcagagcacagggcactttgtgagcactcagtaggtgcaggctcctttctcctcccctctgcctttctctccccacttactcctgtcaagtaacttcacctctcagaaagcagcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagctcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgcagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtaccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaattgtgtgaatttagactcttggtagatgctgcctgaccctgggctgcctggagcactgcatccctgttgcctggcacacagtagggttattgtctctgagtagctgggtgaatgtaggtcagagctgggaggcgctgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccacactgcaggagctggggaaagggaaatgtggtaagaggtgaggaggagaaggacctgatggtgaggatatcacagtctgatttttattttttaaaggacaccttggttcctgcaaaggtgggaggggaggagaggggcattggtgagtccataggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcc
